United States Patent 12,576,115 (BACTERIAL COMPOSITIONS FOR TREATING AND PREVENTING HALITOSIS) - sequence listing, part 23

SEQ ID NO: 33 - DNA, 2478648 bp, Lactococcus lactis
  source 1..2478648: mol_type = genomic DNA
gctaaatgtaactgataatcccttcgttctatatagaacgttttcaagtgatatagtgactttttagcaagtttatgataaaattaatacgataatttctaaaatgggagagagtggcttggctataaaaaaaacatatcgcgttaaacgctcaaaggattttgaccaaattttttcagcgaaacatagctttgccaataaaaaatttgtggtctataaattaaacacaaatcaacctcattttcgtgtaggtctatcagtaagcaaaaagcttggtcatgcggttttacgtaatcgaattaaacgtcttttacgccatgccattgctgaatttaagccttatttgacagatgaagattttgtaattattgcacgttcgggtgttgaaacactcagttttgaggaagtaaagaaaaatctaaaacacgttttgaagttgtcaaaaatctatgtggatggagaaaacgattgaaaaagaaatttagtttgatcgcaatggcaggggcagctcttttgttgcttacagcttgtggaacaacagctgtgacaagtagttcaaccaacctttgggaccaaattgtatatggttttgcacaagttattcgtttcttgtcatttggtggtttgaccggagttggtattattttattcacgattgttattcgggcagcattgcttcccttgatgaatatccaaatcaaatctagccaacgtatgcaagaaattcagccagaaatcaaaaaaattcaggctaaatacccaagcaaagatatggaatctcgtcgtttgatgaacgaggaaattcaaaaactttatgcagaaaataaagtcaacccttacatgggttgtttaccactagttgttcaaatgccagtgctatgggcactatatcaagccttgtctcgtgtggactttttgaaacacggaactttcctatggtttgaaattggtgctaaagaccctacttttattttgcctatattggctgcggtctttactttcttgagttcatacttgatgatgaaatctgctccagaaagaaatgcaatgacaacttcaatgacttatatcatgcctattttcatcttgattatgggggttaactttgctgctgggattgcactctactgggtaatctctaatgctttccaagtattccaaacaatgttgttggcaaatccatacaaaattattgcggcgcgtgaagctaaggtacaggtcgaaaaagacaaaattaaagctcgcgaaaaagcattgaagaaagcaagaaaaaaataaaaaataccattggcagtttttattttaatttggaagttgtgctagaaattgtcaataggctttatcatatgacaggagtagttttattatggctatttttactggtgaaacggtcgaagatgcaatcgaacgtggcttaaatcgcttaaatgttaagcgtgaaaatgttcatattcatattgaacaaaaagaaaaaaagggtttcttaggatttggaaagaaacgggctcgggttaatattgagccaatccatgaagaaacagtgcgtaaagctgaccatttagcagaacgtggtgtggatgatacaattaatcttggtgtgcctaagtcacaatctgctatggaagcaacacttgaattaagccaagtggttaaagctgtccgtgcggctgagagagaacaaaatggtgaaatcactgaagaagagcgtaatgcgattattgaagtggctaaaaagacggttgttcaaaatcgtcaaggaacagcagacctctctgatgtggtttctgctgttaaagaagaagtggaagcgaagaaagaagtttcaaacgaagatgaaaaaattgcttcaaaaatttcaagctatttaacaactattacacaagaaatgggaattgcaacgcgtgtttcagtttctcgtgacggaaatttaacagttttcaatttgacttctaatcatgatgctttgcttattggtaaacatggtaaaattttacaaagtttgcaaattttagctaaagcttacgctaatagtattttgaatacacgaatgaatattgctgttaatgtgggtgattatcatgaaaaacgcaaagcttatatcgtaagtcttgctcatcgtgcagctgaacgtgcgcgtggcggtgaaactgtttatattaatgatttacagtctaatgaacgtaaaattgttcacactattattggtcaggaaaatggtgtatcaagtcattcagaaggacaggaatataatcgctatattgttgtggctaaagagatttagccttgacaaaagacctttcatagtgtagaattgtaaggtatgcttttaatagcagtaaaaagatgaaaggaacaccgaaaaggtggagctactttcaaccaaaagtgaagtagcccagggacttatataaaatgaaacgtacttaccaaccacacaaaaaatctcgtaagactactcacggattccgtagccgtatggcaactaaaaacggacgtcgtgtccttgcagctcgtcgtcgtaaaggacgtgcttcacttacagtttaatttgtaaatgaaattgaaatcagcctatggctgattttttttatttgattattcctaaatatggcaggagtcggttgatgattaaatatattttgttaaacggtttcattaattgtgttataatggttttatcaaataattagtgaaattttttcctttgttgattgaagataaggtgaaatctcacgcttaaaggagagttttgtcgtgaaaaaattcaaaattggtgaacttgaagcttctcaaattattttaggttgtatgagaattaatgaagagggaaaagatccggttgctgtaattgaaaaatcagtggagcaagggataaatttctttgaccatgctgatatctatgggggtggagcttgtgaatcgatttttgcagatgctctagaaaaatcgtcagtaaaacgagaagatattattttacagtcaaaatgtggaattgttcctggaaaaatgttcgatttttcaaaaaaacatattattgaatcggttgaggggagtttatctcgtttaaaaactgattatttggatactttgctcttgcatcgtccagatactttagtcgaacctgaagaagtagctgaggctttttatgaattggaaaaagcagggaaagtacgttattttggggtttctaatcaaaatcctggtcaagttgaactgttgaaaacagcggtgaaagagccattgttgtttaatcaattacagtttggcttaaaacatacgggaatgattgatgctgggattcatgtaaatatgagtgatgaaggttcttttgttcatgataatggaattttagagtattctcgtattaataagatgactattcaggcttggtcacctttccaatatggtttctttgaaggcgtctttgttggaaatgaaaaattccctgatttgaataaaaaattggaattttatgcagaaaaatacaattctactccaactggaattgctgtcgcttggattaatcggcatcctgccaatatccaaacaattattggaacgatgacattgagtcgaattgaagaaattgctgctgcttcagatattgtcttagaacgtgcggaatggtacgacttgtacatggcggctggaaacattttaccttaaatataattaaagtaggagactagtttaaaaaaactagtcttttgattacttttttgggaggaaatctgatggatttttctaaatatttcaagaaaaagaatgacagtaaggtaaaaattttttcaaagttagaaatttttgagaaagttagtgatgaagaattgatagaaatttctggaggaaatttttctagtaatcttcgacaaaaaaggattatattggggttgacacaaaaagaacttgggaaactgctttattcgagtaaacaagctgtctgtaattgggagcacgggcgacgtgaaccgagtttagaacttgttcaatagatggcaaatgtgtttaaatgttcaatagatgatttgttaaaagatagtgaaaatataaactaaaagtacacaaaaagaatattaaagtggtattgactaaatattcagaaaagtttaaaatatatttgtaattaattacgaagatgccgaaattcgatgagcctttctagtggaaatgtttattgactaaaaatgctcaaaacgagtccggagtggactagaaagtgtgtttttatggaattgcaaactatttttgaaaaatttgaagtgttgactgatgaggaattgatggaagttagtggaggagggggcgtaactgggaatcattccgtgagttctttactgtctgacggtgggtcaggcggtgggggaggttatgatgtggttgaaaattacactaataacttccttaaacgtggataaataattaagtaatttcagctaatgacaaggaatgcgagtgctttgcattccttgttttgaatgtgtgaggttaaaaatggggaaaacagataaaacaacgatattcaataagttaaagagcatacttttagtcttcgggacgacaatactttatcttggacctggtgcttttgttccaatggaggcagtgcatgatttttatccaagtttatttttagtaattttgttgattattttgtatattgcaattagaaatggtgtttttgcgcattttaaagaaacttttcgcttgcaaaatttgctttggcttcttgggtttgtaattgtgggatatattctcggtaatattgcacactatttatatctgcgatttgttcctgcacttgatacaatcgtggaaaatgaagctactaataatctcgttgactcttttttaccaacttggtttgtatatgttcttatggtcatcattgctccaatttgtgaagaactaacatttagggaatatttttatcgtttttttagtcataaatggctagcttatattttaagtattcttctatttacattaattcatactaggttgacatggagtttttttgaatacttaccaatgagtgtaatcatcacaagtacttttcaccgatataagcgtgtgagtgatagtattatcgttcatggaggatataatctaatggttttgatttttcatattattatttaatatagaatttattataaatagatttgttattttttattaacgtgggggcttttatgattgaacgtataaaaaattttttacggactaaattaaaaccgcttttattgctattagtgacggttattctttacaatggttggactccccacttggggatttttccaccaactttctatgattttgcttttaattattatggatttgtggatattttaacttttttagtaataatagttattgcttataaaaatgatgcttttaaaaagatttttgatatatttcgtccaaaaaatttgttatttattttgttttttattgttggtggaaatatttttattgctttggcacatcatttatattttcagatgacaccagctttagaagcttttccagaacattcaatagatttggtaaattattttgcacggactcctttttggtcgcattcattagatttattcgtgattggaccgattagtgaagagttgatttatcgggaatatctttatcgactttttgataaaaaatgcttggcttgttttgtgagcgtcactgtgtttgcatgggtgcatactggttttacttactctttctttttatatctgcccataagtttagttgttactttggcctatcaccggcgtaaagcaattggggaaagtatcgctcttcacagttcaataaatctgataaatacttatttaccaaatttattaagcttttgggtattctgagtaactagtgattaggcttactattctttggtaattttcaaattaaaattctctttttatttaaaatttaaaagccttgatagaaggcttttatttactttaatggagaaaacggttgaattcaatcaaaaaataacgtataattaacatgtatctaagaaatttttaatgggatatttctgtcagtaaataaaatgattgtcttctaaaaatgtggacatcagttggctgacgggatggaaattattgatttttagtttaatctggctttacagataaatttaaaggaggtgtcttatgagttttacagatgaaacagtccgttttgaatttggtgattcggacaagaaagaaattggcgaaacactcgttgatgtttacaatgtgcttgaggctaagggttacaatcctatcaatcaaatcgtgggttatgttttgtcgggagaccctgcttatatccctcgtcatgatgatgcgcgtaataaaattcgccgttttgaccgagatgatattgttgaggaattaatcaagaattatttgaaagataatggtgtcaatttatagtgtttgcacgaattttagggcttgatgtcggaacaaaaactgtgggagtttctgtcagtgatttacttgggatgaccgctcaacctgttgaaaccattaagattgacagtgaagccggtgagcttggctttgaacgtttgggcgttttgattaaagaatacaaacctgaaaaggtagttcttggtcttccaaaacatatgaacggtgatgaagggattcgtgccgaagcatcacgggattatggcacaaagttggccaatgaattcggtttggaagtcgcttatcaagatgaacgattgacaactgcgcaagctgaaaaagtattgattgatggtggagtgcgtcgtaaagatcgcaaaaaatcaattgataaattggctgctgttttgattttacaaaattatttggatgctcatgcattaaaattataatttttggtttactgatgaaagctttagtttatttgtaagtataaaaatactgacaagtattcgtaggattttctgtcagtaaaagttgtctatttattttattatgaatagcagaaaattcctctaattaaggatgaagaaaaggaaataaaatgactcatacacatgatcacgaacatgaccataatcatgaacctgactatattactttggttgatgaaaatggaaacgaaagcttgttccaaattttgattaccattgatggacaagaagaatttggcaaaaactatgttgttttacaacctactgagtttgaagaagatgaacaaggtcttatcgatgttttggcttactcatttactgagaatgctgacggtactgaaggtgatttgcaaccaatccctgaagatgctgaagatgaatgggatatgattgaagaagtcttcaatagctttatggatgaacaagaagattaaaataaaaagctgtcattaactgacggcttttatttttttaaaaagctggctaaggctagagcaccgagcatggctacgcaaaccaagccaataggaggccaaaaccaaacaattggaagggatattcctaatatgatgaagatatttctgcgggaaatactatgtgtaagctctttgtattctttatctggattttcttttagaagttcatgatccatgacatgaaatacagctgtccagagaaagacgatgaccagatagaagaactcaggaagaaattcagttgcatgttttccgacccaaccagtggtgaaggggaaaaatgacataataaatagccagagtgtattcaataagaatatttgaggagtaatatttttaatatcacgataaagttgatgatgattataccatacggtcataatcataaaaaagctcaaagcataggctaaaagtgggatggttaattctgtcagagcaggccagccacttttatcaggggttttaaattctaaaaccataatcgttgcaatgatggcaataatagcatctgtaaaagccaaaaatctttctttttccatggaattattttatcataaatgttaagatttgcttacgcttttttcaaaaaacaataaaaaagttgctgaccaatctgtcagtaacttttttatttattttttaaatttacgctttaaaccatttttagcgacatctttaatgactttgttacgtaagcctggttcatagttatcataaattgttccgtcaaaattaataatttgagcattatgatttttgtcatcaaaaataaatttactaatcatttgagctgtttcttcaggagattttacaaacggactatccccaacttttgcgccattcaaatctgttgcaactgcaccaggcataacagcaaagatttgttttttagatttatcttttttgaattgatgaccaaaagcaaaggtcatggcattttgtgcggcttttgaagtgatataagcaagtggcatccaatattcttgagaaacgggtacggtgatgttaataattttagcgttttctgtcagtgaatgtggaagaagttctttaatcacagcatgtgttcccaaaaaattggtcttaattgtttcttctaaatcagttgttgaataatcaaaagctgatttttccatatcaaggtgccctttatctgaatgaatattcccagaaattccagcattattaataagtaaatcaatatctgtcagtgctgacaggctcgtcaattgatttaagtcatctaaatctactttgacaaattcggcagtaattccttcggctttcagtttttcaacagcttcttgtccacgtgcttcattacgggctccgaccaagacctcatagccacgatgaccaaggttttgagcaagtgcaaaaccaattcctttatttgcgccagtgataagtgttttcatgatttttctcctttgagttttaattgtcgcctttagacatttgttgctggtcaattagattggaatttaaaaaccagtgacggtgccaatctccagataaagcggtaaagggaacaggttgttgacctgttttttctactttttctagtaaataatttcgtaaaatccaagtgtcttcgagtgttctttgtttaagattaaatattttttcaagttttacttcgctaatttttaaatcagtagcaacttcagatttgctaagtcttgtgagttcaaaatttttacggagttcttttttggtattatgcatttgaaggggattaagtgacatttttcttctctaatctttcattttgggaaaataattagtgagaatttgttgagaaagtagtttggtgttttcgtcactatttactttgcccatttggtgaagttgtttagcaaaaccagcgtcaatccggtctaagccattttcaagtccggctaaagtttcactaattaagtctgaaagtgccatgttattgggtacgtcagtatttgtatggctttcgagatttgtttcagcaactaatggtggaactaattcgatgacttttaaagtcttttcaaaatatttagcttgttctcgaagcgcatcagagtaaaaatgaaccccagctttggtcaaattgtaaatagggtgtgcaccgtcagccagatttgataatcctgatgaaacattaatgactagtccgttatttgcgacaaggattttcaaaaatgcttgtgtcaaagcaattgttcctaataaattaatatgaatttcttctgtcagtacttccagagaattgtcagcttgttcaaacaaattaatcgcacgcataattccggcacagttcataatgacatcaagttgagggaaattttctttgatgaatttgactaattgggggagggagtctttgtcagcaacatcactgacaaatcctgtaaaagttggattttcatttaaaatttgattaagacgtttttcatttcgggcggtaatgatgactttatttcctaattcggaaaactttttagcaaaaccaagtccgattccgcttgtaccacctgtgattaaaatcgtatgtcctgtaaatgtcatgatttctcctttttatgaggttattttttttaacttttataaccaacaaaatgaattataaaccagaaagttatatttgtcaagaattataacttgtgttacaattaatttatgaatacacgtgaaaagatattaggaaaaacagaagaatttatcttagagaatggaatagagaaactcaccatttcaaaaattgctaaggaactcaatattagtcaaccagctatttataagcactttaaaagtaaagatgaacttttaacgatacttgcccttcgttggctcaatggtcagacacttgtaaaaatatttccttttgacacaagcaagtatcaacatcaaaaagagattgttcatgattggctctggtcagtcgccattgccaaatatgaagcacatcgaaaaactccagaaatgtttgccttatacacaacctacattggagaaaatttagaattggggcgtaaacatattttagaaatggttgagagtctaaagacagctgctaaatttgaaagtgaagaggaagctgctgcatatattcaagcttttgtttattttcatcacccaaaaattgccccacagtgggatgaccaatttcaaaatcaatttgaaaatctctggaccttgcttgaaccgaatttaaatgccttttaaagttactgacagactttttggatttctgtcagtaacttttgcgattctgtcagtaaaaaaacctgtcaattgacaggtttttattctttaattcggaaaaccatagcagttctaggttcaaggattagatttaaatgctcttttgaccaaccaaaactacttcttggaccaaaaccaccaaatttttggtcatcactatcgaagataagttctggtttttcaggaaattggagttgaagctcttgttcataactaggatggaaattaaagacgaaaagaagttgcccttttttgtaagctagtaatttatccgaattttttatccaaagttgttggacaggttctgggctttctaaaaacttgtaatgtcgctctagattaatcatcgcttggtcaaatgccaataaatattggaaacgcaaatctttattatcagctaaagaccattgtcttctagcatgttggaaatcatcatgattttcttgacgcggaaaatcaagccattcggggtggccaaattcattacccatgaaatttaaataaccctcaccagccaaactaaaagtaattaggcgaattaatttatgaagcgctatagcacggtcaatttttagagattgactattaaggtccattttccaataaatctcttcatcagctaaccacatcataatcgttttatcaccaactaaagcttggtcatgactttcagaataaccaatatttttttcaccaggacgtcgcgtcgttaattcccaccaaagactcaataagtcaagactattatccgttttttctttcaattgtttaatccaaaaatcaggaattcccattgataaacggtaatcgaaaccaattccaccacttgaaataggtagggccattcccggcatggctgacatatcttcagcgattgttgttgctaatggattgaataaatgtgttaattcatttgccaacatcaaataagtcaccgcttcgatatctgtattgagcgaaaaatatttgctgtaatcagtaaaagcagtccctaaaccatgatcatgataaagcattgaagtcacaccgtcaaaacgaaaaccgtcaaaatgataggtatccaaccaaaatttaagatttgaaagtagaaaatgaatcacttcatctttgccataattaaaaagttttgtcttccaagctggatgatttcctcgttcaccttcatgaaaatactgattttctgtcccatcaaaatagttgagaccatcttcgatattttttacagcatgtgaatgaaccacatctaaaagcactcgcaaacccataccatgagcttgatcaatcaattccatcaaatcttctggctgaccaaagcgactagaaattgcaaagaaattggaaacttgataaccaaaactagcatagagcggatgttccataattgccatcagttgaatagtattgtaaccagcctttttaattcttggtaagacatcgcgcgtgaattctttataagaattaattttatattcttcagttgaaataccaatatgtgcttcataaatcaaaggagcttcttttaactgaggggctttattcttccaatcatattttggttgaacaatcactccatccaattcatggcgctcattggggacagcaaacataatataagagggaacacgataaactgtttcaccagaaggtaaaagcagcttaaccttcaccttagaacccacaggtagcatacccggaattgaaatttcccaagtcccaccataggcctgtttcaactcaaaattgttttcccaattattgaaatctccaaccaaccaagctcttttagcatttggtgcccattcgcgaaaagtccagtgtttactttcttgttgaaagccaaaatacttataaccattagcaaaatcaacaagcgaaccatcagttcctaaaagccgtttttttgttcgagcaaattcaaaaagccgcaaagacaaatcttctttgaaaggttccaaataagggtcataatccaaaatatttagaggcataagctattctcctttttactgaaaatcatttctagcactattttatcacttttgcaaaggttttcacaatgaaattcccatataaaacaaaaaatatttactgacagaatgggtcagtaaatatttttattcatcattaaaaccaaaccaagggtcttcctcaccttcgagtgcttcttgaccaaaagaaactgtttctggaattttgggagcattaaaaaattgcgaaggagttgctacattttctgtcagtaaatttttttggtcagcaactttttcgtcattaaaaagatgagcttctaggctttgaatataatcataaaactctgtcagtaaatcatgataagcctttaattcacttgttttatttaaatttttataattagcctgaaactctccccaacgttcagcaatgtgcttacttttcataaaatcattataatccatatttgttcctcgttcctttctctttattatacattattatccttaatgcttaagcggataatatttattatttaaaataagactcaatttagaggtgtaatgtaaaaataataaaacgaaagtgaaactttccccttttaaaaaagtattatctttttttttttttgttataaaagtcgatttagaatcaaatttttaatttttatcggtctttttttattaatcatttaaatatttatgaaatattaaaaaaggggctaatggctttatggagccattatgttgcaaaaaggctatgttaggaacaaacaaaaatataaataaaagtaagacaatagaatttaatgtacgaaatttattacacatttgtattgtattatgctataatgtcctagaatcagcaatttttataagaggatgtaattaataaaatacatcgcttacaaaactgatttaaaatcaaaaggaggacattatgaaaagtagaaaaaaagttatttctataattttaggtttaatgctgcttttacaatatgttattaccccagttggagcaattgcaggagcaataaatgaagaaacaaatgattcggatataacattaagtcaatttaaaatagatgaatccgaaagtaatgctgatttaatgacatttgatttaagtctcaagattaatcagtcaatattgaaaagtaaaacaactactattgaattagataaatcaattaaaattaatgaaccaaatgaggctaacagacaaaagtcaacagcatcttatactgctgacgaaaatagattgacaatagaccttaattcactaaatacaagcgaagtgaaagtcaatttttcaatctctaaagaacttttgaaaaactttgagcgattaacagccaaattaaatgatagccaagttgatgtattgttgccaaaaacgagttcaacttcagaaaccccaagtcagtcaacttccactgtgactcaaaatactgttacacctgaaatcaaagaaaaagaaagtagtacgactaaacattcagagcaagctataaaaactgtggaaagtcaagatattcgtaaacttctagaagactcaggaatttcaccagcgactattatcgactcagctaaggtcatatatcttgataaagaaggaaaaccttatccagatcaaacagatgttccgatagatgcagaagttcaaatcgattatacctggagtattccagaagatattttaccattgaaatcaggagattactttgattttaaacttcctgatggtgtaacaattgagcaagcgacatcgtcactgggagattatggaacctatacaattaatgcagatggaaccgttcgtttcgtcttcaatgaaaaagttgaaacctatcatgatattaagggtacctttcattatgatgcacatttcgataagacaattgttccaggagaagttgtagttgatacaccaacggaggaaaattttcccccttcagaaattcatgttcggccaacctatgaccaagcaattgataaatcaggacatttcgataaaactccaaatcctagtaaagttatttgggaaataaatattaactgtccattaaatacaatggaaaatgctacacttaccgatccaatgccagaaggaacaacttatgaatccgtcgaaatttaccctgagacagttggaaaaaatggagaaatcatttccattgataaagaacatcctttagtaaaaggtacagattatactgttgattcaaatggaaaaattacttttattggtaaatatgctaccaccgatcaagcattcaatgttgtctatacaacaactatcgatgaaagtagttttccggaaaaagagggagctgtaagctttaaaaatacagcgacattaaatgatggaaaaacagataccaatgcaagtgcctctgttactgcgcaatataaagggccaattaaaaaaaatggaccatttacaacagggaacgatcaaatttataattggaatatagaatacaattataatgaaaaaaatcataaagcagggtcatttattgaagataccatgagtgatgccatcgagctggtgaacggaagtgttaaactttataaaattacttttgatagtaacggaaaagaaattaaaggtgctcaattaaaagaaggggaagattataaacttgtacaagaccctgataatcctcaaaaatttaaaattgagtttattactgatatcgattatgcagtaaaagttgaatatcaaacgaaggttaaagatatcgtagatggaaatgttaccattgataactcagtaacaactgatacgggagataacagcgagtcaggtggtaatgcaactcaacaaggaatcgttaaaaatattgatggagatattgattacgagaatagagaaattccatggaaaatagatattaatagtgcaggctattggatggaaaactggtcacttgaagacaaaatgtctgaaggattgactttccttgaaaatactttccaaattattgataaaactgctggaaataaagtactctccccaacagaatatacactgataaaaacaacagcaggcttttcagtttcctttaattccccacttaaggaggggacagatcataaatatcaaattaaatacaaaacaaaatttgatactagtgtgattgataatgggtctggtcatgaaggagatatcaaatttgtaaatgatgcttcaatgacttggaaggataaaaatggaggagatcatactaataatgatcataaagaatttaaaccaatacctccgttccaatataatggacaaaaatctggttcatataatgcaaccagcaaaaaaattacatggacaattgcagcaaatttcaatcaacaagaattaagcaatgcctcaataactgatccaatctctgatgatcaaaactatgtttctggaagtgctaaaatatatgaagctacgattaataaaaatggtacttatactttaggtgctgaagttacttcagatatgggaataaaaatagtagaaagcaaaggaagtgttaaggtagaactaccagatggaagcacaaaagcctatgttctaatatttgaaacaagtctagaaggtaatctcatcaatcagaaggagtacaaaaacaaagcgacatttacaaataaggacatttcacatgatttaagtgctagtgttactccagcacatcaaggagaattcgtaacgaaagatggttcacagtcaagtacagattctaattatgtaaattggaaacttacagtaaacgcctcgcaatctaccttaaaaaatgttgaagttaccgataatccttcctcaaatcagtatattgtagcaaaagatattcttatttatggaacaagtattgatgcttctggtaatattaccgagaacaaaaatattattcttgaacaaggcaaagattattctgttgatatccaaactgataattctacaggggctcaaacagttaaaattaaatttttatcagaaattaacacagcatatgttgtagaatatcgtgcattaattacttctgacaaagctaatgatgtggtaactaatcaagcccatattactggagacaacgagaaaacaatagaacaagatgttgaaaaagatgtacccgtaactaatcataacggaagtgcaaacggatcaaaaggttcagttactttggaaaaagttggtcccggcaaagcaaaacttgcgggagctcatcttcaactttggtctatcggtacagatggcaaaaaagataaattaattcgtgaaggagataccgacaaaaatggtgatttaaaacttgggaatttgcgtgttactgattatcttcttattgaaactaaggccccaacagggtatacacttgatgaagaactagtcaaaggtaagaaaataacagtttcaaaagacggagaagtttctaatttcccaattcaagacgttgaaaatgaaccaacgaaagtaatcttgaaaaaagtaggactgaccattgaaaatggtaaagaggtaaaaaatccacttcaaggtgcagaatttaaagtgctagacagcaacggtcaagttgtttcaggttacgaaaaacttacttctgacagttctggaaatgtaacgattgaaaaactaacacctggtaaatattcacttgttgaaaccaaagccccagcgggttatattttggacccaaccccaattgactttgagcttaaagccaatgaagaaggaatcatcccagatatcaacttggaaaaagttaactatcagggttcagcacaactcattaaacataacagtaatggtcaagctttatcaggtgcgattttcaaagttattgataaagatggtaatacaatccaaactaatttaagctctgataaagatggtaaagttacggctactggtttagcgccgggagattattcctttgttgaaaccaaagctccaacaggatatattttaaatacaataccagttcattttacaatttcagctgaagaagaaggccagccacaaatggttattgcctcggataattttatcaattatcaaggttcagccgaattaattaagcaagataacgaaagtcagccactttctggtgcagtttttaaaattgttgataaagctggcaagacaatccaaactaatttaacttctggtaaagatggtaaagtggtagttgatggattagcccccggagaatattcctttgttgaaaccaaagctccaacaggatatattctaaatacaataccagttcattttacaattttagctgaagaagaaggtcagcctagtctaataattgcttcggataatttcgttaactatcaaggttcagctgaattaattaagcatgatagtaaaggtcaagctctagaaggagcagtctttaaagttattgatgcggatggcaaagcagtcaaagaaggcctgacttccgacaaagatggtaaagtaagtattgatgatttagcccccggagaatattcctttgttgaaaccaaagctccaacaggttatattttaaatactattcctaccccttttacaatcttagctgagagtgaaggtcaacctcaactggttgtcgcttcagacaatttcgttaactatcaaggttcagcggaactgattaaacatgatagtaaaggtcaagctctagaaggagcaatctttaaagttattgatgcggatggcaaaacagtcaaagaaggcctgacttccgacaaagatggtaaagtaagtattgatggcctatcaccgggagattattctttcgtcgaaacacgagcaccaagtggttatattttgaacactactcctgctaatttcaccatttcaagtgaagaagaaggtgaacaaaaagtagttattgcttcagataatttcattaattaccaaggttctgctgaattaattaagcatgatagtaaaggtcaagctctagaaggagcagtctttaaagttattgatgcggatggcaaaacagtcaaagaaaacttgacttctaataaagacggtaaagtaagtattggtggcctatcaccgggagattattctttcgtcgaaacacaagcaccaactggatatattttgaatacttcccaagttgatttcacaatttcagccaaagaagagggtcaacctcaagtagttattgcttcagataatttcattaattaccaaggttctgctgagttaatcaagcatgacagcaaaggaaactctttatcaggtgctgttttcagggttattgatgctgacggacaaacagtcaaagaaaatttggtttccgataaagaaggtaaagttttaatcaaagacctcgtaccaggaaaatattccttttaaaagatgtgtagtttaaaacatatatccgaaaaatactaatttttcggagactagcaatagaaaaagcccgaaatgctcaataataagtataaaatattgcgaaataaagttcaaaaaaggctctatatatagttaaataaattggttaaggagaggctataaaataaggatagtaattttaaaaagagagaattaaagaacaagaattaaagaaaacactaaaaaattaagtagtcaatgagagacattttcttctatttgaatagaatttgttactctagccaatttttcatcatacaaaaaaagagaaattcaattacagcatattgattatgactttagaataatttagcagtgacttatctttctttaataagaagaagatagaatcctagaattaatgaatgattttttcaatctatcacttcggagcaaaatagaaattaaataaatttgtcaagaatggaaataaaatgattgaaaagaagaattcagtttcaaatatcataggtaaagtcagtttagtattagtgcttgtctttagcttactctattgtagtaaaagtatctatgcctcatcttctaactttaatgtaagcccagaaatacctgagaatcaagtggataaaaatttgggatattttaatttagtaatgagtccagaatctcagcaaacattatcttttaaggtaaataatgcgacttctaagtccataacggtagagatggcatttgcccactcgaccacaaatggaaatggacttgctatttatgattcatctaaagcaacaaaggatagttctctaaaatataatattgaagactttgttgatattcctaaaaaagaagtaacgattgccgcacacgctcaggtaataatgactgcaaaggttagcatgcctaaaggaatggataccgatattttggcaggaggtttttcctttaaggaaaaagagggaaatcaagaatcaagttcatcaaagggtgtttccatcaagaatgaatatcgatatgtgattgctcttgtgactcaacaaaatacccagaaagtttctcctcaacttaggcttaatgaagtcaaagctacacaagtgaattcgagaaatgtatttgcggcaaacctacaaaacatttccccaacttatcttcaagatatgaacgcgacagcgaccgtcaaaggagtaactaattcagaattaaaatatagctttgaaaattctgatatgaaaatggctccgaactctaattttgattttgcgattccagtttccatcaaaggtaacattggcgatcaatcttctaaagcactagaagctggtaaatatcatctttcgatgacagtttatggtgtgaaaagtgccacgggagcttatgagacaactgttaatggtaaaagtgtaaattacgaatataaatggacttttgaaaaggactttgaaattgcaggagaaaaggcccaaaaactcaataatagtgacccaacggtccattataaagaacctattaattggctaatgattattggtattgcacttattctaattattctgctattgatattcttaatctttagctcccgacgtaaaaaagagaatcatcaaaaatagtgacagttaaagtcagtaagaaaggaagagaaaactttgaataaaagaaaaaaaactttgtttatctctatggggctcttgatagtgattgcttcttatcccctctctgtttctgctcaagaagaaaagaatactacgacgcgggcaacagtcggctttactggtagtttgccttctaaggagaaaccagaagttgtcaatcctcaaaatccatctacaggctctggaaataaagaacttccaaaaacaggagataaaaaatcagttcctatggaatggactgggattggcttacttaaccttattattggacttgtttatttaaaaagacgtaaataagttcaattaaacttaactcgataattaaaataatttaattatatatatttaacaactcaaaggagaaactaacatgaaaaaagcaattactttttcagcggcaactcttgcccttcttgtagccggagcttcaggagcttcagcagtatcagcagcatcagttaaagcagaacaatggaattcaacaggaacgatcggattcacagccaatacaacaacaccaccagatatcactaacccagaagttcctggaggaactggccctggaggtacaccaggagaacttgcgattgactatgcttctgacttagcttttggtaaacacgaaatttcggctaaatcagaaacttactttgcggatgctgacacaactgcctttaacggtacacctgttggagcatttgttgaaatgcacgaccttcgtggtttgggaagcggagataagaatgggacacaattaaatgtgactcaattgaagcaatttaacaatggcagtgccgaccttaaaggagctactttgagcttctcagcaggtacagctgctaatgctggtggaggggcttatactccaactgctgaggctggcttcacattggatcctggtactgcacaaaatgtaatgtcaacagatggtaccacaggtacatatttgacaagctatggtaaagcagcagactataaagggaatactgctggaggacctatttctctaagcgttccttcaggatcagccttagcaggggacttttctacaactctccaatgggatttgataactgcgccttaatctaggaataaaaaagttgtctcttccaaagtgaagaaacagcttttttatcattttaaataaggtggttaacgaaagtgaaaacaacaatgggaaaaataaaaaacttacttaaaaaatctacaaatattggcgcaagtgccctacttttggtaagtaccttgttgccaattttagccctacatggagagacaacagtgtcagcagctaatgcgacgactactttaaaccctgggggaaccgtcgatacgggaaatcatacgtggacacttggcgactttcagacacctggtaattttacacctgtgggaaaaaatacgagtggagcaagctggtcatctatatcaacctatgattttggaactaatcagagagatacaggttcatggctcccttttaatggggcagtggatatgactcaaccgatctcacttggtggaagtacttatgcaagcgctggttggtttggcactggttctggtagtcaattgggggatgcaaatggagttttacttacaaatttgtcttcttctcaactttctggtggttcaactggggggaatttaggggtaggtaatctcggttcgggaacttatttcattggaaataactactcatatcgaaagacttccattcttttaggaagtgattataatacggcaaccgttattgctcagggtgatggtgcgggcaaaaaggttcttaatgctagttctgattatactgcaaagaataattcttccaatgcctttgaaatgtattggactaaccctgttttaaattcggacggaacagttaccggaacgatgaaatacacttctcgaaattcaaacactgattatgttgcttctgcaaaactgaccgttcaaaaaagtatgtcaattggatttatggctgcaaccggcgggaactactcacaaatgactgttacaattggtttagttggtgctggaaaaggagtgcaaccagttaatgttaactatcttaatagtgcaactggtggtcagttagctcccaaaggtagtgcgtgggaaaattctacaatcactgccaatgtaggtgataagattggggtggtgcctcaaggtaatacgacaaatacctcagataactatgattattttgcaccagtagcgccaacaggctatacctttaagtcaatttcttcggcagttactgttcaaaatttccctagtggaacggcaaatcctaaccagattaatttttcttacactcctttagcgcaaacgggtggatttacttttaattatgatccaacggctcaacgaacccctgctgttccatcaaaactgtcagtatcaggggttacagaccaactcttttcagcttcttccctcaatgttcaaaagaatttaacggataaagtacctgctggttactatatttctaagattacttcggcgagtggtaaagcaacgtcaggagcgacaacggatgcaacgattacagcctttttcgccttaaatccaagttttgatacaacgaccgctaataatcaatatcaggtaaccttggctcctactaatcagttgggacaagtaagttttgattataataacagcgttccaaccaatcctccagcattacctgatactattcaattatcaggtttaactggttctgatttgagttttgttatgccaactcttgaaccaggttacgttgtcaatgaagtattagggcctgataacaaaacttattcctctgttactgaagccttaaaggcaaatgaccactttactactggttcgaataattttaaagtgaccattgcggcagagaagcaaacgggaacaataagctataattgggcttcaaatgttcccggacaaaatggggtagcaggtgagcttcaggctactttgccttcttcatctagtatttggggctatggtggagagcagcttagttttacaccaaatattcctaaggggtacgctattgataaagtagtcgcaccagatgggaaaacctatgtagatggtagtattcaaggaatgacagctcttgaagcagcacaagcagcaaaccctagatttattgttggagcaaataactttgcgataactttaagagctctatcaaaagatatcacattacaggtaaacattgatcaaagttcaggtaatggagctccaacggcacctcaaccctatactattgctacagtattgacaggagctcctattgatgcaacttcaattgataaagcacaaaactggttaaatgattggattaccaataatgcttcaggttggtctatcaaagattttttgagtccttatcaagtaaactatggtagcttgaaagatgccgtagcgggagcgggtggagttgcattttctgaagtcaatatttatcaagctaacctagtttataatggtaaaattggctttagttctgttccaacaaaaattgattttggtgaaaatacgatttcttcagtagaaaagagttatcaaggtgtgttggataattcagttgtagtgtcagatactagagcaagtagtttggcaacgccatggacagtcagtgtagctcaaacttcaccaattcaagaagtgatgagtgatactggagctccagtaatgggtggaatttcattcatgaattatctttcatatgatggtcaagtactcactagtaatccacaaataattcattctacgacttcaggtaaaactggagatacagtagttatagacggaaaatcgccaagtctctttacgttaagggttcctatcggtttccaaaaagcggatgctaattttaaaggaacgctatcttggacgctgacaagtgctccataagaaaaggtgattatcaataaatgaatctgagaaatttttgactaatttaattgataatacaatgaggtaaatattcgggagataattaaggaaagagtacacgactaatggtgtattgatggataagaaaatggaaaatatattttatcaacgtttgagagcattaactcataattctggtaaatcatttaatcagattgagagagacttaggctacactaggaatgctcttgcgaattataaaaatggagggatgccttctggtgtaagattaatggatctggcagactattttaaagttctaccagagtatttgattgggaaaattccttttaaagacgtagagaatattgagactacatttacgtctctgaacaatacacaaaaaatggaaatgtaccttctgagccagaaatgggtattatcccgagtaaaagatgattcatattgagttgtttaataagttaaataaaaaaacactaccagactttttatttgtttggtagtgttttttatattactttagtgaattatggtagggtttacaattagaactctatcttaaagactttctgtatccagcggcgatggcttttacaaaaataactcagccataaaaggttgagttattttgaataatgccgagtgcaggaatcgaacctgtgaccccttcgttacgagtgaagtgctctaccgactgagctaactcggcacaaaatgaaagtggttacccacttttattatgatacaactttttaaacctattttcaagaactagaagtctttggcattgggttgattgtagccgtaacgctcacagaaatcttctcggaattccagaaggttgtcatccataatggccccgcgaacgtctttcattagatttacgaggaagtgaagattgtggtatgaacaaagacgaagaccaaaagtttcatcggctttgattaaatgacgaaggtaggcgcgtgtatagttagtacatgtgtagcaatcgcacattgggtcaagtggagtaaaatcgtgttcgtatttagcattacgaatgttaactcgaccgaaatgagtcatcagagttccattacgagcaattcgtgtaggaagaacgcagtcaaacatatcaactccacgaataacgccatcaatcaagctgtctggtgcaccaacacccattaaatagcggggtttgtcttctggaagcattggtgttgtaaagtcaaggacagcattcatttctttatgagattcaccaacggcaagaccaccgatagaataaccagcgaaatccattgaagtcaagtctctagctgattgacgacgtaaatcttcaaaaccagctccttgaacaattccgaaaagtccttggtcatttggacgacgatgagcattgagaccacgctcagcccaacgggaagttctttcaacagaagctttgacatagtcatagggttgatagaaaggtggacattcgtcaaaggacatcatgatgtcagagccaagattattttgaatgcttattgctttttcggggttaagaaaaagttcacgtccgtccaaatggctcttgaacttaacgccttcttctgtgatattttttttgttttgaactaggctgtaaacctggaaaccaccactatcagtcaggataggttggtcccaattcataaatttgtgaagaccgccagcttcagcgacaagttcatctccgggtcgtaaccagaggtggtaagtgtttgagagaataatccctgagcctaatgttttgagttcttctgggctcattgttttaacggtagcttgagtacctacgggcataaacattggagttgggaaggtaccatgcggtgtgatgatttctcctaatcttgctcctgtatgtttttctttttttattaatctgtattttattgcgtgttctgtcataagattcctttatttactcgtagaatcgagtcttcttgtagcttaaaaagcaagcacttataagtataacaaaaattaaacgctttttatagatgattttttgaaaatcgggcgaaagtcttagagattttgcctatttattggtataattaagtaaatataatgtaagacaaattattgggaggtattttatgtcaagatgggaattgaaaaatcaagccaaaggagctttaaaagataattttggttcaaaaatgttactctttattattccaattattgcggggattttaggtggaggaaatggtgtaaagcagtccatggactacaatacttctaattttgatagtattccaggtagtgtttggatggtgattagctttgcgactttgcttattgctattttaatgattgttgtagccttgtttgtttcggtagtaacagttggggcaatttttaactatatcaaaattttccgtggtgaacgaaataatccacaatttaaaaatgtttttggacctttctatgatggttcagctggcaaaattattcttttaagtattgtcaaaggggtgatttttgttgccttgatgtttatcccagtgattggttgggcatttgcaatttatttgggacttggttggtcacaagcaacttatgttttgtttgatcagttagaagaagggcgttacagcggtgttatgggcgttcttagcgaatcagcaacaatgatgaaaggtttgcgtggaaattacttcattttcaaattgagtttcttctggtggtatgttctttatggtatctcaggtggtttagcaggattctggactactccttacctcaacatggcttcaattgcttattacgaaaatattggtaaataataaaaaagctgtcaaaattactgacagcttttttttatttactgacagaacaatcagtagcttaattttcacgtttagcatgacgtccatgaacgaaatggtaaatgacagcaattagaagtgcaagaattgctgatgcaaaatagagattacgatagcctaatagaggcataaacattcctaaaataaatggtccaaaaccgacacccatatccataaagccaaagaaagtagaagttgtgattcctaaacgatgagcttctgaattacggatggcaattgcttgtccaaaaggcgaaaatgagccgtagcctaaaccgataaatatagcagcaaggagcaacatccaaccagaatgagcaaaaccaatcagtaaaaggccaagtgcaaagaagaggtaggttggatacattacaaagttatcaccaaagccgtcaaagacacgaccagtaattggacgagaaagaaggacagtaatggcataaactaagaagaaaaatgaggcagcctctgaaagatgaatattatgagcgtaagcatccataaatgacagaatacttgagtatgaaatacctatgagaaaggcaattaatgaaattggtaaagcttctttttcaaagtaatttgaccaagcgaattttttatggactttattatcgatagaattagagctgtcagtagttttttcagcatgtatgaagaaaattccgactaaggcaataaataaaagtaaggcagaaagccaaattaatgaataaaaacctgatgtccggtaaagaaacattgataaaaagggaccaactgctgacgataatgtgacagaaagcgcataataaccaattccttcaccacgtcttgaagaaggaacaatggcaccagccaaagttccagaagctgttgcagcaataccaaatccaagtccgtgtacaagacgtaaaattaaaagtagaacgacactatgcacaaagaaataagcaaaggtaagcaagaaataaatgagtgttcctatgtacaaaagtttttttgcaccaaggcgtttcatattatttccagcccaaagtcgagcaataaatccgccgacaataaaaattccagataaaataccagcgatactagcagaagcgtgataacgttccatagccattgtaccaataacaacagtagggagataaaaaacaagataaaaaataaaattaagtaacatattaacaacgaaagttgttgtccaaagtttttctttcataaagttcctttctttgagaaaaatttatgaatgcgtaaacatccgcctaaaaaacagataaaactcccgctttttagacgagagttttgtgtttgcgtaattcaactttattattgtatcaaaaaaaatcgataaaatgttgccggggaaacgtaatagtctatagaataacttttgtagtcatttttttcctaagcttgaataggcatattcaattttaatacagcgattcatcacaattttatttcttcctgcttctcgaagaatttcttcagcttcttgagattgtaagcccaattgcgcccagaaaatatcggcgtcagtttcaatgaagtcacgagcaacatccgccaaaaactcacttcgacgaaagatatcaacgatatcaatgtgaaaaggaacttctttgatagaagcgtagactttttcacctagtaattcacggccagcaagtcttggattgactggaataacatggtagccattttgttgtaatccttgagcaattaaaaaagatgaacggtctgttttatcgctaatcccaacgacagcgatggtttttgcatttttgagataatcaaacattacctcttgttctggattttcaaattcgtacatcagatttcctcctcctgctttgtttttattatacaatattaagggaagtggtgtggtttcaaagcttctttaaaatgattataaaaatttttcagaattgtaaaatccttgaaattttttgctataattaggctatgaataagaaacaaataaaaacactaacaagcgtcattgtagtcattattgcactggctgtaggatattttggttcgggacgtctgcatttgggacaaggaaatagttcggctactgataatagtagccaagtttccacaaaatcactggcaagttcggttaaacaagctcctttaacttttaaaaatcaaagacaaatggtcatggccaatactgatgctttaggtcgtgcggttgattcacatattcaattgaatgattctcaagaacctaaagtcaaacgtgaacccttgacctataatccggttggttggcataattataatttttattataaaaaatcagatggttcgattggtaaaatgtggctaatggctcgtggccatttagtgggttatcaattttcaggtctaaataatgaagcaagaaatttagtgccagaaacggcttggttcaatggtggaaatttcactggaacgaacgatggaaatacagccagcatgctttattacgaaaatcgtttggacagttggcttgcaaatcatcccaattattatttagattaccaagtgacccctctctacgaaggaaatgaacttttgcctcgacaaattcgtttggcttatgttgggattgataaaaatggtcaaaccttgtctatcaaactcggtggtggtcgtgaaaagtcaggaaatggtggagcaactgtcgttgttcttgacaatgtcgctccaaatgcaaaaattaattatgctgacgggaccgcagttaacacagtcagccctaaatagttactgacagactgttctgtcagtaaaataaagctctgtcagtaaaaaaatgcttgaaaaatcagtcaaaagactgagaattcgggctttttttcttgctataattaatatataaatacaaattcatgagtgatgagaatttgttaattatcggaggaaagagaatgtttttactacttgtactatttttagctatgttactttttataaaaggattctttaaaattgttttacctgctttgattttattaatgattttgaaatttttgttcggtggtttaatgctcttacttagtccgcatttttgggggactttgctcgtaattagcattattgtatggcttgtgagagccagtcgtagtcgttactactaaaaggagaaaaaatgtttgtaggatttttatcaggtttgattgtaatgggggctttgctttcaattttgttagtgcttttgggagtgatggcattgagagtatttgtacgctatatcttgcccattttacttattttactgattattcgtttgattatttcagggattgtacttttgtttaacccacacttttggttattcattgcggttgtcgctttagtcctttggattcttggtaaaattaggaattaagtagtttataaataatattaacttatagaaattactgacctttttgtcagtaattttttgcttataattttataatcatttttaactttattgagtgttttccaaaaatttggtataatttttttacaactgtgtatttgaaacaagcattttgtttataaaaaagatttccgctaaggaaacatcggaggacgtcatgtcaaatgaatacagatcccgctcgtcacgtcatgagcggagaagctctcgttgggcaaataaagattctgatgtcgtggaagcggcagcgaatcaagcaatcaggcatttagaagaagaaccagaaggtcgaaacgtcgaacgaacttcaagacaaaaattgacacatgaaaaaacactcagaattcctttagcagtctatggattacttacgggtctgtcagtgcttttagcattaactttttatgcatttcctttgtggaaaccagtagccacagccagccaatcacaaaacttttattctggatttgcgatgcatcatggtttagttccttttaatgatttttatgggacaggtggtacggttttttatctcattaattggttagggaatattggtgggacgacttggcttttatggctttttgaaattattgctttactaatcagtggaattttagtttaccgcttagtgggtcaacaaacgaaaaatcaaacggcatcactaactgtatcggtttttaccttagttattattgcaggtttggcaagaggaggagatagtccaacgctctttgctcttccttttgccttatgggcggcacgatttttgagttcttatttccaagatagttctacagataggggatttattcgatttggaatggcagctgcctttgccttagtcatttctcctgtcatgtcagttttctttattttatctgctatcgctctcattattcataatgtgggtagccgtaaaattggacgtggtttttaccaaatgctggcaacaattttgggagttctattagtaggttactcagtcgcttattattctcttgaagaacaaacaatctatacttctattgaacagtctattttaattccctttacacattttggtccaagtggtgatttattattaactcttgctaaagccttagttctcactcttatttttggaattgttgcaggtttcgtccaaggaattgtacaactcaaaaagggtggaccagccagagtttggtatgtcatgatgcttattggaattgttggattgacaacaatgattgtttttgctcagacttttgatagttctaatcttttggctgtcctgccatttacaatagtttttgcaggtcttgggttgacagatagcgatcaaattttgttgaaatatcttcaaaatcgtttatttgctccgattttggcaatactttttgtcatttttacaccaattagttatcatttcatgaaccgaacaattgcttcagaagagcaaagtgtggcacaatatattaaggcaaatgccacaggttctgaccgagtttatgttgtcgctgatggtaaaaatattaacaatttgaccaaaacaatttcaactttagataatgttccagcaaattatccaattaaatttacccaaagttatgatttgaaagttggtaaattatcagataaattcgttgttttacaggccagtgagaaagctccgactagtttgaaaaaagttttagataaggactataaagtgactaactatgctggaaaatatttccaagtctataaaaagaaataaactagtgttaccagaatctgtttgtaagttttgaaaatcaaaacttcataatattacggaggtcaataatgagaaaatttgaaaaatcgcataaacttgataatgtcagctatgatattcgtggcccagtattggatgaagcacaaagaatgcgagccaatggtgaaaaaattcttcgattgaatacaggaaatccagctgaatttggctttcttgctcctgatgaagtcattagtgacttgattcaacatgctgtggatagcgaaggatattcagattctaaaggaattttctcggctcgtaaagcgattatgcaatactgtcagctcaaaggttttcctagtcttgatatcaatgatattttcacaggtaatggggtttctgaattgattgttatggccatgcagggacttttggacacaggggatgaggttttgattcctatgcctgattatccactttggacggcttctgtcagcttagctggaggaacagctgttcattacctctgtgatgaacaggctggttggttccccgacattgatgatattcgctcaaaaatcacaagtaatacaaaagccattgttttgattaatcctaataatccaacgggtgcgctgtattctaaagatttattgcttgaaattgttcaagtggctagagaaaataatttaattattttctctgacgaaatttatgaccgattggttatggatggagcagttcatgttccgattgctagcttggcaccagatctttttgtggtcacaatgaatggactctcaaaatcacaccgcattgcgggattccgtgtggggtggatggttctgtcaggtgaaaaatcacatgttaagggttatattgaaggtttgaatatgctggcttcaatgcgactttgttccaatgttttagctcaatcagtcgtacaaacttcacttggtggcactcaatcggttgataagttgctgttgccgggtggacgagtttatgaacaaagagaattcatttataaagccatcaatggtattccaggattatctgcggtcaaacctcaagcagctttctatattttccctaaaattgacagagaaatgtataaaattgataatgatgaacaatttgtcttggactttttgaagcaggaaaaaatcctgcttgttcatggtcgaggatttaattggaaagagccagaccatttccgaatcgtttatctgcctcgtgtggatgaattagcggaaatacaagaaaaaatggaacgtttcctttggcaatatcgtaaataataaatagaaaaagatgtatgaataattcgtatatctttttttgttgagagtaattttctgacaatttttattgtttttcatgcttttttatgttatactgattatgaaaaattttgtataaaaacaagaatataaaaaaataggagaacaaagtggctacattacttgaaaaaacacgtaaaatcaccgcgattttgcaagatggagtgaccgatttgcaacaagagttgccatataacagtatgactgaacgcttggcaaacgtcattgattgcaatgcatgtgtgattaatacgaagggcgagttgcttggttactcattgccttataatacaaacaatgaccgtgttgaccaatttttctatgatcgtaaattgcctgatgaatatgttcgtgcggcagtacgtatctacgatacaatggcaaacgttcctgttgaccgtccattagcaatctttccagaagaaagccttggcgattttccaaaaggtgtgacaactttagcacctatttatggttctggaatgcgtttgggaacatttatcatgtggcgtgaagacggcgaattcactgatgatgatttggtcttagttgaacttgcaacaacagtaattggtgttcaactctcaaatcttaaacttgaacaaatggaagaaaatatccgtaaagacaccatggcaactatggctgttaacacactttcatattcagaaatgaaagctgttaaagcaatcattgaagagcttgatggtgaagaagggcatgttatcgcttctgtcattgctgacaagattgggattacacgttcagtcatcgttaacgcattgcgtaaactcgaatctgctggtgtaattgaatcacgttcacttggtatgaaaggaacttatcttaaagttcttaatactggtttatttgataaacttgcaggacgtaatttctaaaagccagggtcttagcgctttagtgcttagacttcggcttcacaaaaagctcctatcgcagatgggagcttttcgtgctttataagagtttcaaacaaatttttataagtttagaatgtgaaaattatcagcgaagccatgtaagggtcttagcgctttagcgcttagacttcggcttcacaaaaagctcctatcgcagatgggagcttttcgtgctttataagagttttaaacaaatttttataagtttagaacgtgaaaattaccagcgaagccacgttagcgcttcgcccttttatcattcgcttgtgactcgcgttggtgctttataagccttttaatcaaaattctatcaggtgtttaggtcagaaggttgaacttgctgacagaagccacatacatagttagagtactatttagtttcacaaacagctcctatctcagatgggagttgtttgtgtcttataaagattattgattacagatttataattactgacgaaattatttgtcagcaatttttaaaattgtatcagagataaatttttctgtcagtaattttgctttctatttttactgacaaaaagttctatcattaaaaaaatgactggtaaatggtttaaaatcactgacagactgttaaaatgccgattttttgttataattaacaagaataaactctaaaaaatggagattgaaaatatgagtcaaattacagaggaacaagtcaagcacgtggcgcttttgtcgaagcttgaattctcggaaaatgaagtaaaatcatttaccgatacttttggaaaaatcattgatatggttgaaatgttagatgaagttgatggtgaaggtgtcccatttactatgaatgtggcagataatctcaacttcatgcgtgaagatgtggcagaaaaaggacttgaccgtgaaaaactcatggcagccgttcctgaaaaagaagacggctttatcaaagttccagcaatgctttctgatggaggagatgcttaatgtcatacaataacaaatcaatcaaagagcttcatgagctacttgtaaataaagaaatatctgctcttgaactgacaaaagcaacgctttctgatatttctgcacgtgaaccacaaattgatgcttttttgaaaattacagaagaaaaagctttgcaagatgctgccgcaattgatgctcgtggaattaatccagacgttgtgactgacggaatctcaattgctgtcaaagataatattgttacagaaggaattgaaacaacagctgcctcaaaaattcttggaggttggattccaccttataatgcaacggttgcgaataaattgagcgaatctgggttaattacaattggtaaactcaatatggatgagtttgcgatgggtggttctggtgaaaattcttcagttaagccaaccaaaaacgcttgggatcaaacaaaagtacctggtggttcttcatctggttctgcggcttcagttgcttctggtcaagttcgtttatcattgggttcagatacgggtggctcaattcgccaacctgccgcattcaatgggattgttggtttgaaaccaacttatggtcgtgtgagtcgttttggtttgattgcttttgcttcatcattagaccaaatcggtccattggcgccaacagtcgaagaaaatgctcaacttttgaatgtcatttctggctttgataaaaatgatagcacatcatcaaatgttgcagttcctgactttacaagtaaaattggtcaagacattaaaggaatgaagattgctttgcctaaagaatattttggtgaaggaattgatgaaaaagtaaaagaacaaattttggcagcagctaaacatttggaaaaattgggtgccatcgttgaagaagtgagtcttcctcacagtaaatatggtgttgccgtttattatattattgcctcttctgaagctagctcaaatcttcaacgttttgatggtattcgctacggttatcgtgctaatgacatcaataatcttgaagatttgtatgtgaaatctcgttctgaaggctttggtccggaagttcaacgtcgcatcatgttgggaactttcagtctttcagcaggttcttatgataaacatttcaaaaaagcaggtcaagttcgtactttaatcatcaatgattttgcaaaagtttttgaaaaatatgatttaatcttaggcccaacaactccgacaccagcttgggacttgggagcacgtgttgatgatccactttcaatgtatttggcggatttattgacaattccagtcaacctagctggacttccaggaatttcaattcctgctggttttgccgatggactacctgtgggaatgcaattgattggtaaacgttacgatgaagaaacgatttaccaagtagcggctgcttttgaagcaactactgatttccacaaaaaacaaccgattatttttggaaaataaaaaatggaatttgacgaattaatcaagcgattaaatgcagttgctgatgcaggacttttttacgggaaagatatctttgatattgaacgttatcaggaaatcaaagcaatttcatctcaacttctagagcattcaacgactttgacgaaagaggagctgacagctctctttcgtccaaataattcttatccgacaccgatgattgatgtgcgggcttttattcaaaatgaagaaaaagagatactctttgttcgggataaaatgcagggagactgggccttaccaggaggatatggtgagattggatttaccccaagtgaaaatctacttaaagagttgaaagaggaagccggagtttctggagagattgaacgcttattagcgattttcgatacagacaaatggcaaccgcaaggaaagcaatattataaatttgtttttaagtgtaaagctttatccattgattttctggaaaatagtgaaacttcagaaacgaaatttataaaacgctcagagctgacaaacttgtcagtaaaaagaacgaccatgtcacaacttagtttgcttgaaaaattgtcaaaaaccggaaaacaatatattgactaggataatttgactttcttaaagaaagtatcggagaaaataatgaactttgaaacagtaattgggcttgaagtccacgttgagttaagtacaaactcaaaaattttcagtcccgcctcaacaaaatttggtggagaccctaatacaaatacaaatgtgattgactggtcacttcctggtgttttaccagtaatgaataaaggggtaattgatagcggaattaaagcggcgcttgctttgaatatggatattcacaaatcaatgcattttgaccgcaaaaattatttctatcctgataatcccaaagcttaccaaatttcacaatttgatgagccaattggttataatggttccattgaaattgaacttgaagatggccataaagcgacgattcgcattgagcgcgctcatttagaagaagatgctgggaaaaatacgcacggaacggatggttattcttatgtcgatttgaatcgtcaaggggtgccattgattgagattgtctcagaagcggatatgcgcactcctgaggaagcttatgcctacttgacagctcttaaagaagccattctttacacaggaatttctgatgtgaagatggaagaaggttcaatgcgttgtgatgccaatgtttcgctccgtccttatggtcaagaagcttttggtgtgaagacagaagttaaaaacatgaactcatttagcaatgtcaaaaaagctttggactttgaagtcgaaaggcaagctaagattttgcgcgctggtggcgaaattcgtcaagaaacgcgtcgttttaatgataaaacgggtgaaacaattttgatgcgtgttaaagaaggtgcttctgattaccgttacttcccagagccagatgtccctcgttttgaaatttctgacgaatggatcgaagaaatgcgtcaaagtttgccaatgacggccagcgctcgtcgggtgcattatatcaatgatttgggcttgtcagactacgatgcgcgtcagttgacagcaacgaaagaggtttctgatttctttgatgaggcggtcaaatttgatactgaccctaaattggtttcaaactggttgcaaggtgaagtagcgcaatacttgaacagcgagaaaaaagaacttcatgagattggcttaactccagaaaatctgacagaaatgattcgtttgattgcggacggcactatttcttcaaaaatcgccaaaaaagtctttgtggaattggctaaaaatggtggttctgccgaagaatttgtcaagaaagctggtttggttcaaatttctgaccctgcagtgcttttgccaatcattcatgatgtatttgctaagaatgaacaatctgtagcagattatcgtggtgggaagcaaaatgcggcgaaagctttggttggtcaattgatgaaagcaactaaaggacaagctaacccaacggttgcgcaaaaacttttgtatcaagaattggataatttctaagtatcagctgtatgaaacagctatcctacatttcgttcggtcataagttagtggaagacagcaatatgaaaactttattttgttctgctagttataataataaaaaatatccgtcctaatttggaacggatattttttattatgcttgataagtatggtaaaatgttggcagaatgagtttgtcagcaaatatataaaactcagcttttaaaggagaatcatgcttgaaattaaagatgcaacttattgggcggagcaattaaaatcaggaaatctttctgccaaagcgttattagaaatgacaaatgacaagattcaaaagctcaatccgcgttacaatgcgattgttgcttatgatttagaaaaggcaaaagctgatttagctttaacgagtcaaggtttttttgctggtcttccttttgctttgaaaatgttgggacaaactcataaaggattgcctgatacggctagctctcagctcttttcagagaatgtggcatcagaggatgacaactatgttaaaggactcttagaagctggtttcacgccatttggacaaacgaattctccagagtttggctttaaaaacatttctgattcaaaactctacggagatacacgaaatgtctggaatgaagcttattattcgggagggtcttctggcggagcagcctcggccgtggcttctgggatgtttgcaattgctggagcttcagatggcggtgggtcgattcggattccagcctcattttcgggcttgattggacttaaaatgacgagagggcggatgccacaagggcctgattcttaccgaggatggcaaggagcatcgatttccggagctcttactgtgtctgtgcgagatacggctcgttttgtgcttgaaatgcaaatcctacaagaagcagcaccttatcaggcaaaattgttggacgaaaaagaacttatagcgctcactaaaagtactgaccaagctgtcagcaataatttatcaagaaaattgaaaattgcttattcactccaaagcccgatttctggaattgaattatcaaaagatgccatgaatgcaagcctaaaagcagtagagtttttagagcgtcaaggtcatgaattgacagaagttgattttcctatagatgctcgtcctttgattcagtcttattatcgtatgaatgcggctgaaacagtggccatgttagaaccttgggaacgggctgccggacgaaaattgacgagtcaagatgttgaacttttgacttatgcgcttttagaagccggaagaaaagctccggtgtcttcttatatcaacgctttagctcagtgggatattgcggctagagattttactgacaaaatttataaagattatgatttatttttgacggcaacaactgctaaaacagcccctaaaattggtcaggaattaatgacagcggaagtactaaaagaaatgtcagaaattagccaatatgagtttgaacaacaaatagagattattgaagccgcctttgagcgctcattagcatttacgccttataatttcatcagtaatttaacgggtcagcctgcgctttctctgcccgtttatgttaatgaagaaacgaatctgccacttggaattcaactttggggaccaaaaaattctgaaattgaattattgaaagttgctaaagaatttgaggaagcgggtcaatttattttacccaaagcttatcaataagtttaacgatattttactgacagaaagtgaaaatcaaatctgtcagtaaatttaaaagaaaaaccgcctaagtggcggttttatgttaaatcctgattttgtctaaaacgtttaatcatgcggatggttgttggaattaagatagaggttgaacccagccaagcggcaggattacttgagataattaccgtataattgagtaaaagaacaccaatgatagcgactcctgcccgcatgaaaagctctgcaaagccacacaatgttggaatcttggcattacctaagccttgaattgttgagcgagtaacgaataaaatggctaacaaccaatagaaactcccgttcacaagataataatgactcgacatctcaataacggctgtttgactacttgaaatgaaagcagtggtgaaatagaagtgagcaaggtttaagataatggcaaagataattgaccaaccgacagcaattgtaagagcccgtgttaaaccttgattaattcgtttgtactgtttagccccataattttgtgctccaaaggttgccatggcaaggccgattgaaatcatcgggagcatcgcaaattggtcaattttagaaacgatggcttgggtagcgacagcatttgttcccattttattcaaagcgacttggagcgtgatagagccgatggcaataatacttgattgaaagcccattggaataccaagtctagcgtggtgggcaatttcggcacgatctagccgccataaattttttgaaatttgaaattcgggaacttttcgtttgatgtgccaaaaaagaaataaaaccgaaatcatttgggctaaaattgttgctccacttgctccagcaattcctaattttaagactagaatagcaaaatattcaaaggcaatatttaaaattgaggcagcaatcaaagcatacaatggcgttttagaatcgcccaaagcccttagagcattagacagataagcgtagagattggtggcaatcattccgcctaacataatgcttagaaaggtcttggcgccttcaaaaatttggcttggggtctgcatgacctgaagcaatggtcccacaaaaataagggacaatatgctgagcaaaatagaaatcgcaattgtaaagtagaggcccgtgacataggatttttttatggctaactcatcttttgccccgaaacgttgggccgttaaaattgtcaaaccagcggtcattccttgagcaaaaccgacaattaaaaagttgatggagcctgtcgctccaacagaagccaaagcatcttttcccaaggtttgaccgacaatcagagtatctgccgtgttatagaggacctgaaaaaagttacccataagtaagggcaaagtaaatgcaataagtcctgttaaaatatttcctttagttaaatctttcattttttccctaaacaaactaagttgatttctttattttagcccattttaatcgtttttacaatagtatttttgagaaaatatgaattatttgtaaaggcttacggaaaaatagtatgtcagtaaaattgacaataaaaaaatcactgacaaaactgtcagtgatttttatttaaagctgtaattatttttggatgttaacagcttgaggtccacgagggccatcttcaacgtcaaaagtaactttttgaccttcgtcaagtgttttgaatccatcagtttggatagctgagaagtgagcgaaaacgtcgtttccttcttcagtagtgataaagccgaagcctttagttgcgttaaaccatttaacagttccttgtgccatttttggtacttccttatttataaatttgtaaatctaatttcttgaataggaatgaacccaaaagcacagaactaatcgtaaaacaaaaacttacactttcatgttatcatagttaatatggaaagtaaagtagaaaaccgtaaaaaaatattacaaatgttaaaaaatttttcagactacgagaaaaggcgtcagaataaggatgttttaaagcagttaaccgcttcctcaaaatggaaatctgcaaaaaaaatagcgctttatatgtcaatgccaattgaatttaatttgacagaacttttcgaccaatctgacgacaaagaaattttgattcctaaatgcttacctgagcgtcaaatgatttttgccaagtatgataaagaaaatcttgttcgctcaaaatttggcttgcttgagccaaaatctgaaattgcagttgagcctgattttatccttgttccaggcttaatttggaatgatgagggttatcgaatcggttttggtggtggttattatgaccggtatttggctaattttgagggaacaacggcctctgtactttatgattttcaaaaaatggattttgaggtggaaagccatgacatcgcagtacaagaactttttatagggagaaaaaataatgaattttaatgaaattaaacgagattttacacgttacaaggcaacttatatcttatcaattatcacactcttagtttggttatggcaattttttacttacggaatatcggcaacttcagcaatcaacttgttcaatagtggagccatacttggtcaagttatgctgtttgacccaagccaaatgtggcgtttgtttacggcactctttatccatattggttgggcacacgttttattaaatgtggcgacgctctttttcatcggtcggcaaattgaaaatgtttttggttggctacgttttactctgatttatcttttatcaggaatttttggtaatgccatggtttttcttttgacacctagagtggtttcggcaggagcatccacttctatatttggcctctttgcggcagttgttggtttagcattttttacaaaacatccatttttacaacaaatcggtcgaatgtttactgtgttgattgttgctaacttggttatgaatctcttttctttaggaaatgtaagcatttgggcacatattggcggggcaattggtggactgcttttgtcagcaatttttgcgcctaaggctttcattccatctattcccaaacaataccgtatttttgcaacaggcgcctttgttattctcttggttctctttatcggtttaccatttttcaagtaaaaatatgttttgcttttgaaaacatgaaagtgcttgcaaagaatctttaatcttgttagaataaacttagttaaaaaacttgctgagggagaaaaaaagatgagaattgataaaatagttgatgccccaagagaatttatctttgaaaaaataattgattcgtgtctatttgacattgaaaaaaatacagggaaacgtccgaaagttagaagcttaaatggttatgaatatagtaagagctttgggaaaaaccaaagaggaagtattaaaattacagaactgacagaaccaagcatttacgcttttacgactaaaacaaatcgcaatacttttagtactcgctgggaattgcataaaattgatgaccgaagcactcaggtggtcattgaagagaaccaaacatcaaatggttttattcaaatgattaacgacaaagccgttggttttttcttgggacgttttaaaaagcgtcaaatggttgctgttttggataatgtcaatcgagcttacaatggcggtagagcaagataagtaaagtgtcagacaatgaaaattttaagactttcagatttacaaagaaataagttgttttcatgcgctttattttcagtgataagctaggcggaaagattataatactaaactgaattttcagttttactgtttgactttactgacagaatcagccttgaatgatgattttgaattggaaagaattaaaaagtactgattgctcttaagaacaagatactgaaagctgtcagtaattttgggctaaatatttggtctcgaagaaattaaaatttggatttgaaacagccgattttggctgtttttctattggacgattagaaaaatcaaaaaagtaaacgttaacaaaaatgttttcttattcctacaaatttgtgttaaaatgaatttatgaatgcgaatacaaaaaataataaagaatttttagatttggcaacttatgcctttcataagcctaaaacaaaggaacgggcaaaagcttttgacaaattacttgaattttcaactccttatggacactacgaaaatcaaaaactcacgtcaatggtgattgactcacactttaatgtttattggaaaaatcaagaagtcaaaacttctggaattggttatgttgccagttatcctgagtttcgaggcaatggagccattcgacaattaatgaccaaaagtttgcgagataattatgaaaaaggagtgattttttcatatttagcaccattttcatatgctttttatgaaaaatttggttatcattatgcttttaatcaaaaacattatcgactagcagctcaagattttcctaaaggtaagagaagtgcgggcgaaattagtcgagaaaagtttgagtttgatgatgaaaatgctagtgaattttctgtcagtaaaaatacagccctttttaaagtactgacagaagttcatcaaaaggctgataatcaaggctcacttgttcgctctccagaactttggtcttactttttcagttttaaatcacaacctcactgtgggatttatcgcgaaaatggtaaggctttgggctatcttctctatgaattttcagaaatgacatttgttatcaaagaactgataactttgactgacgaggcaaaacaagcattttatcgttttatttcaagccatgccggttcattttcggaaattagttggcaagcaccctcagatattctccttgaagaagaactgacagagccacagcgagcagaaattaaacttgttccttatatgcaggcacggattgttaacttacaggaatttttaaaagtacacggtcagcccgatttttcagttgaaattactgacgaaattattcctgaaaacaatattagtctcggagaaggaaaaagagaaaaaatgaccattggccaatttacggcaaaaattttaaaagagaatcaggcgattcttcgtgaatatttttaaaaaagttactgacagctttgtcagtaacttttttgataaaaattaaagaaattaaaaaattagaatattgtgggaggagtagtttgtttgttacactgatattactgacaaaaattggtataggtcaattcgccttattttaaagattttaacgaaagaaagcgttaaacctatctaaaaatgagaatttatcgttaatgtttcaatttaagaaacatgtttttttaagatgatatcgcttgcaaaaatgaaatgaaagccttatcatagacttaaggtttatttcagaaataaaaaaaggaaataaacaaataagaaaaaggagaaaaaaatgggaaaattaggggtatctatctatccagaacgctcaaattttgaggcagataaagcttatcttgatttagcgcatcaatatggatttaagcgtgtcttcacttctttactcgaaattgatggagataaagaaggggttctcgcagctttcaaaaaagttgttgattacgccaatcagttaggaatggaagtcatggtggatatcaatccaggtctctttacacaacttaacattagttatgatgacctcagctttttccatgaaatgggtgcagatggagttcgacttgacataggattcacgggagccgaagaagccaaaatgacccgaaatccttacggaatcaaaattgaaatcaacatgagtcagggaacaacctatgttgattcaataatggattactcacctgatactgaaaaactgttgggaagtcacaatttctacccacatcgttacacaggattggaatttaaccattatcttaaatgtacagaaaaattcaaaggctataatttaaacaccatggcctttgtcaattcgcaagcagcaacatttggtccttggccaactcaagatggcctttgtactcttgaagaccacagaagccttgaaattgcgacacaagttaaacattacaaactcctcggtggaattgatgatgtcactattgccaatgcttatgcgagcgaagaagaacttaaagcaatgagccaagcatttaacgcaagcatgcctgagattaaagtcgttccacgtgaaacaatcagcgaaaatgaacgcaaatgtctttttgaagcgacacatagctaccgtggtgataaatcagcttacatgctccgttcaacaatgacaagaatcacttataaagaccttgaattccccgctcacgatactgataaaattcaacgtggcgatgtcattattgacaacgaaggctatggtcaatataaaggtgagactcaaatcgccttacgtgaaatggaaaatgatggtcgagtcaatgtggttggacgtatcgctgatgatgaattattcctacttgatttcctaaaaccatggagctcatttaaacttatcgagagcaaaaaataatcgataatctatgcctgtcagtactgacagaaccttaattatgttcaaaaagtttttttgaaagttatttattattatattataaaggaggaattccatgaacggaattactgcgtggatggagaaatatctcgtccctgttgcggcaaagattgggtctcaaaaacacctagttgcgctgcgtgactcatttatcggtatgttgccagcgacacttgctggtgccttagctgccatgatttcagctatcgtgacaacattcccgtcagctatccaacaaatgatgttgggagcaacagcattctcaaaattagcaccagagaaagtctggacacttgctaatacaccaatcattggtgatttgaacaatatttcagcccttgttaaccaaggtacactgacagttattggtcttatctttgccttttcttggggttacaatttggcccgtgcttacggagtcaatgatctcgctggtggtatcgtatcagttgcaaccttatttgcaggattgccaaaccaaatgggtaaatttacagcagcccttggtacaggtaaagctggtgtagcagcaactgacaagcttaatggcgttcttggtgatcaagggcttgccgcttggaaaccactctttgcctcagctcacctcgatgctggagcatacttcacagttattattatgggtgcccttgcagttattatttatgcaaaactcatgcttgctgacatcacaattaagatgccagaatcagttccacctgcagtagcaaaagctttcttagcaatcattcctacaattgcagcactttatatcgttggtctaatctactacatcattggtaaattgacaaatgactctgtcattaacctgattacccactatattgcagagccattccaaatcctgtcacaaaatatcttctcagtactgattgttacactctttgtttcagtattctggttcttcggacttcacggaccaaacgttttggcaccagtactcgatggtatctggggacctcttggacttaataaccaagccctctacttccaagttcactcacaaggtatccgtgacttgattgctaaaggtgcggttgataaagcacatgccattaatggtgactacgttaacctttgggtacgtggttcatgggacgcctttgcatggtttggtggatcaggtggtacaattacacttgttattgcaatcatcctcttctctaaacgtaaagactacaagattgttggacgtctcggacttgcacctggtatcttcaacatcaacgaaccagtcctcttcggtctgccagttgtcttgaatgcaatcttctttattccatttgcagtcgctccattgatttctgtaatcattgcctacactgcaacagcccttcacttggttgacccagttgtcaatgctgtgccatgggtaacaccaccaattatgaatgccttcatggcaaccggttttgactggcgggcaattgtccttacaattatcaacttgatcattacctttgttatctgggtaccattcgttatcgcagctaacaagttggaagaaactgaactcgactaaatttgaaattaatggtagagcaagtgagaaaacttgctctacacattttttgttaaatctggtaagatttataatataaaccttatcagatgtgataaaaaacactcatagaggaggaaatactatgatactcgtaaattctgcaatgatgcaaaaagaaattattcaacttttagaagaaaatggctttaaacatacaaaaaaacaaggattaaaacttttctttgaaacaccaacagatgacgcaacgactgacgcagcaatggctaaacagctaattaaaggaagctcatttggagcagctgtcttctttaatgtgagtgttgtatgagtacctggggcatcgcttttatcagtttaggtctattgcttgtggcttatcataactggctcggtttagcaatcgttttaattggcttggcaatgattcttattgcacgcagccaaaaaaagaaagccaacaaaatagaatcagaaaatcaacaagcacataaagatataaaaataaaatcaagaaaataaagttgtcttttaagacaacttttttaggataatcacgtaaaaataaaaaaacaaattccaaaagataaaacaaaataaaacggttacaaatgttataatatagactataaacaagtaatgggggaataaaatggagcacaaaaaattaaaagcatttccaaatgattttctatggggttcagcttcggcagcctatcaagttgagggagcaccttttgaagatggcaaaaaagccagtgtctgggataattttgtccgtattccaggcaagacttttaaaggaacgaatggggatatcgctgttgatcattatcatcgctataaagaagatgtggctttaatgaaagagttgggccttaaatcctaccgtttttcaattgcttggacgcggattttacctgacggacgtggcgaagtcaatcaagcaggcttgaaattctatgaagatttgattgatgagttgattgctaatgagattgaaccaattgtcacgatttatcattgggatttgccccaagccttagaagatttatatggtggttgggaatcacgagaaattattgcagattttgttaactatgctgaagttttatttaaagctttcaaaggtaaagtaaaatattgggtatcgcttaatgaacaaaatatttttacaagtcaaggttggtcactcgcgactcacccacctggaaaaagagatatgaaacttttttatcaggtcaatcatatcgctaatctggcaaatgctgcggtaatcaataaatttcatgagcatgaaatggatggacaaattgggccttcgtttgcctatacgccacaatatgctaaggattctgacccactcaatgttttagcggctgaaaatgcagaagagctttatagtcatttttggatggatgtttatctttacggagaatacccgattgcggcaatggcttatttacgtgaaaatgggctagcacctgaatttgaagcaggggatgctgaactcttgaaatcagctaaacctgattttctaggtattaattattaccagacagctactaacgcatggaatccagttgacggaggagttggagttggttcctttaatacaagtggtaaaaaaggaacaaccaaagaatcaggaattccaggtctccataaaaaaattcaaaatccttttattgaccgaactaattgggattgggaaattgaccctgaaggcctgagaattgcacttcgtcgtatcacttctcgttatcgtattccagtgatgattacagaaaatggcttgggcgaatatgataaagttgaagacggaaaaattcatgatgattatcgaatcaaatatctagaaagtcatgttaaagcaatcaaagaagcgatgacggatggagcaaaagtcattggttatcacacttggtcttatactgacctcctttcttggttaaatggctaccaaaaacgttatggttttgtctatgttgaccaagatgaaacaatggaaggttcattgaaacggataccgaaggattcttattactggtatcaacatcttatcgaaacaaatgctgaagaagtctaaatgaaaagcgctctctgagtgctttttttatgatataatagaaaaaaacaaatgaggtaagagatgaaaattcgtggatttgaagtggtaactaaatataaaaatgctggaattaatataccaaaacgttcaactgaacattcagcaggttatgacattgaagcagctgaaaccgttagttttgcgccaggggaaattaaattaattccaacaggcttgaaggcctatatgcaggcaggtgaagtgctttacatgtatgaccgttcatcaaatcctcgtaaaaaaggcttggttttaatcaattcagtaggcgttattgacaaggattactataataatcctgataatgaagggcatatgttcatgcaaatgcgtaatttcactgatgaagaagtcctagttgaaaaaggggagcgcgtggttcagggagtcttcatgcctttcttggtcgctgatggtgatgaaaatcaagaaaaagaagaacggactggtggttttgggtcaacaggagcttaatccaaattaaagtaatttaagaagcgcaattgcgcttcttatttttgtgaacggaagcttttaaagcctattcccattacctgtgttataaatcttaagtttgtcacaagcaaactgctagggcatctgtagatgctttattgctctgaggaagatactatagcaatcttaagtttcacttgcttataaattaggcgaaagctagtaagacgaaatattgtttagccttagtagctatgctataatagtattatgaataaactgcgtatcctccatttgaatgatttacactctcacttggaacgtttccctgtgattgagcgtttttttgcggaaaaatcacatgaagaagttgaaagtttgtctttcgacttgggtgacaatgtggatcgggttcatcctttgacggaggcaacagagggacaatttaatgttgaattgatgaatcgtttagatttgacggcggcgacaataggtaataatgagggattaggactgacacatgagatgctttctcatctctatgatgaagctaattttcctgttctcttgtcaaatttgacgacaaattttgcacaatctgagcctttgatagtcacgacttcatttggcttaagaattggattaattggtttgacagccccttatgttcttgcttatccacaggcgggctgggaattgtcagacccttttgtggttttagatgaacttttaccaaaactggattgtgattttaccattttactttctcatttgggtaagaatgttgatgagcaaattgcgaaggactatgatgagattgacttgattattggagctcatacacatcatttatttgaacatggtgctcaagttaatcaaacccttcttgcagctgctggacgctacggcgaatatgtggggcaaattgatttaacttttaatgaaaataatcaattagttgatgcacaaattgaagctatagcaaccaatacgcttcctcaaaggaaatcggatttggtagaaaccaatggttgggaactgagagggcataaactcttagagggaacagtcgttgctgatttacctaaagccttacctaatgttttaccggatttcaaagcaagtcattatttggcaaaaatctttgcggattatggaaatacaaaactttgtctcatgaattccggtttgttggtgacagatgaattaccaaatcatttaactttagatgatttacatgaatttttaccccattcgattcgtttagttcgtttcacatttacaggtgaagaacttagacaagttttgcttgaaattatggatgtttcggatttccttgccacccaaaaaattcaaggaatgggttttcgtggaaaaacatttggttctcttatatttcatggaattgagccacgcgaaggtgatttttacataaaaaattcggaaaatcggtcacttgaaaaaatttctgatgaagagagttatcaaattgttttacctgaccaatatttgtttgcttggtatttccctttattgaaaaaattgggaaaatcagaaattttattcccttatttcttacgagaaattgtagcagaacattttaaaaataaatagaaatagaaaaattaatggctaaagtaatagacgaaagtaagttaaattataataaatatcctggcgaacatgttatggcagtaggggaagttgttcaagttggacaacgaacttttcatattgttcataattatcgtgaggcttttgatgcggaaaaattagaacaacgtttttctgatgttttagataagtatgattatattgtgggagattggggctttgagcaattgcgtttgaagggttttttctcaaccagtcgtagaaaaatgttggcagacaataaaattgatcatcttgaagattatgtcaatgaatattgtaattatggttgtgcttattttgttttacggcggattcggacaaaagatgaagcttttgtttctgagaaactttttaccgaaaaagagttgaagcaaggatttgataagccacgtcgtaagagaaatcgcaatcgaaatcgggcgcgtgatgaacagaaagttactaaagaagacaaacgttcggaaaattcatcagaagctcgaaaagattttaaaattcgtgaaaaatctactgacagaaaaccaaaagttactgacaaaaataaaaaagtttctgtcagtaaaaaatctcaagagagaaaaacagacaataaaaaacaaaatccagctaaagattctgataaaaaatttacaatgaaaaaacggaatcctcgtaaaaaagttgagcaaacagagactaaaaagcaagagaatcaaggctttgtcattcgtaatcgtaaaaaggattgaggattttgtaaaagttatttgacggtcagccaacttgtcaaagactaaaaattatcgtagaattaacatttatggacttctaagtgatttagtttttcataaataaatgataataatttaaattgattttatgagtgtattcaagggatatgaaaaattgcacgattaaaatttgagatacttaaggaaaataatgacagagaatataataacagaaacgcgtccttcaatttatggattgacacgtgaccaattaattgaatgggcaattgaaaatggagaaaagaaattccgagcaactcaggtttgggattggctttaccgtaaacgtgttcaatcttttgaagaaatgagcaatttatcagctgcttttattgataaacttaatgagcattttattttgaatccattagaacaagttgttgttcaagaatctgctgacggaacagtgaaatatctatttatgcttcctgacaagatgatgattgaaacagttttgatgcgtcaatcttatggtttgtctgtttgtgttacaactcaagtaggttgtaatatgggttgtactttctgtgcttctgggattttgaaaaaagaacgtgatgtgactgctggggaaattgtcagccaaatcatgctcgttcaaaaatactttgatgaacgtggtttagatgaacgtgtttcacacgtggtagttatgggaattggtgaaccttttgataattacgaacatctaatgaacttcttgcgtgttattaatgatgataatgggctggcaattggggctcgtcacatcacagtttcaacttgtggatttatgccagcaaaaattaaagaatttgcgcatgaaaatctacaaatcaatttagcaatttcacttcatgctccaaataatgagttgcgtacttcattgatgcgtattactcgtaacgcaccacttgaaaaactttttgaagcgattgactattacacagaaacaaccaatcgacgtgtgacttacgaatatattatgctttctggtgaaaatgacagcccagaaattgctcaacaattggctgacttgataaaacctagaaataaattgtcttatgttaacttgattccatacaatccagttgcagaacatattaaatatgaacgttcaacaaaagataatacggcaaaattttatgatgttttgaagaaaaatggcattaactgtgtcgttcgtcaagaacatggaacagatattgatgcagcttgtggacaattacgttctaaacaaattaagaaaaataaggccaaattagcctaatataaaaactgctgaccaggcagtttttttatttccacttttgtcagtaaaatatttcggaaataacctatatttaataaaaaaataaatataatgaataaatatgctatgcaaaagtgacaaaaatttgctaaaatataaacaaagaaaaaacgggtgtctgctctactagacttagaaattgatgcaaacaatttcagagaaactattcagctacatctcataagaggaatagaggagtatcatggattacgtaaagctcaataaatcacgacacaaagtaaaaaactttgatggtaaaaaaattcccacagtggatgttaaacaaattatttctgcagcaagtttagctccttctgcccacaatattcaaagttggcattttgtcattgtagaatcagaagaaaaacgggaagcattactttctgaagttgatcctggcaatcacgaacaaatcaaacaagctggtgcagtcatcgtcctctttagcgatacagatttagttgaacgttctcgtgatattgctagattaggagctggagagttggacgatgaacaacttctgcgcttcaatagtcgttatccacaaatgtatgaaggatttgaagaacttcatgaaagtaattatctttctatcaatattggtttggttacaatgaatcttgttttggctattaaaaattacggttatgagagcaacatcatcatgggctttaatcgaactcaaaaagtgaatgaacttttagaagttgaaaaacgttatcgcccagaactaattattccgcttggaaattcagaagataaaggaaaaccaagttaccgcctacctcaaagtcaaattatggaaattcgataaaaaaaaggagttcatctgaacttctttttacttatgaaaaaaaggcattatgttcgcaacattgggtctattttgctaaaatggagtaagatatttgataagtcattatcaaaagaaatgaatgaattatcgagaggaaagagaaaaaacattgctcacattttggcaggattatcccgaaattcagaataaattaaaggatgttcaagcgctcatgattgagcgtttaaaaattaataatcaagagatagaagcagcactagagaaatttgcatcacgtggcgggaaaatggttcgtcctgcgctttttttgctgttcgctgggattgtccctaatggctctaaagatgaagagaagctcattaaaatcgctgcatcattagagatgcttcattcagcaacattgattcacgatgatattatcgacgactctcctttaagacgtggtttaccgtcaatagagtcacaatttggcaaagatgtagctgtttatgctggagattttgtttatactgtttattttgaattattgattgaaaccatgaatgggacaagttttgtcgctaaaaatgctcaatcaatgaaaaaaattcttcagggtgaattgactcaaatgcaatctgcttttgacaaaaataatacagcgagacgctatatgaaagcaattagtggaaaaacagctgaattactgagtcttagctgtttagaaggtgtttattttgctggtggggataaaaaattacaatattctgcccgtaaaattggtcgagcaattggtcttgcttttcaagtttatgatgacattttaaattttacagtaggacttgatgaagctgataaacctattttgacagatttccgtcaagggatttatacattacctttactcttggctcgtgaagtaaatgatgaagcgattgctccttatttagaagcgccagaaaatttgtcaagacaagaatgtttagatttagcagaattagtgacagaatcaggtgggatagcaggagcactccttgttgccggaagattaacagaactggctttgaatgaaattcggaaattaccagaatcaccaaatcggcagattctagaagaagcaacacaaattttattggaaagaaattattgaaaacctgtcactgacaggctttttcatagaaaattttactgacagctattaggaaagttttctgtcagtaacttttttatctcaaaatttctgtcagtaacttttgagataaagcttttaaagctagtatttctctagtttgattttaaaagttttgatttaaaatgtgataaaataagaaatagtttttatagacgaattgataaataaaaagaggaaataatgaattttaaaatatttgctgaactaattgaattgaaagctaaaactgcttcaatttttccatttttactagggcttgcttactcgctttatcattatcagtcagtcaatttgtcagcacttgccatttattttgtggcaatgtttatgttcaactgttttgttgatatttgggacaactataatgattatcataaagcagtagatacagatgattatcaaaaaaatacaaatattatcggacgcgagaacttatcaatgggactcatcaaaagtttattggcctttttcttttttggtagtctgattttaggaattattgtcgctttaatgactggttgggcagtcttttggttgggactactctgctatgttgttggagttttctatgctggcgggccaaaaccactctcatcacttccacttggggaacttttatcaggtttgacaatgggttatgtcatttttctgatttgcctttatatcaatagttctcagaactttgtatggtcatttgcgaatctggcaacaactttcttgattgctttacctaatacattattgattgcaaatctgatgttagccaataacacctgtgatttagaagaagatgaagccaatcaccgctacacaatcgtgcattatattgggaaaaaggcagcacttatttggtggactacagctttaattttggcttttgttgccattgttgttgcagtaattttaggattactttctccgattatgcttttaattctgttaattgcaccattgatgataaaatttgctaaaccatatttacaaaaacaagtaaaaaaagaaacatttatttcatcggttaaaatcttaatggtttttcaacttgtacaagtcctactattctttgttagtttaattaaattttaaaaaaagaaaaactccaaatgaattaatttggagttttattattgattgttttagattgatttgttttttcagttagtggtcttgcaccattaaccagagcgattaaagcaaagactggaccaccgatataaggaagtaataaccagcaaagatttcctaagtggaaattaaagaaaacaattaaaaagacatatagggcgattcctagaaggaataaaagataaataggtaatgctttatttgcaatttctgctcgactgccagcactggtagatatttttgaaaaaaggagcatcgttggtaaaatcaaaatgccataaatcattgaaactagggcaaaaattctacggaaagttgaactttgagcaagagtaggtaacttacgggctgtaagttgtggactacgttcttgaatagcggcaatgaatttttctctttgagtccaacccgtgtaaaataatgcgaaagcgagtgtaccaaaaataaaccattcgtagagaattgtcagagggttggtttgttgtgaagataaactacccgaactggccatgattgccatgaaatcattcatggcatgtaccacaatcgcaaaaatcaaattgcttgttttcatgtaaaccacagctgcgaaaagtccaaaagccataactccaagaacttgaatgatagtatttcctaaaggttgattgcgaatattgaccaaatgcatgagtccaaatagtatacttgaaataaataaaggaacaataatcttatctttagaatttttaactaaaataccaaaaattaaacctctaaaagagagttcttcagcaaaaccaattaataaagtggctccaatggctagaaaaatatacgaagcgggggcatgttttcctattgcaagaactaaacctgccagaaacatgactaaaggaagaatgagcattcctaatgcttttttccagttatatcctttaaatagcaatttttgatgccagaaaaaatgattgagtagcagtaagatgatgataattggaatttcttgaataataatagaggttagtgaagcaaaatgtccgaggctgcgtaaccaattgataagaccaagagccttgagaataggattgagtgccagtaggtaggcaagccagaccaagaaaacactaaagacgctgatgtattttttcatagaagacctttcttgagttcaaaaatagttgtcagtgagcctttgtgaaaaaactttgacagattttgcataatgtttcagttatattttgattatagttttaaattttctacttgtcaattataaacaaagggtaagtggcaggcaaatcaagattattaagtaaaaagtactgacaaaattatcggtattctaaaacattcaaaataagcttaaaaaaatactgacagacttgttatggtagtaaatttaaccataataaatctgtcagtaactttttttaattacaacaatcatgtttaacatctgtttttttagttgaatgagattcagctgaaacgggtagagccgccgctcccttgaccggacaagtgttaacattgcaatcttcgcaagcccctttgctacgaacagttttaaaaatggcaaatccagtaataatgaggatgacagccaaaatgacaatactagctaagttcataagtaagacctttcccttttctgaaaatgaaatataaaccaaccgacaatacaattaatgctaataaactaaaaacatcaaagttttgtgagctaaacaaactacccaattgataaataatgaaactcatgctataagcaactaaagtttgaaaaccaaccgctcgtaaagtccaacgaacatcgcccatttctttataaattgttgagattgcagcaacacatggcgcgcaaagcagattgaaaacaaggagagaataagcggaaagaggagtataggtggcttgaacagcagaccagagttggtgactgtcagaagaattatgagcaaacaggacacccattgttccgacgattgtttcttttgcaattagtccagtaattgtagcgactgttgcacgccactcgccaaaaccaagaggagcaaagataacagcaacaactttaccaacatcagcaagaatggattgactcgcatcaacatgtgccaaggtccaattataatttgaagtgaaccaaatcaaaacattcatagcgaaaatgattgtaccagcccgcttgacgaaagaaaacgcacggtcgaaagcatattttaaaacagtcatcgcataaggtaaatgataggcaggaagttccatgatgaaagccgaagtatcaccagaaaacctccgtgtttttttcaaaataataccggagagaataatcatggacattcccaaaaagtaagcactaggagcaacccaagaagcgtgaggaaaaaaagcgccagaaactaatgcgataatagggagtttggcagaacaaggcataaaagttgtgaccataattgtaatttttcggtcacgttcttgctcaattgttctcgtcgccataattccaggtacgccacagccagaagcaataagcatgggaataaaagacttaccagaaaggccaaatcgtctaaaaattcggtccatgacaaaggctacccgagccatatatccagaatcttccagaattcctaaaagtaaaaagagcacaaaaatctgcggaacaaaacctaaaattgccccaactccggcaacgacaccatttaaaactaaatcttgaacccaaggagtaacagctaaagcattcattccattggcaattaaatcaggaagccattgaccaaagaagacatcattgagccaatcggtcgctgctgttccgacagtttgaatagaaataaaatagaccaaccacatgacgaaaacaaaaataggaagtcccaaccatttatgggtaataatctggtcgattcgatctgtcagattaattttaccagtttcagtctgagtaacgcaaagttgaacaatatgaccaattaaatcataacgttcattaacgataattgattcacggtcatctgccattaatttttgggtgatagaaacaatttcctcaatttcagccagttgttttgctgataagccagcttgagaattatcagtatgaacttgctgacttagcgctttatctgtttctccagctaataaaagtttgtcgccctcgaaaacttttatttgttcaaaacgattggtaaagccagttactttaccgatttccgagagcgccccttcaagtcgatggtcataatctaaaggctgactttcatgactttttagtgctgctttaacaacctcatctaaacctttatttttaatggccgaggttgtaacaacaggaattccaaggctataagaaagtttttcaatgtcgattttttttccttgaccagccaaaaggtcgctcatattaagcgctaaaaccatagggattccaagttccatcagctgtaaagtcaaataaagtgaacgctctaaattcgttgaatccacaatattaatgagggcatccggtggtgtttttgtcaaaaaatctctggcaacttgctcatcaagcgaataaggagaaagagagtaaagaccaggcaaatcttggatacaaatacttttatcttttcgataaaatccagatttcttttcaacagtaacgcctggccaattaccaacttgctgatttgatccggttagttgattaaaaatactcgtttttccactattggggtttccgagtagcgcaattattttcatattattaaaatttcttcttaaatttcgttagactttgttaagggttctaggacaatttctttacaaaaataacgataaaaataggtcaacaattttgctcactattgttcaagaacgactttgattttttcagcatcggtctttctcaaagagagagaatagcctcgaagcctaagttcaagagggtcgccaagtggtgctaatttttgcagatgaacacttgttcctcgcgtaatgcccatgtccatcaagcggcgcctgatatcagacgttgcatcaatcatacgaacgacaccagtttggccaacttgcaagtgagctaaaccaatgatatcctcgctagaacgtttttcttttacaaaaatttgctctaaaaattcagaacttaaagcaaggcgagtttcatcaattttgacaattgcattctcgccgtcagtagaaattagtgttatttttttatcggaaatcatgcctaaatcacgcagtttagcttgattcttcccaataattttatgaatataataaatttgcccaatatgggtattgttaagagttttcattttacctcccggaatcaaatgattacagaaaatgtcaagtacgttttacatttatgattatatcaaaatttaaagtacgatacaataattttctgaaaaataacagtaacttttaatatttaagaaatggagctcctaaaatctttaagtaatttcaatggaaatcaatagcgatttttgataggatgaatcatattagatgaggacttgtttttgacaaaaaagtgcttattgacagcctaatgtaaaggtgtcaagccctttgtcaaccaagtttacactagtgtcaaaaaggttgacagtcaatgttcacatgtaggaaaggaaaattgctgatggaaaaagaagaacttaaaaagaaattaagcccacttgcttatcgtgttacccaagaaaatgggacagaggccccttttgctaatgagtttgatgatttctttgaaaaaggattgtatgttgatgttgtgagtggtgaaccgctatttacaagtttagataaatatcaatcaggctgcggttggccagcatttacacaaccgattgaaaaaggagttgtcaaagaaaaacgagataaatctctatttatggaacgtacagaagttcgttctagtaatgctgacagtcatttgggtcatgtttttactgacggtcccttagataagggaggcttgcgttattgtattaattctgccgctttgcgtttcgttccttttgaccaattagaagcagagggttatggagagtacgtaaaatacttttcataattctatacactcaataaaaaagttactgacagaaattttaatcgatgaaaaatgcttctgtcagtaactttttataaaacaaaagaaaaattctgatgtttaacatcagaatttttttatttctatattttactcaactgagaagagatatggataaaccggttgttttccttcgtggatttcaacttcaatctcaggatattttttctcaagttctttagcaattttgtcagcgttggcttttttaccttcttcaccgatataaatcgctacaatctcactaccttcatcaatcatttggtcaaagacagcaaagattgcatcattcatttttcgtgttgaaacaacaattttgttattcaacattccaagtgtatcttttttatgaatttcgataccatcgacatttgtatcacgaatggctgttgttactgaacctgatttaacatcaagaagcgcatcagtcatagcggctttattttcttcaattgaacgtgtagggtcaaagctcaagagtgctgtaaatccttgaggaacagtggcagattcaatcacttcaacaggaatttcagcaacttcagcagcagattttgcagccataaagatattcttgttattaggtaagataattactttttctgcgttaacagcttcaatagcagtcaaaatatcttctgtcgaaggattcattgtttgaccaccagaaacgacatgattaacacccatttcacggaaaatatcagctaaaccttcaccagcagcaatagcaattaagccccagtcttttttagaagtagaagttgaaacatttgttgattttgcttctttttcagcgacaccttcattttgcaggcgcatattgtcaactttaacttttacaagacgaccatatttaagtccttcttgcataactaaaccaggatcttctgtatgaacgtggactttaacgacttcctcatcatcaacaacaagaagtgaattcccaattcctgcaagataagctttgaagttatcgtggtcgtaactttcacgagaagttggacctttaccaagttcaaccatgatttctgtacaataaccaaatttgatgtccgctgttgaagcattggcaacactttcgtgttcaacattaaccatacggtccattgcgccaagttcggcaacaggtgtttctggtacgaattcaccattaagcgccattaaaaagccttcatagatataaaccaaaccttgaccaccagagtcaacaactccaacttctttaagaactgggagcatatcaggagtcatggcaagtgcttttttagccccttcaagtactgcttccataatttcaacagcatcatcagtttcgtcagttttgcgttttgctaactcagcagcaccacgagaaacagttaaaattgttccctcaacaggtttcataactgccttataggctacttcgaccccattttgaagcgcagctgcaagatggattccatcaatttcttcgtaatctttaacatattgagcgaaaccacggaaaagttggcttaaaataacaccagaatttccacgagcgcccataagaagaccttttgaaagaatttgagccacttgaccaacagtatcagctggtttagaagcaacatcttttgccccatttgtaatggtcatgcccatgtttgttcctgtatctccatcgggaacagggaaaacattaagcgagttaacatattcggcttgttcgttcaaacggcttgccgctgcttgaaccatttcttgaaatttacttgcattaatatttgacactaatcttcaaccaccttcacattttgtacatatacgtttacgctactggctgtgatgccaagttgattttcgagattgaaacgaacacgttcttgaatattttttgcaacttcgctaatttttacaccataagaaatgacaacataaacatcgatagaagtttcgttgtcggcagttgtaacgacaactcctttagaatagttttcttgacgcaaaacactgcgaacattatctttaacagcagatttactggtcatgccgactacgccgaaaatttcagttgtagatgcacccacaaccgttgcaatgacttcggtagcaatatcgacattcccgtgttggttgttgatagtaacactcattttcatagctgtaccgtcgtcaataatttacaaattttgtaaataaagaaaaattgactgacaaacggcactttcctccatattatttaaatatcattactcattttatcatacttttataaaataaaacagctcttttgaactgctttttgaaatttactatttgtcagcgctgacagagtttgttggtaacaattttatttactgacagctctgtcagtaaataaaaaaccccgtcagatgacaggatatttttgtgttttgcaaaaaacaaaaattatacgcgttctacgcctgctggcaatttcttcaaagctttagctgaagcccatacagttttgagttcaccgttttcaagaattgtaactttttgaagatttggtttaactacacgtttagtttgattcatcgcgtgtgaacggttgttacttgaaacagtcttacgaccagtaaaataacattctttagacatgatatttacctcccattagatttttatgtgcttaaaaacaacatacttgttgattataacatttttcaaataaaaaaatcaagcttttgactatttttggctgttttttttcacgctttctgataaaatgagattatggaaaatttaatcgaagaacttactgcaaaaaataaagaatacattcattcggtaacgaaacaactgattttagttgggaaatcagatgaagaagttaaagaaatcttgaatgacattcttccgcaaattattgaaggtcaaaaatcaggaattattgctcgtaaattattgggagcgccaactgaatttgtttctcaatatcaaccaaaagttgctgacagacctgtcagtgaaaaaaatgaaaatccagttttgatgtggcttgatagtagcctactctttttaggatttatttctcttttaaatggagtaaccgcacttatcacttctaaagctccggtttatggcttgattacaacaatcttgtcagcggcagttgctggtttggtaatgtatatgatgtatcgttacttttatcgtcctaaagcggataacagtcgtagaacttggaattggaaaggttttgcagcaaccactctgtcagttctcctttggattgcggtaaccatcttctctggccttttgccaacatcagttaatttgcaacttcctgcaattgctttagttattgttggtattgtagcctttggagttcgttggctcttgaaacgtcaatttaacattcaatctgctttggttgctcaaccaagaagataaaaaaggaagtctctaattttagagatttttttatttatataggtagaatcttttcattagtgttttaaaatagtgtcagaaatgcctatttatcaaccttttatccccaaaatgaccacagagggttgtgtattgagaaacattttgtgttataatgtatattgattaattatgattatggaggtcctttgatgaaagggattattttagcaggagggtctggaacacgactttacccactgacacgtgctgcgtcaaaacaattgatgcctatttacgataaaccaatgatttattacccattgtcaactttgatgttggctgggattaaagacattttaattatctcgacaccaacagatactccacgttttaaagagttacttcaagatggttctgagtttgggattaatctgcaatatgcggtacaaccatcaccagatggattggctcaagcctttattattggtgaagaatttattggtgatgattcagttgcgcttattttgggtgataatatttatcacggacctgggatgtctaaaatgctccaaaatgcagctgcaaaagaaaaaggagccactgtttttggttatcatgttcctgatccagaacgttttggtgtcgttgaatttgatgaaaacatgaatgctgtttctattgaagaaaaaccagaagaacctaaatcaaattatgcagtaactggtttatacttctacgataatgatgttattgaaattgccaaaaacatcgaaccttcacctcgtggagagcttgaaattactgacgtaaataaagcttatcttgaacgtggcgatctgtcagttgaattaatgggccgtggttttgcttggttagatactggaacacatgaatctctccttgaagctgcacaatatatcgaaacagttcaacggatgcaaaatatgcaagtggcgaacttggaagaaattgcttatcgtatgggttatattacagctgacgatgttcttaaattggctcaaccgcttaagaaaaatgagtatggtcaatacttgcttcgtttgattggaaaagactaaaaagtcattattaaagtaaagttgtcaaagtacaagaaggacaatcaatgctaaaaaatatttgggaatggtttttgtggtttactggtgtgactgacgcaggttggtcagcgtggtggggcggatttttcagctgtttgccactttttggtgtctttgctgttgtttggcgaagactaaaatgtcatgcaccaggttgtcatcgaattggacttcatcgcacagctgatggactttatgttctttgtcgaaaacatcatccagatgtacctaataacctaacgctcgaacacattcaaaaatcacacgtcaatgcaaaagcgaaaaaagataagtgactgagtgactgaatgaagttagcgttgttcttgaataaactttgaaaatagtgattagaaagaaaaatatgactgataatttttttgaaaaaacattggctgcacgagaaatcagccaaattcctggaatgttagaatttgatatcccagttcatggtgataatcgtggatggtttaaagaaaatttccaaaaagaaaaaatggtgccacttggttttccagagagcttctttgccgaagaaaaattacaaaacaatgtaagtttttctcgtaaaaatgttttgcgtggtctccacgctgaaccttgggataaatatatttcggtggctgatggcggaagtgttttaggcgcatgggttgatttacgtgaaggagaaaatttcggtcatgtttatcaaactgtgattgatgcaagtaaaggaatttttgttccacgtggtgtggctaatggattccaagttttgtctgacacagtttcttatagctatttagttaatgattactgggcacttgaacttaaacctaaatacgcttttgtgaattatgctgacccaactttgggaattaagtgggaagatgttgaaaatgctgaagtttctgaagctgataaaaatcatccattattaaaagatgtaaaagctttgaaggctgatgaactctaatgtttgctttacatttacgaactaaaaaacgtttagaattttggcaagttgaaaaaaatactgacagaccgagctgggccaatcaggcatttactgacggtggcttttcttggaatgacaaatcgctgtcagtaaaaaatgtcggtggtttactcaaaatgacagttcctattggcgattatttggtcttcaatggaaaatatttaaaagctgtgccaaaagcaaaatttgtcagagaatatcgagtggattgacggtggaaattttacaaaactaagagggacttaagatgggtagtgaattgagagaatctaaggtgggagaggcgaaaaaatttatgatttggatacccattttaatttctttaggagcgctttgcttttctatttattcttggcatcaaggtaacaagcgccaaaagtattttgattctactaacttcaatattgtgcaaaatttgtgggagaaaaatccaagttatacattgtagaatgagtcagttaaaccactaaatttaccgccgcatccgacatacatgatgtatataccttctaagttgtatatgattttccctgatggaagcagaatatctagcttgatattattgccggtgtcatacgatatggttataagtcaaattgattctggaaaaactgttgatgatatagaaaagtctgagttgcctcaaaatttttatggtaaaaaaggagctagggatattcggttttctgatttcatatcaaaggattggggaaacatcaaatttcaattacggacctatccatttttagcaatcgctacccaagtagaatatagctataaagataatcctcaaaaaataaaccagcagacatttattactacaccgttcaacaggattgatctaactcctaaagaattcaaggacttggaaaattatactagaaatgtagcttatttccctcagaatgaaatgagattagacgggaaaaagaatatatatgacactactcatacatacctattaactcaaattcagcaatcatttaacaatgcaaaagatgatgataaagcgaaaaaagaaatgtatatactacttggagtcatgcacgatacggatgaaaaatatccagatagtaaatcacaagacgaaaaattcgattcttcgaaaattggtccaagcgaattgaactttaatgtgattactaaggtactgttagaaaaaggcctaattcctcaagatccattggagcccaattattaaaaataaaatcaaaaaaggaaaaaacatgactgaatttaaaaatatcgttgtgacaggtggagcaggatttatcggctcaaactttgtacactatgtttataacaatcatccagacgtgcatatcacagttttggataaattaacatatgcaggaaatgttaataacattaacatgttatttgacagtggacgtgtcgaacttgttgttggcgacattgcagaccctgaaattgttgatcaagtggcttctaaagcagacgcaattgttcactatgcagctgaaagccataatgataattctttgaaatctcaagatgaatttatccaaacaaactttatcggaacttatacgttgattcaagcggctcgtaaatatgatttacgtttccaccatgtttctactgatgaagtttatggtgatttgccttatcgcgaagatttgccaggtcatggcgaaggtgaaggtgaaaaatttactgacaaaacaccttacaatccatcaagcccttactcttcaactaaagcggcttctgatttgattgttcgtgcttgggtacgttcatttggacttaaagcaacaatttcaaactgctcaaataactacggacctttccaacacatcgaaaaatttattcctcgtcaaattactaatattctttcaggaatcaaaccaaaactttacggtgatggtaaaaacgttcgtgactggattcatacagaagaccattcatcaggtgtttggacaattttgactaaaggtcgtatgggcgaaacttatcttatcggtgcagacggtgaaaaaaataacaaagaagttcttgaagatattttgactcgtatgggcaaagataaagacgattatgaccgtgtaactgaccgtgctggccatgaccttcgttacgcgattgataatagtaaattacgtacagaacttggttgggctccaaaacatactgactttgaatctggtttgcaagcgacaatcgactggtatcgtgaaaacgaaaactggtggaaagctgaaaaagaagctgttgaagcaaaatatgctgaaacacaaaaagttttggaaaaataaaataaattccaattatattatctaaaagttactgacagtaataatgaaaaaatctgtcagtaaaaaattaaagattggagaacaaatgattttaataacaggtggaaatgggcaactcggaacagagttgcgtcatttacttgatgaacgtggcatggcttatacagcaacagatgctaaagaactcgatattactgacaaagcagctgttgataaattctttgatgaaaataaacccgaacttgtctatcattgtgcggcttacacagctgttgataaagctgaagacgaaggtcgcgagcttgatgaaaaaatcaatgttgatgggactaaaaatgtagccgaagcggcagcacgtgttggggcaacactcgtttatatttcaactgactacgtttttggcggaactttaccaattggtcaagagtggccggttgatgcaccaaaagctcctgaatctgaatatggacggacgaaacatcttggtgaagaagcggttgtggcttctggtgtaaaacattacatcatccgtactgcttgggtttttggttcttatggaccaaactttgtcttcacaatgcaaaacttggcgacacgttttccagaattaaccgttgttaatgatcaacacggcagaccaacttggacacgtacacttgctgaatttatggtttatttggttaatgaaaaagctgattttggtttttatcatctaacaaacgatgctgcgcctggtgaagatgtgacttggtttgattttgccaaagaaatcttgaaagacacagatgtgcttgttaaacctgtggattcaagcaaattcccagcaaaagcaaaacgtccatttaattcaacaatgagtcttgaaaaagcaaaagcgacaggttttgtcattccaacatggcaagaagctttagcaagtatgcttgaaaaaggcgatttgcgtgaaaataaagatggcgtaaaaggcgaaattaacaaaaaataatgactctgtcattaaaataaactaattgaaaattctgtcagcgacttgcaaaagctcgtcagtactgacagaattctcattttgagaggctgaaataatcactaaataaattttagtgagtaaaaggaacaacatgaaaaaacacgtttttatcattggtagccgtggcttaccagcgaaatatggagggtttgaaacatttgttgaagaactcgtcaaacatcaaaataataaaaatataaaatatcatgtagcttgtcaaagtgagaattcagacatggcactacctggagaacattttgagtatcttggagcagattgttttgtaattaagttacccaaaattggttcagcacgtgtgattgcttatgatattttagccattaatgcggcacttaaatattgtaaaaaagaagaaatcaaagcgcctattttttatattcttgggaatacagcaggtggatttattggccattatgctaataaaatccataaacttgggggaaaattatttgtcaatcctgatggattggaatggaaaagaaccaagtgggcagcaccaattcgttcttatttgaaatttgctgagaaaaaaatggtgcgatatgctgatttgattatttcagataacgcaggaattaaagaatatttaacaagtgaatatggacaagttgaatcagaagtgattgcttatggaacagaaaagttcaagtccgatttgacagaatcagaaactctggtaaaatataaagttaatgattattatttgattgtaggacgttttgtgcctgaaaataattatgaaacgctaattagagccttcatgaaaagttcaacaaaacgagaccttgtgattattactaatcatgaaggtaatgcttacttcaaagaattgcgcgaaaaaacgcaattcgacaaggatgcacgaattaaatttgttggaacagtctataatcaaaacgaattgagatatattcgtgaacatgcctttgcttatttacatggtcatgaggtaggggggacaaatcctggtttgcttgaggccatgtggtcaacagcggtcaatgttgttttaggagtcaatttcaaccggacgacagcaggcgattccgtcatttattttgacaagaaaaatttactgacaactttgtcagaagttgaaaatttgaccccagatgaaggtcaaagattacacgaaaaagctcaggcaattatcgaagaaaaatatacttgggagcatatttgtggtcaatatgaggaccttttcgctcctaagtttactgatgagtctgagcctttaagaaaaatggagaacctagccagaggcggagatgagagttaatattttaatgtcaacctacaacggcgagaagttcgtcgctgatcagattgagagtattcaaaaacaaacttatactgactggaatttaatcattcgtgacgatggttcaattgatagaacctgcgaaattgttgatgattttgtcagtaaagacaacagaattaaattaattcgagctgaaaatgttggggtgattaaatcctttcatgagcttgtaacagataataacaatgctgacttctatttttttgctgaccaagatgattattggttgccagagaagctgtcagtaatgctagaagaaactaagaaacatgataatagtaaaccggtcatgtattatacagatttgaaagttactgacagaaaccttaatgtgacttcggaatccatgatacgcagtcagtctgaccatgcaaataccaaacttgttcaagaattgactgaaaatacggtcacaggcggagcgagtatgattaatcatgagcttgcacaactttggcaaagcacaaatgatattattatgcatgattggtatttggcaattgtagcagctgcactcggtgagttggtttatattgaccaacctactcatctttatcgtcagcatgattctaatgttttgggagcaagaaccctctcaaaacggataaaaaaatggatacacccaaacttatggtttgaaaaatattggtggctcattacagccagtcaaaaacaagctcaaaaattactgacagaaaatttgtcactaatgtcggaagatgacaaagggcttgtgacagcttatgtcaatattttagcagaaccgaaagcaaagcgtcgtcaaattcttgaacaatatgatttacgtaaaaataaaaattatcatacaagcatttttcgcacacttattatcacaaaatttgcatacaaaggaaaaaacaaatgaatttcttcagccgtagaaatcaaattctacttaaagagttaattaaaactgactttaaacttcgttaccaaggaagcgtcataggttacctatggtctatcttaaaaccccttttacttttcttgattctctatctcgtcttcgtaagattcatgcgttttggggaagcaattcctcactttgctgtcgctcttttactcgggattacaatctggaatttctttagtgaagcaacaaatatgggaatgctctcaattgtcagccgtggagatttattgcgaaaagttaacttttcaaaacctgtcctcatcttctcagttgttgccaacgcttttattaatttaatgatttctttagttgtcgttattatctttgctttaattaatggcgtacaaatgagctggacagtaatattcgccgttcctttacttctagaattaatcatcttcacgatgggaattgcctttatcctttcaactctttttgtttatttccgtgatttaggaccaatttgggaagtagtaatgcaagcagctttctacggaacaccaattatctatccagtaacacaaatctcaacttcacatcttgaaattgccaaaatattgatgcttaatccaatggctcaaattgttcaagatatgcgttatattttaacttttagtaacaatgccaacccaacactatggcaaatgtggaacaatccttttgtaattatcattccatatatcttgccgattcttgtattcggacttggactttggatatttactaaaaactctaagaaattcgcagaagttatttaattaaggagacaaaatggctgaattagcagtaaaaattgatcatgtaagtaagtattttcgtcttccgacagaagcgagtacaagccttcggacaactcttgtcaatcgatttagaggaatcaaaggttataaagaacaacatgtcctaaaagacattgattttgaagtagaaaaaggtgatttctttgggattgttggtcgtaatggttcaggtaaatcaacacttttaaaaatcatttctcaaatttatgttccagaaaaaggaaaagttaccgttaatggtaaattggtttctttcattgaacttggtgttggtttcaatcccgagcttacgggccgtgaaaatgtttatatgaacggtgcgatgcttggattttcaactcaagaaattgatgaaatgtatgacgaaattgtcgattttgcagagttacatgagtttatgaaccaaaaactcaaaaattattctagtgggatgcaagttcgtttggctttctcagttgctatcaaagcaagaggagatgttcttgttttggatgaagttttggctgttggggatgaagcattccaaagaaaatgtaatgattatttcttggaaagaaaaaaatctggattaacaaccattttagttacccatgacatgaatgccgtaaaaaaatattgtaataaagcggtacttatcgaagatggtctaattaaagttgcaggaaatgtagataaagtagctaaccaatacagtttggacaatttaaaacgtcttaaagcggctcaagaagaatcaacagaagaagttgaagagtttgtcagtgatttaaaagtaaatttattatcaccagtacaaacaacgccagaacaacccattaaatttgaagtttcttataatgttaaagaagatattcaaacttatgttgctttctcattaaccgatgcagaccgtaatatctggatttataatgataactcaatggattacctgaccgaaggtcaaggtgaaaaacgagctgtttatgaatgcaaactagaccaagttaataatttaaaactcaagctacaagtttcagtgcggaatgctaaagatgaaatggttgcttatgatatcgatgaaaaaatcattattattaatcgtctcgacattccaaaagatgacctcagtgctaaagattcagcaagcggcctaatcttgcggaatggagattggaattttggttaaagaaaagactaaaagtaaaaaattaatgaaaccagagcgactttttttaattgttgctcttgttgctggcttgatttttgcgattgctcaaccactttttattgagcccgattcaagttatcattttgataaatcgtcttatctttcaaatacagttgtggatagaacaaaaattggatttcctgctgaggattatcaatcagcacctcttccttttacaacggtcacaacgaaaatgaaagatggaacttatttcaaagatttttttgaaacaaaacttccactagtttctaaaagtaaagtaacagataagcgtgccttaggaacaaaatggtatcaggatatcatgcatttgattcctgctttgggcgtaaaagtgggttatatgatttacccatcagtaggttcgatggtcttagttgctcggttatttagtttaattttctttgttttgacgatgtattttatcatcaaaaaactaaaagcttaccaaatgatattcacaatcatatctgtcactcctgttgctattcaatttgctacgagtctaagttatgattcttataattatattgtttttgcttggctaagtgcaaccttgattaacttggcagtagagttgcaagaaaataaagaaattcagctaaaagattttttcttaagaactattcttccgtcgattgccttgtatttttcaaaggccaactcacgcttactttatttaattgttttggcagtatttatagtaatagttgcgaaaaaattaaaacttagcttaacaaaactacaagttcttattggaagtggtgtattaattgttctaggagctttggtttatatttttagataccatgaccaattacgccttgtagtaagtaagttcctttatacgttcatggagccttattactcagtattaacaactcaagttatcagtggaacttcaacagcagcaatacctgcttggttttatccaatccaatatggagctttaattcttttatttttatcttatactaaagaacaagtgccacgttggtttgcttggttaggtttacttattaacctgattaatctgtttggagtattatttaaatttgccattgacccagcctttactgaacacgtaatcacagggccacaaggaagatatttcacagtctttatcttactcttggcaccaattttaacccttctagcccaaaaaatttcagttaaatcaactggaagttggttgagaagaaccgtactttttgttagtttaatggcccttgcgttgaacttaggcgttaccacacttaggtcttaccacttgcatctaccaatggatgaataccgctcaggaatagaacattatatctttaaataggtgaaattatggataaaaaagtatcagtcgtagtgacatgttataatcatgaaaaatacattgaagaatgcttgcgcagtatctttgggcaaactcatcaagaaatagaactcttaatttttaatgatggttcaacagatgcttctggagaggtaatttcagaagtgttgcaagattctccgtttgtggaaacacattatttttcagaaaaaaatagaggtttagcctacgtccgaaatgatgctttgagtaaaataactggcgattttctgttgttcgtagatagtgataactttttaaatgatgatcatgtcgaaaaattactgacagaattgtcagtaacaaattcagacattgcttattgtcaactttgggattttaatgcccaaagagacgttttacgtccagacttagaatacagctttgaaaaacaaattgtggggaatttaattgatgcctcatcacttgtcagagcttctaagattattgatgcaaaatttgatgaatctttgaataaccaaactcttgaagattatgatttttggcttaatttaattataaacaatggagcaaaaccagtttatgtcttcactacaaagttaaattatagagtattaaatgagtccttgagtaagcgtggaaattgggaaaattattataaatcctatttctacatcatcaacaaatatattcaaaaaattccagcagaattgatagaagccttacaaaaaaatctattactttgggtagacaactaccaaaatctagcaattgatagtgagcaaaaacttgctgacaaagaacaagaactcattaatcataatacccaagaagagataatgagaaaaatcatagctgacaaagatactcatattgctaaccaagaaaaagtgatttctgatatcacaaactccctagcttatcgaataataaataaacttctacaccccttaggaaagaaacatgaacaataaattattactatacgtacattttaaccgaaataacgaattaagcgaccacgttatatatcaactaacccatttacgtcagaattttgaagagattttcttcatttcaaatagtcagatggatgagaacgatttatcaacattaacagggcagaatcttattgacggttttatgcaacgtgaaaacaaggggtatgattttgttgcttggtcagacgcgatgaagcattatggatttgataaattggcttcgtatgattcagttactgttatgaatgatacatgttttggtcctgtttatgattttgaaggaattttagcaaaatttgacaaagatacaagcgttgatttttggggaattactaataatcgaagccataaagtaaaaccttgggaaaatcgagaagcgattgtattaccagaccatattcaaagctattttgtcaactataaacaaaaaattgtaaagagtgaagcatttgaaaatttttgggcaaatattgaagttttagatgatgttgtagaagttatcgtaaaatacgaaacagcaatgaccaagtattttgaagatgctggatttaagtcaggagttgtatttgatacacgtaaagaagagtgggcaggcatgcttgtccatgatttttccgtattcaatttaccagaattgttgaaaagacacattcctttcctaaaaataaaagctttcagctatggtgcagaaaatatttatactccattagtgattgaacgtttaaaacaagaaacttcttttccggttaaacttattgttaatcacatgacagaagtagattatccggaccgtgaatacatgttagaagaaaaaacactgaaattcacaaaagaagtaagttcgaaaacgaacttgaaaattggtattcaccttcatgcattttatcttgacctaattcccgaatatcttaattattttgataaatatattcaaaattatgatttatatatcaccacagatacagaagaaaagtatgaagaaattcttaaaaattatcctcttccacaaataaaaaaagttatcgtaaccggtaataaaggaagagacgttcttccgtggatgcaagtttcagaattaatgacagattatgacctttgcggacattttcacactaaaaaatcaaaagataatgattggattgtgggagaatcttggagacgagatattgaatattctttattagaacctgctcaagctatttttcaagaatttgaaaaaaatccaaagcttggcttaatgattgctgacgttccatcattttttgaacatttttatgggccaacatacatcaccgaacgtgatatttggccagatatgcaagaaatttggcaaaaaatagactttgaaaattccaaagaattgaagcagaaagatagctatgtgatgagttacggcacaatgatttggtatcgtcctcaagctttgaataacttattaaatgttaatattcaggctgacgttccagaagaacctttaccatataatagtattttacatgcatttgaacgccttcttgtttatgtttcgtgggcaaatggctatgatttccgtatttctcaaatacaaacaaataatgggtttgttgcgaacttttcagcaaatcgactcttacgttctgtagagactgatttaacacagacaaaattacgggatctagttaaaatgatctttaaaaagattaaagtaattattgtataccgtttaggatttaataaaaaaaataagtaaatttatggtaaaatttatattagaaaactgtacacaaagttgtacagcgcgaatattatgaggagaacttggagctgtgtccgaagacaagaaaatgaaaattttactaattatcccggcttataacgagggtgaaggaatattagaaaatctaaaaattgtagaggactatcaagccacttgtccttatcaattagattatgtagtgataaatgatggatccactgacaacgaagaagaaattttgacagcaaacaacattaaccacgttgaattgattcaaaatctcggaataggtggagccgtgcaaacaggttatctgtatgccttgcaaaattcttacgatatagccgttcaatttgatggagatggtcagcatgatatccattctttaccaaatctggtagaacctattttgaatgatgaagctgattttaccgttggttctagatttttagacgaaagcaattctgaatttaagtcttcaaaatcacgtcaaatgggtataaaaattctatcatctttaatttatatgtcttctaaaataaaaattaaagatgttaccagcggttatcgagcaggaaatcgtaaagtgattgagcaatttgttaaaagatatccaagacaatatccagaacctgaaagctacatgcacttattctctaaaaacattcgcgtcaaagaggtaggggtaaaaatgtttgagcggacaacgggtgtttcaagtattaacatggtaaaaggaataagttatatgataagtgtatccttagcgattattgcgagctcgttattaggaaaggagggtaagtaatgcctattcaacttcgtattttagcaattattttggcagctttcttctttatctatacgattcgtttggttcgtaaagatagagcagaaataagacatatgttaaaatggttcatgttagctctcatattgctgattggttcgattattccagatttgggtacaagtattgcacacctgctaggaattggaacattaacctcattagctttatatttcttggtaggggctttattatttatctgtttgaaatatcaaatttctctgatctcagctgaaaaagaaataaaaaatttagtacaagagttgtccttattgaaaaagaagatttccgatgaagataatgaagattaagaaattataaatactaataatagaataaggtagtaatgaataaagtcatcaaacatactttcgtcatatgtgcgtatatgcaatctccgtatttagaggaaagtataaaatcaattttagaccaaggatctattaaagaaggaatatcggaagtggttttgtatacttctactcctaattattatatagaaaatatttgtcataaatataacatcaagatatttattggtgaaggtggaggtattggagcagattggaatggagctttagcagcagttaaaaccaaatatgctacaattgttcatcaagatgatctatatgataagaaatatggtgaaatgataattaatgatttcgagtctcaaaaagactctaatattgtttttactgactattatgaaattgatggatactctaaacttagaaaaagaaatattaatttaaaaataaaaagtttaggattaaaactaatgtctttttgggaaaataaaaaatatcaaagaagagtttactcttttggtaattttatttgttgcccagctgtttcttataatatggaacgtcttaaagattttagatttaatgaagagatgaaaatggcagtagattgggatgcctgggaaagaataatgaaaaagcctggtcgtgtccactatcttcctttaaaattgatggctcatagaatacatagcgattcggaaacaaccaataatactttaaataaaaatagagaaaaagaagagcacgagatgtttcgaagatattggggagaaacaatggcaaaacttttaatgaaggtttatactaataatcaaaaaggaaattcataaagtaaatggacaaggataaaacattagtttcaataatagttcctgtatacaatgctgaattatatttggaagagtgtataaattcaattttagaacaaacatacaaaaatttggaaattattcttattgatgatggttctaccgataattcttttgagattatgaaacaatactctgaaaatgatagtagagttcaaagtctctcaataagtaattctggaccggggaagtgtagaaatgttgggctggatatatttagtggcgattttgtaatgtttgtagattctgatgatagaatttgcagagatttggttgaaatattactcgagcatcttgagagctcttcggagattgctatgtgcaaattttcaaaagagattcaaaagattgcaaaagggacaaaaaaagtagaaaaccaaacttctatttttgttgatagcataaaaagtatctatttacccggatttccatcttcaggaccagttgctaaattatatggtaagaaaatatttagtgagttacgattcccagatatatcaatgtatgaagatgctgctataagccttcaagttctatctattgctgataaggtaagttttgtagattattatggttactattacaggtttaattctgatagtatcacaaataaaagggtttcggaacgaaatttatttatttttgagaaaacaaaaataatgttagaatttacaaataaaaatcatcccgaagctttagatatagtgaaaacaatctgtctcaatgataacgactatgtgatgatggagtgtaccagaagtaatacagaaatagcaagaaccctctttgagcgcctactggaacaaaatagagatttatccaaaaacttaggtatgaggaagttagtttatactaatcgtttattattaaaaatagctttgaaaataatgagcaaaatttattacaatgattttgtacgaaatatttttaaaaaggttttgggagttaacaatggatgaaaaaattgactttatagtaacatacttggatagtgaagatacaaattggataaaagctaaagctgaaaatgatggtagtgatgtagctgaagcgcttaattcaacggcaagatatagaaatttggataattttcactactggtttagagctgttgaacgatatgctccatgggttaataagattcatttagtaacttgggggcatataccagaatggttaaatacagcacatcctaaattaaatataataaaacatgaagactacatccccgaaaaatatttaccaacgtttaattcaaatgttattgaattaaattatgatagaattgaaaatcttgcagaacaattcgtcaattttaatgatgatatgttcctgaacgctgatacaaaaccgtcagattttttcgttaatggccttcctaaattacaaatgatgtatatgcctattcaagccgttgaaaagtttagtaccgttttgtttaataatatgttagttctaaatagtcttgaagattcaactaaaatttttaataaaggaatgtactcattaaaaaatgggttatttgccactgcaacaaacctgtatttaactccgcttctcaaatatttcaataaattcatgggcttttacccagaccatttaccaaatgcgctacttaaaagttcaatgtcagaattgaaagaatcggcaccaagtttttttgatgaaacttccaacaataagtttagaacaataaatgatataaatatttggctctgtcaggactatctgagagctactggtaagttctctccacggaattcttttaaatttggacaagtattggaaataaaagatgatcaaaattatagttcactactttcttcaaaatataaggtagtgtgtgttaatgatggaagtgaaggggttaatgattttgatttagaaaaagaaagaatactagagaccttagaaaaaaaattcccagtaaaaagtgaatttgaaaaataaaaattattattgttttgatgtgataaaaataaagaaagaaggatgaaaatatctctaaatacaatttggattttagtatccccatagatcaaactgctggggccaaagctaaaatagactcagatactatatttaaggctagtggatataaatcgttattttcacaccatattcagacaaataaagtatatattaataaaatattaaatattatcttaggtattatttcattaacttttataaaaaaagggagtgttattactacaaattatccaccaaatctaattgataagaaaatagtctggagctatctatataaaataaaaagaataaaaaaaataaaattaattattcttattcatgatttagattttataagaaataacgataatgattctaatcaagaaaaaaaatatatagagcaacttgatgtggcagatgcgattattgtacataatactaaaatgattgatttactagtcgagaaaggtttatcaaaggataaacttattgatttgaagatatttgattatctagccgatatcagatccagtgggggaagctatggtaataaatttattgttgcggggaacctggatattcaaaagtctcagtacctatccaaaatttcaaaaatagatggagtatatttcaatctttatggaccaggttataatcaaaatgattatgataacgataagtctaaatattatggaagttttccttcagaaagtatccccaatgtaattcaaggttcgtatggtttagtatgggatagcgaagatttacaagggggagttggtccttatggagattatcagagatataacaatccccataaaacatctctttatttggctgcaggctttccagtagtagtttggaaaaaagctgctttagctcctttcattgtagaaaataatctagggtttgtagttgataacttgtatgaattacattctaaaatagaaaaactttctgaggacgagtataaccgaatgaaattaaatgttaaagaaatagggcaaaagatttattcaggatactttttgaatgaagctttaaaaaaagcagaaactgtcattgaggaaaataaattatgaaatacaatacaaaaaactatgattacttaattgttggtgcaggaccttatggtgcaattttcgcgcatgaagcagctaaacgtggaaaacgtagcttgattattgagcggcgtgcacatattggtggaaacatgtacactcataaagaacatggtatcaatgtccatgactttggagcacacattttccatacagacaataaagaagtttgggattatgttaatcaatttacagagttcaatggctatattaaccaagtagtagctaattataaaggtgaactctataatcttccgttcaatatgaatactttttatcaaatgtggggagtgaaaactccagaagaagcagcggcaaaaattgaggagcaaaaagttgctgcaggactttcaggtattccaaaaaaccttgaagaacaagcaatttctttaattggtactgatatttatacaaaattgattaaaggatatacagaaaaacaatgggggcgtaaagcaacagaacttccaagttttattatccgtcgtttgccagttcgttatacttttgataataactatttcaaccatcgatatcaaggagttccagtagatggatacacagcaatttttgataagatgctggattctgatttgattgatgttcaagtaaatactgatttcttctcaaataaagaggattatttagcggaattccctaaaattgtttatacaggaatgattgaccaatatttcaactatgaatttggagaattagagtatcgctcagttcgttttgaatcagaaacttttgaaacggataacaagcaaggaaatgctgttattaattatacagatgctgaaactccgttcactcgagtgatggaatggcgtcattttgacaaaaaaggcgatgataataaaacaatcatcactaaagaatatcctcaagattgggatcgtacaaaagaagcctattatcctgtcaatgacactaaaaactcagaactttttaagaaatatcgtaaattagcggataatgaaaaaacagtgatttttggtggccgtttgggaaattatcaatattatgatatggaccaagtctttaatgcagctttaaaggctgtggagaaggaatttaaagattgaaagtattaaaaaactatcttttgaatagctcttaccagcttttaattgtgattattccaattatcacaattccctatatttctagagtacttggaacaacagccataggtataaatacttttacttatgcgattatccagtattttgtattagctggttcaattgggataacaacttatggaaatcgagagattgcctatcatcaatctaacaaagaaaagagaagtcaaattttttgggaaatttcatttttgagattttgtacgattgctctctcttttcttgttttctgtgttttcttggcttttcaaaaacagaattttgaaatttatcttttacaaagtattgcaattatcgctgctgcttttgatatctcttggtattttatgggagtggagaactttaagcggaccgttggtcgtaattttattgtctctattatttcggttatttttatctttacttttattaagagcccaaaggatttacctatttatgtactgattattactggtacatctttgattggaaatctttctctttggccttatttacgtaaggaaatttttgctcctaaatggaaaacacttgccttaggtcatcatttaaaaccaacattattgctttttttaccacaaattgcgacacaaatttatacaattgccaacaagacgatgattgggatttttgatgggaaaacggcgtctggattctttagtcaatcagatagtctaattaaagtaacattgagtattgtcacctctttgggtgtagttatgctacctcacgtttccaatctgttttcaaaaggaaaaattaaagaggttcaagagaccttaaaaaaatcctttgttcttatgactggacttgccataccaataatgtttggggtgatgggaatagcactcaattttgcgggcttcttttttggtcccaaatgggtagctgtaggaccgttgttaatgatggaagctccaattattgtttttattgcctggagtaatgttttgggaatccaatatctccttcctttaaatcgaatgcgagagttcactacttcggtaacaattggagccgttcttaatattttacttaactttgttttaattccatctttagggcttacaggagcaatgattgcgacggtaattgctgaggccgcggtaacaatttatcaattctatattttgagaaatgattttgagatcgggacaatgattctatcgtgctggaagtactttttatccggtgcgattatgtttggggttgttttctatctcaacaatttatggaagatgaatttccgtaatcttttatttcaaatagtgattggtgctataatatatataattcttaatatcttattgaaaaccagtctttttattgaagtcaaaaagattgtaagtaaaaaataacccttatactaaatgattggagaataaaatgtataaaaaggtaaccttcttagtcactctcattggggtgctggggctattcctctttactttttctgaaggacaggttgtgagcgcctcggacaaaacttccaccactaatctatcaataaaagtcacagcatcaggggaaccgattcaaaatggaacatttatggctggaaattatcaaacggcctatgaacatattaagtcggggacttttccaagttctgtaacaaattcttctgcttggcgaggaacacaaaatactgaacatgtgatagtcgttgctgggttaactgttggagaaaataataaacattctgatagtgaagcaaaaacaataatttcgacactctttagtacaaactttacacttcttcagtcaattaatgagacaaacaatggaacagatattatgtcttttaatcctcctagcaactttgttagaatgcgtagccctagtggttcaaatgaaacaaccgatattaaagggagagccgttgcaaaagtttcgacaggattgacggcgattgtagacggaagtagtaaaggaattgtggaactaattgatgtaaccgccggtatgggggaagttaaagtggatatggatagttcaggactttcgctctcttttgcttctgggaactctaaaagtactgaacctaggacagttgagctagatcaagaactacattatgtgctcaaaataaataaaaaaatgttaagtcctaccgctttgacaaaaattgttcttagaccggatgctaatattgttattgatgagacgtcagttcccaatacagtaacctcattaattccacctatcattaatcctggggtaacatttgaccccttgtctagttcggatcagttaagtaaggttgccgaaacaataggacagactttaatttcttcgcaaattaatatgtacgaattgacaattccaccaacagatagtgatgtatcaattgatataaaagcacatctttcccctgttgtctacttaaatgatgttttgattcaacaaggaacaagtactaatactacaaaaatgaatattccgattcaagcatctagctctccagataataattttggtatgacagctaatgttatttcccaaacaacggggactcagattacttcatctgctcctaaagtaaacacaactggtattaactttgttgaggtagatgcaagtaaaaacaaaatggtaagggatgccgtttatgttttgggaaagactgttggtagtaagaagtatctgtatgatagtcaaggaaagtggagtcaaattcaagacctttctgcggtagttccgacaagttataccttgctaagaggagggaatcaatatgtttttggtgataatgaagtaagtcctattgagttgaataatagtagattcaattatgattatgagcgtgatactaagattaaccaatctttaataaaactatttggtttgggtgagggaaaagattattttctctatcaagtagctactcccgctaattattctgttgataaaacaccaattaatttctccattttttcagaaaatgtagtttctcctaatggtagtcaacttataaaaaccagcatcaaaacggcagtcaatcaatcgttcaaactaaatggtcttattccagactatagtgcagggacgaatgaatataatgtcttggctgttactcctcaaaaagaggttcattttagcgctctgaaatcaataattttcccactagcattatttgttttaggaattttggttattggtggtcttttagtgaggttggtgtaatatggatacagttagatatagaagaaatgatcattatcagaataaacaagttagtaagaggtctagaatctcatttaacgaagaaactatcgggaaaaaaatccataaattttatttgacaattgctctattctttggagtgattttatcaataggtatgcctttttttaatgaaccagatggtgtttaccactttgttaactcaagtaatattgttcatctgacaacagatataacggtttatggcgaaaattcaaaatggtttggtaatcaatttattaatcaaaaacctgcttatcagaatggagattactttaaaaaatactttgaaactgaagttcaaagaatgcctatgagtaaacttcctaggtctacggagtatcctaaagtattatcttataattttttgggacatatagtacccgctgctggagtttggctagggtatcacatttatccttcaatggggatgatgatagtatgtgctcgacttttatcaatgtttgtctatagtttgatattattttttataatcaaatatgttaaaagagggaaattggtatttacaataattggacttagtcctgttgtaatgaataccttctctagcctgtcttatgatggtttaacattaattcttgcggcttttcttgtagccgttggtattaatatggtaaacaagcgtaagataactcctcttaacttaataccaatgattattagttcaattgctgtatattttgccgcaaaaactaatatcaaacttttaattcttatctttcccataatagttctatctattcttatgaaaggaaggataaagggtaggattaataaacttcctagtcggttaaaattaataataagtatctttcttttgagctttgttctaattggtggagcgatttacgctcaacgatatgggggcttgggcctagttatttataaactatttatgaatttttcatataacttcaaccctaatataaacgtacaggatatcaatactatccttgttcaaccattagcaacacataatatgatgccattttggcttacgagtgtatggtttataatgattttagctgcggcttttgcagaagctaagtttgttaaagatcctttaattagttatggtgccttaggacttttcattctaaatatattggctctttacgttaatttctttacaggatattcttcgggagttaatgctgctaacggagcaattggtggggttcaaggacgttacataaccccgatgttcttcttactgccactatttgctgggaatgaacactttgaattaaaggttgtttcttacaagacaattgctttgttttctggtgtgattatagtaatttctaatagtcttttactttttgatactttgtttacaatattaaaattttaaaaagtcaccttatctaataaaaaaagttattccaaaattagtattttaactgattttcggaataactttttattttttaggttttagttgaagattattagactgagtaaatataaaaaaactaagaaaattttcttagctttttattttaattaactttccacgcgactgcaccatacttccaacctagtctgaggaggttgtcttgttcataggaatttgtggtgtagttgtgtgatcctgaagaagcatttggattgtaggcaacatagagatttttggaaccgtttgagtaaaaagctgctcctccattattatcccaacgccaacctttgctaacgagttgctgtgcttcatatttgctcatggtgtaataatgatctccacctcttgtattaggattataaactcggtaaacgggtgaaccagttgaggaagaaagccaaccgattccttcgtaacgccaaccaacattttgaagattagttttttcggcaaaatttaatgtataaaaatgttcacctgtgttggcattgtagagacgatagacatcttgtaaattttgtgaaggagcaccgaagatattattatagtcaattgaagtatctaagtccttaattaaaagatttgctgttccacctttgaaacgcatttggctggtatattgccaagcaccgtattgggtatttttcaaattggtagaagaggggctgccgtaaagatactgcgcagcccaaactttttttgctccaccaagagtattataattcatttggcaagttaatgtatttgtgcctaaccaagaagatgaggtataaaatatagtgttactgtatccttggctttttagttggctagcaaattttgcagcagaagtagcccagtcaacgttagcgggatttggatcaataacgtttcccttaccatctttatagggttgttcacaatccataatcatgacaatatttgtagagagtcccaatttttttgccgtatttgcaaaataattggcttcttgtacagccaaggagttaccagcatcttgagagttagctccttgcaaggtagcataatgatagacggcaatatttaatccagcacttttagccatttgaatctgacttgaagcatacggattgatatagcctgttccttcagtcaatttaataataatggttttgacgcctgctgcttttatggcattaaaatctgcttggaccatccaagattgatgactagaaatatcaacggcatcttttcttggcagagatgtattatctgaataaagagtatcaggaacattcgcagctggtatggctgctgcaaaagaacgtgctctgattgatggaacttcagctgtgtctgtactggtattttcctctgaatcctgctgttcttgctcttgtttgatgtagtagcccattggatggtcatcttgactaacattatcttcagcaaatactggtttggcgattaatagccctgacaatagaattagggaaataatgtgggattttttcagtttcatttctaaattttcagctttcctttgtgtggatgaaaaataaatggtttcatataatattttacaatgaggacaacaaagctttgttgcgttttagtaaaaaataactaacattttaatgaaaatgttttctttgggttttaaatgtaattttaaacagtctttttttaccctgtataatatatgttaccatatttaaggtgagtttatgaaataataaggtaattatcagtttaaattatgcatattttttaattaatctgtttcctactgttgaaatgctttgggaatagtggtagaatagtaaaaataaaaaattggcgaatgccatagaaatatagctatattgcttatatatagcacgataatggaggaatattttcgatgtcaaactgggaaactaagtttttgaaaaagggatttacttttgatgatgtattgctgattccagcagagtctcatgttttaccaaatgaggtgagtatgaagacaaagctggctaaaaatttgactttgaatattccaattatctctgctgccatggatactgtaactgactcaaaaatggctatttcaatggcgcgtcaaggtggacttggtgtagttcataaaaatatgtctgttgaggaacaagctgaagaaattcataaagtgaaacgttcagaatctggtgtcattacagatccatttttcttgactccaaatcataaaattgaagaagctgaaaacttgatggcaacttaccgaatttctggtgtaccaatcgttgatacgcttgaaaatcgtaaattggtagggattattactaaccgtgatttgcgttttattacggattataatcaacaaatcaaaaatatgatgacttctgaaaatctgattactgctccggttggaacaactttagatacagctgctcgtattttgcaagagcataaaattgaaaaattacctttggttgatgaagctggtaaattggctggtttgattacaattaaagatattgaacgtgtgattgaattcccaaatgctgctaaagatgagcaaggtcgtttgcttgttgctggagcagttggtgtatcttctgatacttttgagcgtgcggaagctttgttcgctgcaggggctgatgcgattgttattgataccgctcatggacattcagctggtgttttacgtaaaatccgtgaaatccgtaatcatttcccagaccgtactttgattgctggtaatattgctactggtgagggtgctcgtgctttgtttgaagctggtgttgatgtggttaaagttgggattggtcctggttctatctgtacgactcgtgttgttgctggtgtaggtgttccgcaaattacagctatttatgatgcggcaaatgtggcgcgtgaatttggtaaaacaatcatcgctgatggtggaattaaatattctggtgatattgttaaggcgcttgctgctggtggagacgctgttatgcttggttcaatgcttgcaggtactgacgaatctcctggtgaatttgaaatcttccaaggtcgtaagtttaaaacttaccgtggaatgggtagcttggcagcaatgaaaaaaggttctaaagaccgttatttccaaggggctgttaatgaagctaacaaacttgttccagagggaattgaaggacgtgtggcttataaaggaacagcgacagatatcattttccaaatgcttggcggtttgaaagcgggaatgggatatactggtgcggctgatattactgctttgcatgattcagcacaatttatcgaaatgtctggtgctggtttgaaagaatcacatccgcatgatgtacaaattactaaagaagcacctaactattctgtacaataaaaattactgacaagaattctgtcagtaaaaaaagggaattgacaagttgtcgttctcttttttattttgaaaattactgacagaaaaaattgtcagtaaaaagatgataaaaataggtcttttattataggaaaaaaggctaaaaatgctgttgaaatgtggtataataagcaatatgattgaaaatgaaaatacaatggaagatttgtactgtattggttgtggtgcaaaaattcaaactgaggataaaaatgcacttggctttttgcctgcgggtgctttgaagaaaaaaatagagaacgatgaggatttatactgtcagcgttgtttccgtttgcgccattataatgagattgcaccgacaagtttgacggatgcagattttttgcgtttacttaaagaaattggtcaacatgatgctttgattgtcaatgtggttgatatttttgactttaacggctctttgattcctaaccttcataaattgactggtggaaatgatttactcatggttgccaataaacgtgatgttttaccaaaatcactaaaagttgggaaattaactgcttggttaagagaacaagcggcatcacgttcgcttaaacctaaagatattttagtgacttcagctcaaaataaagatgatgtggctgagttgatggaagctattgaatactaccgccgtgggcgtgatgtctatgtggttggggtaacgaatgttggtaaatcaactttgattaatgcaattattaaatcagcttcaggttctgaggatgtgattacaacttcacgtttccctgggacaactcttgataagattgaaattccgcttgatgaagattcggcattgattgacacaccggggattattcaccgtgggcaaatggctcattatttggaaccagaagatttgaaatatgtatcaccgcgtaaagaaattaagccgaaaacttatcagctcaatcctgaacaaacattgttctttggtggtttggcacgttttgattttataagtggcgaacgtcaaggaatgacggcttattttgacaatgaaatcaatgttcatcggacgaaacttgaaggtgcgactgaattttatgaaaagcataaaggagaactcttggcccctgctttagttggtgccaaattggttcgtcgtgagtttaaaattactgacaaatcggatattgtcttttctggtctcggctgggttcgtgtgccacaaaaagcagttgtggcagcttgggtgccagaaggtgtggatatagttgttcgtaaggctttgattgggtaaaaaatattcacagtttgtcttgtaaaattactgacagaatttctgtcagtaaaatcttggagaattaaaatggaagagactagtcaggatattggttttacgcgtaataatcagtggtttcgatatcgggcagctggaattattattaaagatgatgctgttttaatggttggcaatgaccacaatgattattattattcggttggtggtgccgtgcaactgggtgaaacggccgaggaggcttgtctgcgtgagctttatgaggaaactggtttacaacttgaaatcgaaagattagcttttatccatgaaaatttttttacaggtcaggaaagtgattttttaaataaggtcaattgtcatgaattgagtttttattttctgatgaaaccactgacagaaaatatgtcagtaaaatcggagagttttgggactgatggtagcaaagaatttttgaaatggattccaattgctgagtataaaaattacaaagctttcccgacattctttgcagacgagctgaaaaatctgtcagtaaattctcaaatcaaaagaattgtgacaactgaataaataaatgagcagagtttgactctataacaattttagtctaaactcagctgacaaaaataaaaaaggaaaattttactaaaaatttgatagatttagaagaaaaacaagaaagagttctccttgctggagtggaaacagctgaaaattttcaggcttttgagtcatcaatgattgaacttgctgaactgacaaaaacagctggcggcttggttattgaccaattcactcaaaaaagagaacgtccagatagtcggacaatgattggttctggaaaattagaacaaatgcgttgggcgattgaagtgggtgaaattgatacggttattttcaatgatcgcttatcaccaaggcaaaatgtcaatttagaagaagctttgggtgtcaaagttatcgatagaatgcaattgattttggatatttttgctatgcgtgcgcgctcgcatgaaggaatgcttcaagttgaagaagcccagctcaattatcttttgcctcgtttggtgggacaagggattatgctcagccgtcaaggtgggggaattggttctaaagggccgggtgaaaccaagcttgaaacagatcgacgttatattcgcactcgaattgaaaacattgataaagccctcaaaaaagttgaaaaaacaagggaaaatattcgccaaaaacgctcaaaatcaggaatttttcggattggcttaattggttacaccaatgccggaaaatccagcattatgaatgctttagttgggcttgataaagaacaatatgagcaaaatgaactttttgcgactttggatgccacaacaaaagcagttaaattggttgaagactttacggtgtcactgaccgatactgtcggttttatccaaaacctgccaacagagctgattaaagcatttaaatcaacactagaagaatcagctaatgttgatttactgattcatgttgtggatgctagcaaccctcaccatgagattcatgaacaaacagttttaaaaatcatggaagatttgaagcttaccaatattcctgtgctgaatgtttataataaaatggatatagcaccaagtgatttcttgccaactttatcgccaagtttgcaactctcaattaaatctgaaagtggtgtgcaatggctgaaaacagcaattttggaaaaattacatgaactttttgatgcttttgagttagagttaccttacgaaaaagcctatcagttacctgaattacgaaaaagtgccttggtgcaatcagtggttgagggtgaaaaaggatatctgattaaaggattgattgcgcctgaattgagttggaaattacccaataactaaaggttgctcggaaattttaaaaatagaaataggaaaaattaaatcatggaaatgaacggaaaacaaaaacgctacttgcgtagcttggcagttaatattaaaccaattgttcaaattggcaaaagtggtttgtctaatgaaattttgacaagcattcgtaatgctgctgatgcacgtgaactaatcaaagttaatattttacaaaactcagatgaagtggcaacagatgttgcagaagcaattgaagaaatgggacttgatgttgttcaaatcatcggtcgaaatctcattgtgtttaaagtttctgaccgcaaagagaatcgcaaaatttcggttgaagttaaaaatattgtgaaataaagtgttctaaaaaataatcaaagactaagatataatgggtgaacaaatggcaatagatttattgactccttttacaaaggtagaattaaaagctaaagaagacgagaaacgacgtgcaatcggacttttttggggtaattttaatcctgttcatgttggccatttgacaattgctgaccaagtgcgccaagaacttaatttggaaaaagttgtctttttaccagaacataatactgatggacatgttgcagctatgctgaccgcagctattgaagattgtcctggtttagaagtagacgcttgtcgcctgaaagctaaagatggcgctgatatttatcaaacggtgcttgagcttcatgaagaaaatccagattgtgatttttattttattatcggtggtgacatgatttctggtttagctcattgggcacatattgatgagttattagaattagttcaattcgttgggattcgtcggcctcgttatcgggcaggaacttcttatccgattatgtgggtggatgttccaatgatggatatttctggaaatttgattcgggaacaattgcaccgtggaattaaaccacattttcttttggcaccgaaggttttagattacattttgaaagaaggcttatatgtttgacttttatccagaagtgaatttatcaagagaagatttgttagcgaaaattgctagcatggtcaaaaaatcacgctttgaacatatgctcggtgtggaaaaagcagcgattgcattagctgaaaaatatggagttgacccgcataaagcaagtttagctggacttttacatgactattgtaaagaagtggatgatgaaacttttctttctttgattgataaatatggcttagatgctgatttgaaaaattgggataataatatttggcatggaaaagtcggaatttataaaatgcgtgaagatttcggacttgaagatgaagaaattttaagggcgattgagattcatacggtcggagataaagaaatgtctggtttggctaaggtgttgtatgtagcagattacattgaggaaggtcgaacatttcctggggtcattgaagcccgtgccgttgctaatcaagatttaaatcaagcagttgcttttgaaaccatgcgtttggttgagtatttggcagaacgtcgtttgaccatttaccctcaaacttttgaagcttataatgcttttattggttatttgtcttgaaatatcgttagagataaactgcttattatgaacagaggaaaatgaatgattagaaaagctgaaatgaaagattatcttgacattgctcgcctttctggagtacttggttatccaatttctgaagcggctgtcaagaaaaatcttgcacgtattttaaaagatgctgaccatgaatttcttgtttttgaattgggagaaagagtgacagctttcatcgaagcggaaatttatgctccggtttatgctgaacaagtgatgctaaatgtcttaggtttagttgtggatgaaaaaaatcaaggacagggaattggtgctcaattacttaatgccttagaagaaaaggctaaagcgagagagattaaagttattagactgaactccggagtgcaaaggcatgaggcgcatcaattttatgaacatcaaggttataccagtaatcattcacagaagcgttttttaaaatttctctaaaaataatgaatataacaggcaacttttggttgctgtaactttttatgttaaaataagtgggtctagtttttacatttgattgtaaaggagctagagaaaatgaataataaatcttaaaaagatttttaatgaataaaaagagacaaaaagtctcggaggaaagaattggattcaaaaaaattacttgaagtggttgtaaaagcagccgatgataaaaaagcacttgatattgtggccttagatatgtctgaagtgacatttgttgcagattattttgtgattatggaagcaatgaatagccgtcagttagatgcaattgctgataatattgctgaagcggctgaacttgctggagcaaaagcagccggtcatattgaaggcgatgcaaaaacaggttgggttttgattgaccttggtgatatcgtagtcagtgtctttggacatgatgaacgtggacactttaatttagaaaaactttggtctgatgcaccaatggtagatatttctggatttatggctgaataattaatagctttgtcggtcttactgacagagctcttatttattttaaaatttactgacagccctattaaaagagctgtcagtaattctagaaagggctgaaatggcattttacgaagatttttcaagagtctatgatcaggtcatggaccaagaactttatgagcaatggcttgattttacaaaaagacatttaccaaaagaaacaaaatcagtttttgaattagcttgtggctctggtgctttatcagttcgtttggcccaagaaggctacaaagtgaccggacttgatatttctgaagaaatgttaactttggcaagtaaaaaagctcgtcaagccggatatcaacttgattttactgctggagatatgcgcgaactttctggacttggaaaatttgatgcggtaacttgctattctgactcactttgttatttggaaaatttggatgaattagaagctacgtttgatggtgtttttgaaatactaaatgaaggtggaacttttatttttgatgtgcattcaacttatcaagtagatgaagtttttcccaattactcttatcatgaaaatgcggaagactttgcttttttatgggactcatttgaaggagaagttccacattctattgtccatgaattaagttttttcattcagggttctgatgggaaatttacacgaaaagacgaagttcatgaagaacggacttatccaatcgacgattatctcgcacgcttggcaactgctggctttaaagaagcgatggtctgtgcagattttactgacgaggcgccgagcgaagaaagtgcgcgttggttctttgtctgtaaaaaataatcgaaaaaatatttctgtcagttactgacagatttttttagaggtagaaaatgaataagattacaggaattattgccgaatttaatccatttcataagggacatgaatatcttttgaaccagattgagggcataaaaatagtaaccatgtcagggaattggatgcagcgaggtgagcctgctatttttgataaatggacgagagcacaaatggctttagcttgtggtgctgatttagtggttgaattacctgtcactgtttcggtacaggcagctgatttttttgcaagtggtgctgtggatattttaaaaaatcttggaattactgacctggcttttggttcagaatcagcaattgattataatgaaattgctgatatttatgaaaaaagaggggaggaaatggaaagttacattcaatcattagctgaccacctttcctaccctgaaaaaactcaaaaaatgtggcagcattttacgggcattgaatttgacgggaacacaccaaatcacgtcttagctcttgcctatgctaaagcagcggcaggtaaacaaattaatttacaagcgattaaacgcgtcggaaaatttcattcactagagctgacagaaggatttgctagtgcaaccgcactccgtcaggagttattttcactgacagaaaggcaaaatttactgacagagcaaactaatcaatctgtcagtaataaatcggtgctgacagacttgtcagcaataaaaaatcatgttccgtcagccattttagcggcttatgcaagtccaaaaactaattgggcagcttattttccacttctgcaatataaaattcgagttgatgagcacttggaaaatatttttcaagtcaatcaagaactttctgtccgcttaaaaaaggcggtcaaatctgctaaaaattttgatgaattggtcgaacaagtttataccaaacgttatacgaaagcgcgtgtccgcaggcttttaacttatattttgttaaatattccaaagcagtttgatttaccagaacaaattcatgtgctaggtttttcaaaaactggtcaagaaattttagctcaaaatcggggaaaaattatcagtaaaattgggcaaaatccatgggacaacttgacccaaaaagctgatgaaatttatcaattaggaaatgttcaatttgaagaacaaaattttggtcgaaaaccaattcgttcatcaatcagatagacatttacgataaatgtttgtaaataacgtaaaaaatatgttatgataaaaagaaaaggaatttttattatgactgaaaaaagtatgaagaatcttgtcaaagtgacggggattcttaacatcattggtgctgccttggttgtgctttcaactatcgtttcaatggcttcactatcgcaagcactcaattcaactggttcaaacagctttgaagccggatttaatgcagcaaattctggccctgctatgtttatcaaaattattattgggtttgtgggaatagcaacatttgtccttgcgattattttacttcgccaaaatagaagattcaatttgagcaatgcagcagcaattttaacactgattgcaggaatctttgcttgggttattatatttgtttcgcttgttttatggattattgctgccgtgttcttattaagaatgaaaataaaagaaggtgaagaaaactctaatgaaatttcctcacaagaataatccctgatgaaattaaagtaaaatcccgtaaaatcgggattttttttgatttctcatagacgagcctttacaaattgtgatataatatgatagaaaaaatcatgcagattaatcctctgccaataatttaaataaaatttcaaggagattattccaatgggacgtaaatgggccaatattgttgctaaaaaaaccgctaaagacggtgcaacttctaaagtatatgcaaaattcggtgttgaaatctatgccgctgctaaacaaggtgaaccagatccagaatcaaattcatcattaaaattcgttattgaacgtgccaaacaagcgcaagttccaaaacacgttattgataaagcaatcgataaagccaaaggtggtggtgatgaaactttcgttcaaggacgttatgaaggatttggaccaaatggttcaatggttatcgccgaaactttgacttcaaatgttaaccgtacaatcgctaatgtccgtactactttccacaaaaatggtgggaatatcggagcagccggtgctgtcagctatatgtttgacaatacaggggtgattgtttttgaaggaactgaccctgaccatatctttgaaattttgcttgatgctgaagttgatgttcgtgatgtgaccgaagaagaaggaaatattgttgtttatacagaaccaacagaccttcataaaggaattgcagcacttaaagaagctggaattactgagttctcaacaacagaattagaaatgattcctcaatcagaagttgaactttcacctgaagatttagaaatctttgagggactcattgatgctcttgaagatgacgatgacgtccaaaaagtttatcataacgttgcaaatctctaatttgaaaatgaaaaatctgtcattaaggcaggtttttttatttataaatttgatataataaaagtatgtctagcccgaaaattgattataaaaaatctgataaaaattattatttaccaaaaggaatttctttaattgagctacctgcccttaattatctaatgatagatggcaaaggagcaccaacaagtccagcttttcaagaagccattcaatatttgtatgcgacagcctatatgatttcaatgtcttatcgaaacccagactttataattgaaaatttccaaccttttgtggttccgcctcttgaaggtttatggaccagtaaaaatgaacctagagctggtaaactagataaaaatgactttatttggcgattgatgattagaatgcccgattttgtggattctgaaatagttgaaaaagctaagaagttagttgagagtaaaaaaggatttgatttatcaaaagttaaatttgaagctattcaagacggattatgtctccaaaccattcatttaggttcttttgatgacgaaggggaaagctttgagaaactctttgagtatgctaaagaacatgatttaaaagctgttcacaaagaatttcatcatcgagaaatttatatcagtgatttcagaaagacaacaacagaaaaattgaaaacaaccctccgaatttttgtggagagaggacaagaaaaatgaagaaaacagattggtcacaacccttacgcaatcgattagcagaagattattttcctaaaatgattgaatttatcaatcagacttatcaagagggcaaagtatatccaccagaaaatcaaatttttcgggcgattgaattgactcctttggcgcaaacaaaggttatcattgttgggcaagacccttaccctcagcccgggaaagctcaaggcttggctttttcttatcctgctactttcaaagtgaatcgtccagactcgattgttaatatccaaaaagaattacgtgaggaaggtttttctaaagaagacagtgatttgacggcttgggccgaacagggtgttttacttctaaatgcagtcctgaccgtacctgagtttgcttcaaatgcccatgctggtaaaatttgggaaccgttgacagacgaaattatcaagattgcctcagatgatgagcgaccaaaagttttcattctttggggtggttttgctagaaagaaagccaaactaattgatggaagtaagcatctcatactagaagcggcgcatccgtcacctttgtcagcaagtcgtggattttttggttcgcatcctttctcaaaaaccaatgaatttctggttgaatctggtcaaagtccgattgattggagtaaataaaaaacagtctgatttgactgttttttatttatttaaaaataaagaacgatttttccatgtgcgtgacgattcatctgtaagttgattgcatctaaatagtcatcgatagagtacttagctgcaattggaaccgtcagttgatgattagagatggcatttaaaatcatttccatatcagaaggaagagcttcgccacctgtagccgttggaatcccagctggaggctctggatacatgatgacagtcgacatcttatcagctttgactcctaattcgagagcagctttaagcgtttcatggctgaataaatcgatagccgccgtgatttctttatttttcaaacggtcagccagacctgggccataacttatttgttcggcacctaaatcttgtaggaagtcagcggtagagtcagaagcagtaccgattactttagcgcctaaaatttgagcaagttgaaccgtaaaaattcttacgccaccggctgcaccaccaactaaaagagtatcccgtgctgttacgtgagcttttcgcagagcaactgccgcagtatggccagccacggcaagagtagaggcgacgtcatcttctacaaaatcgggtctatgaaaaagtccacgttctttcgttgaaaaaatgagttgttcggttgctgcacctctcattgttgttccaaaaacatggtcgccaactttaaagtcggtcacttctggaccaatttcatcgattattccagcaaaatcataggcaaaagtttggggaagtttgacaccaaaatttggagccacttcaggatttcccataatagcccaatccattggattgagtccaacaatgactgactttgatagaaacttcgtcagcttttggatggacgagaggaaggtccacgagttgaagaacatcgggtttaccaaatgttttgtattgtagtgctttaaccatttattttctccttaatgtgctttatcaacttttcttgacagttttaaagtcattttatataatgtcagtaactgacatttgagaatagtataatcctttagaggagccttgtcaaggaaaatatcacaaactgacatttaggggaagagatgaaaaaaacaagtcaagaaaaattatatgaagcagccttggaattgattacagcgcaaggttatgagaatacaactgttctacaaattgctaccaaagctggtttaacagagcgaacgttttttcgtaaatttaaaaataaagcagatattttctttgctggcggtgagcaatacagccaaatgttactgacgaaaatgaaagaatcaaaagcgaataatcctttggctattgttcttgaaagttatttttacgctgcagacttctttgatgaacatagagaaagaacagtcaaaagacaaaaaataattgccagtcacccagatttggaagaacgcgaacttttaaaacaaagcaaaatcgaagaactattagttgaatatttactgacagcttatggtgaaagaagtgcaagattagctgttcgcctagctcgagcagtttatagtgtggcttgggaagaatggttagaaaatgatgctgacagtttacatcatttattagaaaaagcaattgcagactttaatgaactcaaaaattactgacgtaaatactagcatatccgtaaatgcgctaaagcgcaaacggctatcctatgacagaaattttgtcagcaaaataaaaactactgacgagcctgtcagcagtttttttcctattctaagccttttttccaagggtcgagccaattgacaaaaagagcgatgaaaagaagtaatcctgagataagagcaagcaagtgcatgccgttaaataagatgtgacgtaaaggggcaataagatttactggaatattttttaaagcttttgcatcagaaatttgattaagaagtgttgttgtaagttttggattatgtgctgttgcctcagtaaatgtacgattaagggcaatggacagcccagataaaacaagcgttgttcccattgttcttagtagtgcattaaccgcggtcgctgcaccaatcaaatgcttagcaacactttcttgaaccgcaacttgcaaggtgatattgacaattccaaaggcagttccaagaattgctattgccacaaatagcatcacaattgaggcatgttcaggcaaactaaataagaaaattgcccctaaaaccataatagaaaatccaatatagattgttttcttttctcccactttttgaatgagatgattgacatttctagtgcctataaccagcatgattgctgatggaatcaaaaccattccaccgactaaagccgttgcgcccataactccttgtccccaagtgggcagatagtttgtgtaaaaaccaaagaaaccatattgcatgaaaaacatgatatttttagcaataaatgaagggtttttgaaaagttcaagtggaacaattgggtcaactgcccgtttttcagcaaaataaaatccgatgaaaaagagaaaacttacaactaataaagtaaggaggagaggaagattaatgactgcatttcccatcatttggaaaagcaacattattgcaatgacagcgatggataaagaagcagagccagcaaaatcaattgattttttagtatggtctgttttcaagtcgaaatttttccaaacaataaaagccatataaatcccaatgggaatgttgatgaaaaagacccaacgccagtcaagtaaagtgacaatcagccccccgacaattggtcctgcaatagttgaaaatgaataagcagcgacagtatttccaatcactcgtcttcgctcatcggcttgatacatcattccatagatgacaaaaggaagttgaatcatcacaccagcaccaagtcccatgagcgcgcgtgcgacaataaccattagcatattaatggctaatccttcgccgagagaacctattgtaaataagagtgtgccaagcacaaacatttgtttataaccaaagcgttcggctaatttggtccaaatgggagaagaaaccgccatgaggagcatataaatggttacaacccaactcattaatttaattccatgtaattccgccatcattgcaggtagagcggtcgctacgattgacccttctaaacctgccatcacattggagagcataaaggctcttatggaacgtttttcttgtattttattcaatttttactcttttctattttaaaataagattcaaaatgcggtggttgacactttgaaatcaacatgctatattatagcaagttagagttactctaagtcaagagaaaaaattgactttttattaattaataaaataaaaaagtaaaattgccataaaaaagtgatttttataagttcaaaggagaaaaaatggtcacgattgcgacagttgcagggagaacaggaatttcagcctacaatctacgattctatgaaaaagaaggattgatctcagttccacgcactaaagctggaattcgtgattttgacgaggcaacagaatcaagaattaatgccattcgccattatcgctgtgccggattgagtctagcacaaattaaagaagtttttgccaatacagataagcatgaaatgataattggagttttaaaagctcgtaaaaaggaaatggaaaaagaattagccgaacttgaaaaatcgatggcttatttggataaaaaaattaatattcatcaagaacgcttaaatgagaagacgacaaagctagtctagtttgacaaggtcttttccatttgatataataggaaagtcgtgtgaaagaccacgaactctcgagctggaaatggggtgaaaatctatgtcaaaaacacttgtacgcaaaaatgaatcacttgacgacgcactccgtcgcttcaaacgttcagtaacaaaagctggaactcttcaagagctccgcaaacgtgaacactacgaaaaaccttctgtaaaacgtaaacgtaaatcagaagcagcacgtaaacgtaaaaaatactaattagaatttttaatcactgacttctgtcagtgatttttttattcattagcttttactaacaaagctgtcagtaaattttgttaaaatagaggatagagggggataagatgactaagattaaacatattttttctgacctagacgggactttacttgatgaccaaggaaaaatttccaaaaagactcaagaagtgattgaaaactctaatcttccgttttctttggtttcagcaagagcacctcaagcgatggagaatctaattaatcaattgaatttaaaaagctcacaagttgcatttaatggtgggcttatttttgctaaaaaagaagtcattaaagcaaatccaatggttcatgctagcgctcaagaattgattaagacaatcaaaaaagattatcctgaaataaatctatccctgtacagtttaagcgattggtatgttgaaaagattgataaagacatcgaacaagaaatgcaatttactccacaggttcctaagttagtagatttggaaacattgataactgagcgaccaagactagaaatatttaaaattcttttgattacaccaaatgaaagtaagttagaagaaattaaaaaacatttagaaaagctaaattttcctgatataatcattcaaaaaacttgggaaacgtatcttgagattacacatcttgaagctcaaaaagctaaagcagtccaatttattgcccaaagagaacagttagaacaaagcgaacttgcagcatttggcgataatgaaaatgatttaagtatgttaaaagctgttgggttaccaattgtcatggcaaatgcttctgatgacttaaaaaaaataggaaaagtgattacgaaaagcaatacagaagacggtgtcgcttatggaattcaaaaatatattactgacagccctttttaaattcatttttaaaaataaaaaaatctgtcagtaaaaatcttttaaaagtaaccctttacaagctaaaagtaaaattctcaaagccaaattattcgaatttgtgatataattaacctatcgatttgaattgaatcagcatggtgctttttcaatctcaacaaaaatatcttataaggagaatttttccaaatggcaaaattgactgtaaaagacgttgaacttaaaggcaaaaaagtcctcgtacgtgttgactttaatgttccaattaaagatggcgtaatcacaaatgataaccgtatcactgctgcgcttccaacaattaaatacatccttgaacaaggtggacgtgcagtcctcttctctcacttgggacgtgttaaagaagaagctgacaaagctggtaaatcacttgcaccagtagctaaagctctttctgaaaaacttggtcaagatgttgttttcccaggaactactcgtggagcagaacttgaagcagcaatcaacgaacttaaagatggagaaatccttctcgttgaaaacactcgttttgaagacatcgacggtaaaaaagaatctaaaaacgacccagaacttggtaaatactgggcttcacttggtgacggaattttcgttaatgacgcatttggtacagctcaccgtgctcacgcatctaacgttggtatctcagcaaacgttgataaagccgttgctggtttccttcttgaaaacgaaattgcttatatccaagaagcagttgaagctccagaacgtccattcgtagcaatccttggtggttcaaaagtttcagataaaatcggtgttatcgaaaaccttctttcaaaagctgataaagttatcatcggtggtggaatggcttacacattcttgaaagctcaaggttacgaaatcggaacttcactcgttgaagatgacaaacttgatcttgctaaagaattgcttgaaaaagcagctgggaaattgattttgccacttgaccacaaagttgctaacgcatttgctggttacacagaagttaaagaaactgctgaccaaaatattcctgcaggcttcatgggacttgacgtagcaagcaaaacaattgctgactacaacacacaacttgaaggtgctaaaacagttgtttggaatggtccagttggtgtatttgaaaacccagacttccaagcaggtactgttggattgatggaagctatcgttaaacaaccaggtgttaaatcaatcatcggtggtggtgactcagcagcagcagcaatcaaccttggttatgcagataaattctcatggatttcaactggtggtggagcttcaatggaactcctcgaaggtaaagtacttccaggacttgcagctttgactgaaaaataatctaaaagctaataaataaaaagagtttgatttttgaaatcaagctctttttgtatctgtgctataatttggttatatgaaattctataattcaacaaatgaaattccagaggagatgttaaaagggattgatttgacttaccctcaattgacttatctaccagaaactggaattctctatgataatacatataatgaaaaagcagttccaattatttcaggtggaggaagtggtcatgaaccggcccatgtaggttacgttgggtctggaatgcttgctgcagctgtgactggtcctctatttataccaccaaagtctaaaaatattttaaaagctattcgccaagttaactcaggcaaaggcgtttttgtgattatcaaaaattttgaagctgacttaaaggaatttaatgaggcaataaaagaagcgagaaatgaaggaattgatgtaagatatattgtcagtcatgatgatatttcggtaaatgcttataattttcataaaagacatcgcggggttgctggaacaattttacttcataaaattctcggtgcttttgctaaagaaggcggaagtattgatgaaattgaacaattggctttgtcactctccccagaaatttatactttgggcgttgccttagcacccgttcattttcctcatcaaaagacttcatttgttctagctgaagatgaagtttcttttggaattggaatacacggagaacccggttatcgtgttgaaaaatttgaaggctcagagcgtattgccgtagagttagtaaataagttaaaagcagaaattaactggcaaaaaaaagcaaataaaaattatattttgcttgtaaatggtttgggttcaacaacattaatggaactttacagttttcaatatgatgtgatgcgccttttagaacttgaaggcttatctattaagttttgcaaagttggaaacctaatgacaagttgtgatatgtcaggaatttcattaacgctttgttctgttaaagatcctaaatggttggactatctgaatgctccaacgggagcttttgcatggtaatcagctttcaaaaattttaatttgagcaagtaaaagatttacaatctgagaataaagcttttctaaagaatttcctctaatgattgattctttagttattgcacaaattgctgcagcattataacgacatataaatgatttttctaagtctgaccaatgatagtcagactttttttcttggtcaaaaataaccttatcaagtaagttttcccattgaataaggaaaaagtgttcaaaatttttatctataacaaatattttttgataaaaaatttgattttcatctaagtagcgtaataagagtaagagttcattttgccagccataataatccagattatcattaattaattcggcaaaatcattctcaaaaatccaagataaaagctcttcttggttctgaaaataattataaaaagtttgccttctaatttttgcggtttgcataatatcactgacagaaatctggtgataagcattactttgcatcaggtctttaaaagctttagcaataattttttgtgtaatgattgattttttcatattttaaaagaaagcggacacattttgtgatttgtcccttatttttatggactttatattttatactaagtataacataagaaactcaggaggatgagcgatgaaaaagattattaatcaaccacaagatgtggtctcagaaatgttagacggattaacctatgcttacggggatttgattgaaaaagttccagattttgaaattattcaacgtaaaagtcctaaaagtggaaaagttgccttagtatcaggcgggggttctggacacgaaccggctcatgctggctttgtcggggaaggaatgctgtcagcagctgtttgtggagctattttcacatcaccaacgcctgatcaaatttatgaggcaatcaaatctgctgacgaaggagctggagtactcttaattatcaaaaattattcaggcgatgtgatgaattttgaaatggcacgagaaatggctgagatggaagagattaaggttgagcaaattattgttgacgatgatatcgccgttgaaaattcgctctatactcaaggaagacgaggagttgctggaacagtccttgttcataaaatattaggcgcagctgcccatcaaggagcttctttagatgaaatcaaagatttggctgataaggtcgtcaagaatatcaagactattggcttagctttgtcagccgcaacagttccagaagttggaaaacctggttttgttcttgatgataatgaaattgaatatggcgtaggaattcatagtgaaccaggataccgtcgggaaaaaatgaaaacttcttatgagttagcaacagaactggttggaaagttgaaagaagaattcaaatttgaagctggtcaaaaatatggaattcttgtaaatggtatgggagcgacgtcactaatggagcaattcatttttatgaatgatgttgcaaaattactgacagaagaaaatattgaaattctttttaaaaaagttggaaattatatgacttcaattgatatggcaggcttgtcacttacaatgattaagttggaagatgaccaatggctcaaaaatcttaatgaagacgtgaaaactatttcttggggataaggagagagaatgttaacaatagatacaaccattgaatggttaggaaaattcaacgaaaaaatacaagaaaataaagcttatctaagcgaactagacggacctattggtgacggggatcatggtgcaaatatggctcgtgggatgtctgaaacaatgaaagcattggaagtttcaaactttggaaatgtctcagaaatctttaaaaaagtggccatgaccctaatgtcaaaagtaggaggagcttctggtcctttgtatggttcagcctttctagccatgagtaagactgccacagaaactttagatacaagtgaattaatttatgctggactagaagctattcaaaaaagaggaaaagctcaagtcggtgaaaaaacgatggttgatatctggtcagcatttttaaatgacttacaaactgattcagcttccaaagataatttagaaaaagttgttaaagcaagtgcaggacttttagctacaaaaggaagagcttcttatcttggggaacgctcaattgggcacattgaccctggaacacaatcaagtgcttatttatttgaaacacttttggaggtagtagcatgacttatggaattgtaatcgtttctcattcccctgagattgcctcaggactaaaaaaattaattcgtgaagttgctaaaaatatttcgctaaccgctataggtggtttagaaaatggcgaaataggcacctcatttgaccgagttatgaatgctattgaagaaaatgaggcagacaatctcttaacattttttgatttaggaagtgctcgaatgaatttggatttggtttctgaaatgacagacaaagaattaaccatttttaatgtcccgctcattgagggagcttacacagcgagtgctctcttagaagcaggagcaacttttgaagcaataaaagagcagttagaaaaaatgatgatagaaaaataaggtaaagcaatgacattacaaatattgggagaatttctgggcactttcatccttgtattattaggaaatggggttgtcgcagcaaatgttttaggtaaaacaaaatcggaaaatgcaggttgggtgactattgcaattggttggggcttagccgttgctgtcgctgtctgggcagttggcttcttttcacccgcttatctcaatccagccttggtcattggttttcttgtcttagggaaaataaagattggcttagcatttgcttttattgtagccgaatttttaggtgctatgttaggtgctgtcgccgtttggttacattattatcctcattgggaagaaacaaaagattcttctctaatcttggcaagttttgccacagcacccgctattcgtcattcttggtccaattttttaggggaagcttttgatggggcgctactcatgatactgattatggcaatgggccattatcgtctggaaggtggttttggtccaattattgtcggttttcttattatggcagttggtttttctttaggaccaacaactggctacgcgatgaatccagcacgtgacctaggtccgagaataatgcacgcacttttaccaatcaaaaataaaggaacttccgactggagctatgcttggattccagcaactggttcaattgttggtgctgtaattgctggactactctatcaatggatgttgacgcttcattgatagtatctaaaaaaatacggataaccatccgtattttttaatcattaaaatcaaagcgaagtttcatgtgattggaaccagaaataaccattttaccaagaagttcagtttgagcagtcagagcaatctgtgcaagtttttcgttcactgcttcaagtgattggtcacttcctttgtcggtttcgttttgtaaggcccttaattttgccattgtgttgaggtcaaaattgtctcttttatcgacatagccttggaaattactgtctcctagaacagcggtcattgtagtcaaccaatacattttggttgggtcaaagtcggcttttgtatcgcgataacaagtaggggtatcacttactctagcataaaatggaacaaggctattgaaactgttaggtccaaaagcaagccaatgaatgccagcaagctccttgtctacattatctcgaatttgtaaaacatggagttccaaattacgattgagtccaattggtcgaatcaatttttgttctgcggcgcttgatgttgtgctgtatgggtcataagctgtattttcataatgacttgacatgacaaacttaatttcttcaatggaaattttgcgattggcatggcagatgaaaggtaaatcttggttaaatggattgtcatttcctgtggtttctggagaaaaatagttttgcacataccaagcgcgtggattgttgtagcgcgtgtctttaatggtacttgaaccaaaaatatgacgaaggttataaccatcaaagtctggattaagcttgttcttatcaataaattctttcaaaccagttgaataaatcgtgtcagaactttcaaaatcataccaatcgatattaagacgattaggagcaataacataagcgtcgtcggggatacgaatagctgcccattgatgtccacctagtgtttctaaccaccaaatttcatctttatcagaaaaagccatcccgtttgattcataagttccatatttttctaagagttgtcccatccgttcaacaccctcacgcgcactctggatatagggaagggtaattgttgtgaagtcttcttcacccagtcctgtttcaacataagggtccaatcccaaaatacgactatttgtcgttgaggtttctgtcgcagtcatggcaacattcgcactattgatgccagccgctgcccaaatcccataggttgaatccgcgtcaggtgtagaagtataggataggggattttctggtaagtcaaattcacaagctgtggcgacagagcgatagtgcttgggttgattttcaggattgatgacaacaaaacgttggggattaggtttatctccaccatcttcgtttcgtgcaattaaagttgtaccatctaatgaggattttttaccgacgagaaatgttgtacaggccatatgaactcctttataaagatataaatgatttgtgctaagtttctcaaaacttaaagttcttatcattatactacaaaataacttttatatgcagtttctaaagggtaaaatgatttgaggttcaaaaatgaagtgttacaattagtttaacatcaaatctaaagaaagtttatgccatcaaaggagaagaatatgacctcaccaataactattaatgatattagtgtgaaatttggcgataaagcaatattagaccatttatcctatgaatttgaaagtggaaaaattatttgtttgattggaccttctggagctgggaagtcaacctttatcaaggccattgttggaatgcaaaaattggattctggcaatgttgagattcttgaaagaaaaattcctgacagagaagtattagggaaattaggctatatggcgcaagaagacgctttatttaaggaattgaccggcaaacaaaatttagaattttttggttctttgcagggaatcaaaaaaaaggatttacaaggcaaacttgataaggcagctgctacagtaaatctgactaagcagttaaatcaatcaatttctaattattcaggaggaatgcaaaggcgcttatcactcgctattgctctgcaaacggatgctcctattttacttttagatgaaccaactgttgggattgatccagaattgcgtcaagaaatttgggaagagctgcgaaatcaagcaaatcaagggaaaacaatattaattacgacacatgttatggatgaagctgaacgttgtgatgtcgtactgatgcttagaaatggtaaatttatagcagaaggttcgccaaaggaaattaaggaaaagtatcaagttgcctcggttgaggaagcctttattgttgcgggaaaaaatttagagttacaaaataagggggcagcgaaatgagaacacttgctatctttaaacgaattatgcttcaacggcgtggtgaccctaggacgctggcaatgatatttttagctccaatatttattttgacgctcatgtactttctctttcaagtaccgccaaataatgcttacagagtgggtttgaagtctgataatacagaattaacaagagctttgaaggatatgccaaatgataaagcacatctgaaagtgattagtgtttctgaaaataatcgctcaacaatgaatgagaaagatttgagtgcaattgttagtatttcgggaaaaaatattgatgttagttatgctaatcagtcaaatggaacaagttctgcgattaagctacttttaacacaagtcattcaagaaagccaagttaaggcaactaaagaggagactaagcaggctctgcaaaatttgataagtaagttacctcaaacatcaggtcaaagtttttcaacaaatttcagggttgatacagagcagtataaagtaacgagtcactatttgtacggagatcctagtagtacaaatgctacttttgatgatttagcaccgattttagttggagcctttgctttcttcttggtgcttctaatttcaggtatttcattagtgaacgagcgaacctcagggacgctggggagaatgttagtcactcctgtgaaacgaactgaaatcgtgacgggctatactttgagttatggaattcttgcaatgattcaaacagcactcatggttgtttttacttattggattttaggggttcatcataacggaaatattggttgggtctttgtcattaatttctttatcaccatcatcgctttattgtttggattacttttatccacattagcaaaaacagaatttcaatttgtacagatgattcctttagcgattgttccccaatttttattttctggtttgattcctgtggatacgatgcctgtcattcttcaagcgatcgcacattgtattccggtttattatggaatttctgccatgcaagaggtagttaaaagaggagtaggattctctggaatctggtttgatttgctcattatgctactttttgcggctctgctctatcttgcgaatgttttagctttgaaaaatgttcgtcggacttaaaaatatgcttttgattgtataactactggatagtctatctggtggttattttggtttttaaaagaaaaagaaagtactttttgttataataatggagtagagtttatgaacggtagctttgattggaggtggtgcttatgattatttcgtgggcaaaacctcacaaaaaatgaaatgcgaaaattttttgactgtatttcaggcattgagtctcatgattgcatttgcgaccttgatgattcttgtcattaatacaagtaataaaaaatgaccgttctacttagcaggtaatcggtcatttttgattgaagtattgctaccgttcttaacacggctacattgggacttgtttcgagcaagtccttttctttaatttcattatatcatgaaaaagtaaaatctgtcaaaccacttactaattagaagttaaatcatataaacacatataatgaaattttcaatgtaaggagcattaatggatgtgaacaaattacaaacttggctttggcctagtatcacggggatagctattataggttcttttatacttatttatactgctaataaaaaacttagagaagaaacagttcgtgataatattctgatatctaaagtattgttgcaattaatatatgcttccatttcacttgctattggtatctactgcctaaatcatgcaatgaaattaggatttgaacaaaatttaacagcctatatagccattattggtggtattcctactatttatctttggattataagagaacgaaaaaaagaacaggaccttaaaaataaggatattgaattaaataataagaaaattgagctgaatcaaatcaaaatagcagaattaaataaaatatatgttgatgcaataaaccaattttattccaaagaacagtttctggctggggcatacgctttaagtggattaattgaagactggatgcaattggaaacattctcatcttctgatttcattaataatactacaaaaatagagcaaattagttccataattttttctaaattccaatcaaaaaaacacaacatactgttctctagacttgtttcaagaatagttcaaaaactaatttatttttctttaaaaagaaataattgggatgaaagaatggagataccctggcaacagtataatttatcaggtattgacctttcaaatatgaatttatctaattatacattttctaaggtcaggtttaataatgccaaatttgaaaattctatactaaaaaatgtaggatttgttgattcaaatattaccaatgcaaattttaaaaatactagattagaaaatgcagaatttagaaacacttcagcgcaaaatatggattttagaaattctaatctaagtggtgcaaaaatattaaaatcaaatttttcagcatccaatttttatagttctcatttggaaaatataacaattaataattcttcattgaatgatactaatttaaatggctgcaatttaaaaaacgcaacgattaataattcttcaattcagaaatctgaattaaatcgtgtggtcctatgttatgctaatatcctacattctaatttatataattcaaaatttaatcatgcaaagatgtcagaaattgttattgaccaaacaattatgggtgcagcagtcttaataggagcaaatttaaagggtgcgattatgactaatacaagtctaaacacagcaaattttgaaaatgcaaacttagaaaatactaatttgaacaactctgtcataaactttgtaaaattttccaatgccaatcttaccaacgctagtataaaggattctgatacttttaaaacaactctttttttgaaaagtctaaaacttatagaggtcaatttaatacaattaaaagatatgtatatattaaataataataatactagattaattattaatagaaaaatagaaaaaagattaaaacaagaaaagcagttatctagtaataatgatacgttcaaattaacggaactagatatccatattttagaaaattctcaataactaaaaatagttattatatttcctttttgaaagagttcagttttaaaagtgaactttttttattttctatatacattatatctctgtctatatcttctaaacgttctacgattaattcctgtttgttcttctacttctttgtcggtataaccttttaaatataaatcaaaagctaaatttaaacgtgggtcattttcatgaaattttcttttaccgcctttaaatttacctttgtttttagcaatttttatgccttgttgctgacgttcttttattttttttcgctcagcttcagcttgatatttataaagttcaatcactaaattatttattaaccgtcttaaattttcatcatcaataccattcatcgagggcaaatttagaacttctaatgttgctcctttttgttgtatctcattcatgatagtagtaaggtcgttattatttcttcctaaacggtctaattctgtcaccacgacaatatcgccctctcggatatactctaacattgcttttaattgtggtcgttcggtagattgtccgcttattttatctgaaaagaccttagaaacagaatccaaggcttctaattgtctatcaaggttttgttccttgctacttacacgtgcatatccaattttactcataactcttttccaattcaagtacaaccgcatacaatttatcaagttttctttttataattttttcttcttcatcaagttctctacctgattctatattttttttataaaactcatgtgtttctttaatttgggttacaataaacccataaggtacactcattttttattacctcctaatagctattatccataaaaatatctttctttgttgctcaacttagttgaccgcttataaaagctattatatcacaatttttaatacggacaactccctataccctgttgtcctaactatgctagcaatacattttagctgcgaacttcctagggcgtttttttactttatgtatgctttaatagaattttcaaagtttatcataattttgaacagaaaaggatttaattaaaatttttttgagacagtctctttagttaaggctctgaatatactacaagattagttttttaacttaatgtgatgaaaaaaatttataagaaaaataccttaaaaatttttttgtctatctattcgatattttaatacgttcgttatttactaacattaagactggaaaaattggaaatacatgttctgtaaagctttatttcgtaattttatatactataagattataaatgttcggccgttcattttaactacttacaatttattttgtaacagaaaaattaaggaaaattatgtatttcgataatgccgctatatcttacccaaaaccaaattcagttttaaagggaatttcccaatttttagaaacggaatccggttcttctaatcgttcaagcaacacagaaacaaacgatattatatatgaaacaagaagtaaggtcgctaatttgtttaatgtgaagtttccaacaagtattattttcacacaaaattctactgaagcgttgaatttaataataaaaggaatattgcgcaaaggtgaccacgttatttctacagcaattgaacataattctgtcattcgtccattaatagagctggctaaaaataaaattatagagcttgaatttgttgattgtgaccaatatggcttcattaatcaacaaaaagtccttgataagatttcagacaacactaaattggttgtaatcaatcacggctcaaatattactggttcagttcaaaacatcgatcaaatttctaaaaaaattggcgaactagaaaagacattcttgcttcttgatgtatcgcaaactgctggacacattactattaataatgaggagctaaatgctgattttctagcttttacaggacataaaggtttgttgggaattcaaggaattggtggagcttatattaatcctgatattccactaaaaccgcttatggttggtggaactggtgttctctcagagctattagttcaaccatctggtactcctcttcattatgaagctggaacaccaaacggaccaggaattgcttcgctattctattctattgactatttaaataagcataagattagtaaaatatcagaagaattatttgacatgacctcttatttcataaataggctctctaaatttaaagagttaacgatttatagtaagccaaatgctctaggaattgtttcttttaatattactggtattgtaccagctagggtttctcattttttattggcagagtttgatattgttactcgttcaggattaatgtgcgcaccttttattcatgaatttataaaaagcggacctttcggttgtgtaagaatcagtttatcggataatacccaaaaaagtgaattaaaccatttaattgacgcaatcatatcaatcgttaaagatagtgaacaatctagaaatgtaaacattcctaaagtttacgaattaccaagcattaataattggagtgaagaattatgaataagataataaatgactattgcacgttttgtgaaagaagagagaatgtaccaaatcaattatttgcggaatcagataatttttttgctttttttaccttaggacatatggtggaaggatataccctcattgtgtcaaaagaacattatcattgtatgggtgctctaccgcaaagcttacaagctgaatatttagagtttactaaatatatcactggtattttagaaaaaaaatatggtagaaccatttcatatgaacatggaagggtaggcttatgtaatgttcagcccggagagcaaatttgttaccatgctcacacccacatagttccagttgcaatggatttaattcctgattttaagaaagatggactaatcccatatgagatagagcaaaatagctctctattcaaacaatataaaaattttggacactatctatactatagaaatatagataaaaaggagtatattatccaaattaatcaacctattaggcgacaatacctgagatatttagtagccaaaaatttaggaaatgaagaacttgcaaaatggtcagagtatccagagtatgaaaagctaaattcagctataaaaaatattagtaatttaatcacagaaaaaaaggttgtcaactaaatgttagtatcaagtctcgcgattatagtgatggcaattttttcagcattgtcacgaggagtcattagcgtcatagatagatatcaaataggtattaaaggaaattctgttgtcgaagtaaacttatacaataatttattcactttactttttgttattggattaacgttttattttccaatttggaatcttattaccgattggaaagttattttatacagtgttttagttcaagctgtagcaattggatattctaccttattcaaaaaaatgactatatttgaatcagtgatttcagctaaattagctgacttattaatccctatagccgtttatttatccactggaaaattagatttaaaaatatactttttagccgtatttactaccttaattgttgtgttttggttaaagaaaaaaggagatgcaaaaaaatacctagatggagttatcatcattgttcctctactaactattcaagcatttgcttcccctttgttagtcggaaataacaaaaatcaattaagttctattatagcttttacacttagtacactagtaattcgattcattatttcagcattaatgatgctattttaccaaaaatcttttcagttaaaaaactctttaaattcaaataatcttttcatttatataattcgttcaattttaacaataattgctcagttcacttttgtaatcgtgacctcagataaatattctgcattagggtggatatttttaaatatgacctcattatatggtgttttagcttccagtttatttttgaaagagaagaatacaaagaaagaaatcttattaatttgtttcattacagctataatgttaattcaaaactttatttagagacaaaacttaacaaatagtttaacttttcttatacatttgactaataataaaaaaagacaaactatattaaaagtcaagtaaaaactgatttttaatatagtttgtctttttagttctattttatcattaatacaagaaaataaacccttttatataatgtttagatgaaatatttttttttgctataattaaagcatgaaaaaaattacagtacggacaaaagcagcaaagaaattgcgggctggttatccacttttggtggcagaagatttaaattcacccttcttggaggatgattttgcacaattttttgatgaaaaagggcaagcgcttggaacaggttatctttcaaaacaaaataaaggagtgggttggcttttagattcttcgtcagtaaaaattgaccatcatttttatgtggaaaaatttgtcaatgcacgcgctttacgggcgaacttctatcaggatgcattaacgaacgcctttcgtctttttaatggtgaaggagatggattaggcggcttaaccattgatttttataatggttttgcagtcttttcttggtataatccatttatatatagtcaaaaaaaagcgattgttaaggcttttcaagtcgtgttcccagatattaaaggggcttatgaaaaacttcgtttttctgaggctgctttagaaagtcaacatatttttggtcaagaagcggctgaacctttgttggtcatggaaaatggcgtgacttatgcgacttatctaaatgaagggttaatgacaggaatttttcttgaccaaaaaaatgttcgcggggcacttgcgggcggtctttcaactggtaaaactttactaaatatgtttagttatacaggcgctttttcagttgcagcagcttttggagggagcagtcaaacaacgtcagtcgatttggcgaaacgttcgcttgataaaacgagagaacaatttttggtcaatggaattgaaccagagagtcaaaaaatctatgtgatggatgtttttggttattttaattatgctaagaaaaaagaattgacttatgacatgattgtcctcgaccctccttcatttgccagaaatggtaaaaaaacattctcagtagctaaaaattatggcgagcttgttaaagaagctgttgaaattttagaaaataatgggacattaattgcatcaacaaatgcagcaaatgtttctgataaaaaattccgtcaaatgattgaagaagcgctcaaaaataagggagtaaaatttaccgttttccaagaagaaaaattaccagctgattttcatattgctgacagctttccagaaggaaattatcttaaagtattatttattaaaatcaaaaaataatctgtctattactgacagaaataatgattaattacaaatgtgagcgctttactatctgctttctatatgataaaatgcaagaataagtctaataattcccgacttttttagatagaaagcagagtgtgaatgagggatcgaaacctcatttacttttattatggataaaaaatattatcaattactaaaaaaacagttttcgtcaaaggaagcagtactgacagaaattattaatttgagtgctatttgtgaactaccaaaagcaacagagcattttatgagtgatgtgcatggtgaatatgatgcttttaatcatgttttgagaaatggttctggcagtatcaaagaaaaacttagagattgttttccagaattttctgcgacagaaatatcatcacttgcaaccttgatttattatccacaagaaaaactagattctgagtgtcaactaaaagagacagaagaatttgagaactattgtcgaatcaatttagtttatcttttaaagactgtaaaatttgtcggtcaaaaatatactcgatcaaaagtccgaaaagcttttccagaaaaatttcgatatatcttagaagagttaatcaatgaagttgattcgacgactgataaaagagattattttgattcaatcctttcgcaattgcaaaatttgggtgaatttactcgcttaattgttgcacttgcagatacgattcgcagattgacggttgaccaccttcatgtggtgggagatatttatgatcgaggaccttatccagataaaatcattgaccgcttaataaaaatgccctcagttgatgttcaatggggaaatcatgatattgtatggatggcagcttttagtggttcacctttagccatgatgaatgtaattagaatctgtgcccgctatggaaatctcgatattcttgaagaatcttatgggattaatttacggatgattttagagtatgctgaacgttattatgagccaagtgaggcttttcaaccacgtttggtcgaaggggttcgtttgtcagatgatgaaaaggcactccttaataaattacaagaagccacagccattttacaatttaagttagagagtcagttgataaaacgccgacctgattttcaacttgaacatcgtgatgtccttcatttcattgatttttccgaaaaaacaataaaattgggaactgaagtttatgaattaactgattttcaagcgcccacagtaaatcctgagcagcctgaaagtttgactgctgaagaagaaaaaataatcagccatttattaaataattttagaagttctgataaacttaaacgtcatgttgaatttttacaagaaaagggagccatgtatctttcttacaatggaaacttgttgattcatggctgtcttcccttacatgaaaatggtgattttaaatcatttacggttaacaaagaggctcatgctggccgtgatttacttgatttctttgaccaagaggttagaaaatgtcttgctcatccagaaaactcgacggatttagcaacagatttgatgtggtatctttgggtgggagaatgctcttcattatttggtaaaacggcaatgacaacctttgaacgctattatatcaaggataagaacacgcatgtggaaaagaaaaatccttattatcaattgcgtgaggaagctgaaattatcaggaaaattttggaaaactttggtttagatgaagagggacatttggtgaatgggcacacccctatcaaagaaaaaaatggtgaaaatccaatcaaagcagatggaaagttgattgtgatagatggtggttttgcaaaagcttatcaaaaggaaacaggaattgctggatatactcttctttataatagttttggcattcaactggttgctcatcaacctttttcaaccgttaaagaagcagttgaaaaagggacggatattattagcctgaaacgcttggtagccgaagttgaccaaagaaaacgagtcaaggatacaaatgttggccaaactttgttaagtgaaatagcagatttagaagtgctttttgaacattatgaggaattttaaaagtaccagtgttggtacttttatttgttttccaaaaaagacaataaaaaaactcagccttagccgagttaatattagtgcggtgggcgggacttgaacccgcaccaagaaaattcccgacaggatccttaatcctgcgcgtctgccaattccgccaccaccgcaaaacagtactttaatatagtaccatttctataaagaatgtgcaagcctgagctagggctgacttattgttggaaataagatgcgatttgggcagcatgttttccagcaacaaaacctgtcacaaaggcacaggtaatattataaccgccagtgtatccattaatatctaaaagttcaccggtcatgaataaaccttgggtttgtttactttccatacttttaggatttatttctttgagagaaacaccgccacctgttacaaaagatttctcaattggtaaagttttgctaattgtgatttgccaatttttgaaaagactagcgattttatcaatttgctgctcagatagcgtcttggcagaaagactagggtcaattccagctttttcaaggataaatagaagcatacgttcttgggtcaatcctgagaaggcatttttaattgatttatctgttttagaaaggctagtcagttcatttttcaaagagcccaactttttttcggggaattggtctaagctgactgtgaccattttttcacctttagcaagaagttggttaatgaaacttgaacaacgcagagcagctggaccagaaattccgaaatgcgtaaataataaatcatgctgatgagagattatcgcttttcccttagaattgagtactgagagttttatttcgcgtagggaaatgccttgaagacttttgtctaaaatgaatggttcgtcagaaatcagggcagattcagtggcatagagttgtgaaatactatgccctgctgagcgtgctaaacgatagccatcaccagttgaacctgtggaaggataagcgcgtccgcctgttgagaggataattgtagggcttaaaaagctctcgctatccgtttcaagaccaattactgctccgttttcaatgaggagcttatcaactgcttggcttggaaaataagaaacatggaggctcaaaattttattgaagagggcatcaacaattgtttttgatttgtgggttatagggaacatgcgcccgtggtcttcttcttttaatttaataccattgctttcaaaaaattcgatgatatcaaggttagaaaattgagaaaaggctgaatgaagaaaacgaccatttccaggaacatttgttaatatttcgtcaacagagcgggcatttgtcacattacagcgtccgccacctgtcattaataatttttttccgacttttttatttttatcaataagagcaacttttgctccgttttgcgcggctgagatggcagccatcattccagaagggcctgcgccaacaacaataacgtcaaatgttttagctgattttgtcatgctttaattttaacatgatgtgagcagaaataggggaaagagtattgaaaaatagtaaatttaaattcagcgagcgataaggctttaaaatattgatatttgatattggaaatcgatatgaaatgcggtaaaatagcattatgattgaactgactgatgaaattttagcaaaagtaattaaaaaacgtaaaaaagcttcttacaaaggaacttatggtcgcttattagtgattggcggtaatcgtcaatatggtggtgcggctattttggcgacgacaagtgcagtttattcaggtgctggcttagtttctgtggcactggctaaagaaaatcatagtgctttacaggcaagacttccagaagcaatgactttagattttgatgatttgataaagctaagagaagtagcaaaagttgctgatgttattgttattggtccaggattgggcttagaaagactagatttactgacagaaattttgaatttactgacagaaaatcaaaagttagtcattgatggttcggcactgaccctttttgctagagagcatttagacttaccatttcctgaaaatacggtgtttacacctcatgaaatggaattggaacgactttctggtttgaaaattggtcaacaaaccaaagaagaagttcaagattttgttaatcaactcggagcaattgttgttgctaaatcttcagaaacacgaatttttgcgccaaatcaggagtcatttatcttgaaaataggaagtccagctcaggcaacagggggaatgggggacactttagccgggatggttggtggctttttagctcagtttcatggagaaacagaggaagtagttgctgctgcaacttatttgcatagtttaattgcaagcgtcttagctcagaaatcatatgtggtcttgccaagtcgattgattgaagaaattccattatttatgaaaaaatatgaatgctgattaattctgtcagttcaatgcgacaaggggagtattgaagttgggaataaaaaaattactgacgaaaatttcagtcctccgtcagcatttttttcttagaatttttgttataattaatcatcaaaataaatgaagatgaggtcaaaagatgaatgcaattgaacttgtgcaaggcgccatgaaaaaagcagagaaaattcgtccaaaagtaggtggttttccatacttggctgaatgtatgcgagaagctggagttttaaaaaatgtttggacccttcctgccggacaaagcacgttttggacaagcgctggcgtaattagcgtgaccaattcaccaatggtgagtggttttcatgaggtgccagtttttgaccaagaagctttgattaaggccttgcgggctgaccaagctggacaaacgacttttccggaatttttgagtgccacttgggaagctggtgtgatttcttatgaagctgatttttcagaaagaaaagtcacttatctaggaagtcaaggagaaagctatgttgaggcctatccagcggtcgaaattcattaaaaagttactgacagaatgattaaaatatttggtaaaattatttactaaattaatcattctgtcagtaacttttctgttaatttctgataaaagtgctataatatttgaatgaaaactaataagtataaagaaaaactactaagagtagtttctggagaaaaggggaaattatgctaacgattggaaggcgatatttaaatttttggcctgtattttgggcactttttttgttagttattcaagttgtgactaatctttggcttccaacgattacagcggatattatcaataaaggcattggtcaatctgatatgaaatatatctggtttatgggtctaatcatgctttttgtttccctggccagttggctttcggcaattggaaatgtttattttgcttccaaacaatctcaaggattgggcctgaaattacgccatgatttatttaagaaagttttatttatggacgagcgcaattttcaggaatttggtgatgcaactttaattacacgtacaacaaatgatgtgactcaattgcaaaatgtctttcaaacgatgttacgaatgatgctcatggcgccaatgatgctcattggttctattttcatggcttggaaattatcgcatgatttactgctggtttttttgattgccttgcctattttaactttggctgtcgttattaatattgctatttccatgccacgttttcggtcaatgcaaacaaaagttgataaaattaatatgatttttcaacaaggattgactggtgttcgggtgattcgtgcttttagacgagatcaatatgaaattgataaatttgatgatgctaaccgtgatttgacacataccagtcaagtggttttgacgacgattgcgatgttaatgccaattatgacagttattcttagttttacaaatattggaattgtttggtttggtgctcatcttatcagtaaaaatatgatggaaatgggttcattagttgcctttttgacctatgccacacagattttgatgtcatttatgcaattatcagcagttgctgtcatggtgccacgagctcaggtttcagctgttcgagttcgagaaattttagaatctaaagataaaattactgatgaaaattcgagcatatccgtagaggcgctaaagcgccaacggctatcctctgacggaaatgacaagttgtctgaaagcaattctgtccgcaattctctagctcttaatcatgtatctttcaaatttgatgaagcaaaaagacaagcgctaagtgacttgtcagtaaatgtagcagctggtcagaccttagcaattattggggggactggttctggtaaatcaacgattttgaatttgattgccagattaattgacccgacaaatggaagtgtcacaattgatggtactgatattcgccaaatttcacagtatgacttgcatgaaaaagtttcttttacgcaacaaaaagctcaacttttttcgggaactgtccgctcgaatcttaaatttgggaaaagtgatgcaacagatgaagaaatgtggcaagctttggaaattgcacaagctgctgatttcgttcgtgaacaaggtggacttgagctggcggtcgaacaaaatggcgcaaatttctctggtggtcaaaaacaaagaatttcgattgctagaaccttgattaaagaggcagaaatttatctatttgacgattcattttcggccttggactttgctactgacagacaattacgaacagctattaatcattcggaaaaacataaaaataaaatcaaggtgattgtggctcaaagaatcgcaaccgttatgtcagctgaccaaatcttagttttagaaaatggaattgccgtaggaattggtactcatgaaagtttggcaaaatcctgtccgcaatatcaagaaacaatgcaatctcaactctcggatgatgatttggttaagatgggtgtttcaattgcacatttgaccgccagaggaggtgatgaccaatgatgagaggaaattatctcaatcgaggtggcaaaggggctgaccgttttcaaaaaggtcggcgagctcaaaatttctttccaacgattattcgacttttcaaatatatgcgcagagatttatggggacttcttttttcaattttaattgcttcgctgtcagtcattttgtcggttcaggcacccaaaattttgggaaatgcaaccacagtgatatttgatggcgtaacaaaaagtctaaaaaaccataccgcaattcaaattgacatgactaaggtcgaatctattttgctttatgtcatggtcatttatctgatttcatttatctctgggattttgcaacaaagcattatgacacgcatttcgcaacgaacagtttatactttacgtcgtgaatttaaaaacaaaatgaaaaaattgccagtttcatattatgatagccatagtaatggggatatcatgagtcgaatgataaatgatatggataatatttcagggactttaaatcaaactttgattcagcttatcacaagtctcttgcaatttgttggaactatttatttcatgttgaccatttcttggcagttggcactcgtcgcctttatcacagttcctttggcaatgattacggtaaggattgttgcacctttatcgcaaaaattctttgctgaacaacaaaaaaatctgggattattgaatgaccaaattgaagaaaattatgcagggcatgcggtcattaaaacattcaatcatgaagcctcagctgaaaaagaattcgcaaaaagaaatgataatttttataaatcagcttggaaagctcaatttgtatcgactttgatttatccaaccatgcgatttatcaataatttagattacttagccatggccgtaattggtggtcttaaggttatttcagggacggttaatctcggagatgttcaagccatgttgcaatataccaatcaatttgcacagccaatcacaaatatctcgaatatgctcaacaccattcaggctacagttgcgtcagccgaacgaatttttgaagtattagatgaaaaagaaatgactgacggaattcctgtcagtgaaaaagttgctgacgaaagttcaaaaaaagctgtcagtaatttaggagcgactgacaagactgatttcatcaattttgaccaagttgcattttcttataatgaaaatcaatccttaatgacagatgttaatttttccgttgaagttgggcaaatgattgccattgtgggaccaactggagcaggtaaaacaacaatgattaacttgctcgaacgattttacgatgtcacttcgggaaaaattttacttgaaggaaaagacattcgcgaaattgaccgtgaacaattacgtggacgaatggcaatggttttacaagaaacctggttgttctcagggacaattatggataatttacagtatggtcgtcttgaagcaacacaagaagaagtgattcaagcagctaaaatggcacatgctgatgaatttatcaccactttacctcaaggttaccaaactcttttgaatgaagccgcaagcaatatttctcaggggcaaaggcagttattaaccatcgcccgtgcctttttagcaaatccagaaatattgattttggatgaagccacgtccagtgtagatacaagaacggagcgcctgattcaatcagcgatgaatcgtctattaaaaggacggacaagctttgtcgttgctcaccgtttatcaactattcgtgatgccaatcagattttggttatggaaaatggaaatattgtggaaatggggaaccatgaaagtctccttaaagaaaatggattatatgctagcctttataattcacaatttgcaaaataagatatcaaaaaatcagtctctttttgattgatttttttgtttattaagcgtctattttgttataatgagttaaaaataggcgagaaggagcgataatgtttaaacaatcagataagaaaataaaagaaaatgatcaagaaagcaatgcagcttttgaggagttttttaatcaagtgctcaaaaaaatgcctgctcgttccgcaaaaataatcagttcttctttaactgtttcaaaagcgaaagcagagcagtttttagctagcaattctcagaaatttgaccacctctttgatgaatttttggttggagtggacagtcaaacgcgaaggaaatgccatgaaaccattcatttcgctaccttgacggcggcaattgttggcttttcaccaattcccttttcagatgccgtcttgcttgttccgattcaattgacaatgatgatgcgactttataagatatttggggcttcttggtcagaagcattggcaaaaggaatcactaaggaattagttgttgttggtttaggtcgaagccttgtagggaatgttttaaaatttgttcctgcggtgggaacaattgcaggtggagcaattaatgccacagtggcgacaacaattacagaagccttaggctgggtaactgtcaaaatgcttaatgatggcgaagatattttcaataatgtcctgacttttgaaggtcaattcaaaggtttggtcagtaaattacaaaaagccaataagaaaaaataggctgtcagtaaaaaaagacttatcagttgataagtctttttattattatttagaaaaaccattttccaaagttttaatgacagccaaaatttgttcatcggaaaccaacttgtcagctccattaataattgattcataagctgaatcataaactctaccataatcaccagcaaccgttggaatatgtttcacaatacggtcaccattttgattgaaataggtaagttgcccaaaatcagctggactgtcttgcccaaaaccttcatcacctgggaacatgccaacttttaaatcattttcttgttggtcaacatccattttgatgaaagttcctctcgtaccataaacaagccattttggatgtggtagagcagcgacttcagtagcagcaacagttgctcgcaagtttggataaagaagattgacagaaaaatagtcatcgacactgtcataatctcttgttgctcgaatatcatattgaacttctttgggagcgccaaaaagtgaaaccatttggtccactaaatgaacaccgtgaccataccaagcgccatcaaaatttccaccttgactggcatcattaggtctaaagtggtccatattgacagtaatatctaccaaatcacccaaataaccttgctcaatcacttttttgacggttaaaaagtcgctgtcaaagcgtcgattttggaaaggcatgaagaaaagatttttttctttggcaagagctaccaattctttagcttgttccaaggtttcgactaatggtttatcacagagtacattttttccagctgaaaggagttccttagcatagtcatagtgagcaaaagctggagtcacaatgactactaaatcaattgaatcatcattaataatatcagcgatgtcagtggagaacaaagttccatttgcttctaattctgcttgttcaggacgttttcctaaagtccggttgacaattcgtttaatcacaatattctcacgttctttcacgtaaggaatatgatagcgatttgttgatttaccaaaaccaacataggcaatattaagcttttttgtcattctttttattctccattttggcacggagggcttcaattttagcttgagtggcattctttgtattgatgccttttccgcctaccgttgagtttttttcgtgaaattttccgacagatttctgtcctttattatcaagttgatattttcccataagataaattaggtttcagtaagtaaagtgcctactgaattcagttcctttctaagtggatttgactgataaaagtcaaaaagttactgacaagagctgtcagtaaaaatttgaccgattaaattccttactaaaggaaatgaagttgcacttgtaatttaaaaatgctgaacttttggagtaaactttaaattactttacgttcgtaagggtcagtagaaattccttcagaaagaattttcttagaccattctttagcaccgaaaagtgagtgattacggtaatttccgcattctttttcagcaacaccagggacattatcccaaccaaatgcatcacttgcaagctcttctagagaagatttaattacttttgcaatttcttctgaactatgttcaccccacataatcatgtgaaaaccagtttgacatccaaaaggtgaaaagtcaatcatgccatcaattctatcgcgaattaaactagccatgctatgctcaatagtgtgtaaagcggccattccaatggcattcgcattaggttgaacaaaacgaacgtcaaaattagtgataacatcgcctttaggaccagtttcgctaccgattaagcggacataaggggcaagtacttttgtgtggtctaattgaaaagattctacttcagccataagatataggatacaaaactcagctgataaaagtcagccttgttagtatctcctcctttattttaaattctaattctattctatcattttttgagcgaaatattttttcattttaattataaagtggtaaaatgactttataacggtttcaaaagaagccttattgcttaaaaaagcaagaaacatcattgtcaaaaagagtgaggaggggaagtgaacatcagagaagttgaaaagtcatctttctccatcattggaaaagaaggcttaggtaaagcacaagaagctgacatttggattccaccactctggcaagaagcaaccaacgcttttgaggaaattattcatttgattaagcagccactcacaatttggggggccatgtctgatgaatcagggcaatttaaaccatggaataatggtggactctatctggcaggcgttgaagttgaaaattcagcgcaaaagcctgaaaattggactaaatggacacttccaggctttcgttatttcgttgttgaaacaacaacttatgaaatgaacaagacttattcagatatgtggaattatttaactcaaaatgatttagaaattgttggagcagtacaagaacatcaatcaatttcagcagaaaatcctgaagagttagaactatggtttccaattgaaagaatataaaagtccaaatagtttcattgatgacgagttgttgtatttcaaaaattactaaggagaaaaaatcatgacattaacagacacttacacactaaacaatggcattaaaattccaaaagttggctttggaacttggcaatctgcgagcggagaagaagcttataatgcggtaaaagcagcacttgaagcaggatatcgtcatattgatacagcggcagtttataaaaatgaagaatcagtcggtcaagcaattgctgattcaggaattccccgtgaggaacttttcgttacaacaaaactttggggtgtaggaacaacagaggacgctgcgaaagccttggatgaatccttgaaaaaattgggacttgattatgttgatttgtacctcattcattggccaaatcctaaagcattccgccctgattttgaaacacgtaatcttgcagtttggaaagccatggaagcaggcgtaaaagctggtaaaatccgtgcaattggtgtttcaaacttccacccacgtcacctaaaaccattgttgaaatttgctgaaattaaaccagcagttaaccaaattatggtcaacccaagtgatcaacaagaagaaattgtaagttttaatgttgacaacaatatcttgactgaggcttacagcccacttggaacaggtaaaatctttgaagttccagaacttgcagacttggcaagtaaatacaacaagagtattgctcaagtggtattgcgttggtctcttcacaaaggatatttaccacttcctaaatcagtaacccctgcaagaattaaagaaaatgcagaaatctttgattttgatttaagtattgaagatattgcttttattgacagccttcatggaaaagctggtttggctaaaaaccctgatgaagttgatttctaaagaataattatgaacatattttactgacagattgtttacatctcttaaaagacagcagagaatttggtcagtaatttaaaaaaggtctgtcagtaaaattttgctgacaggctttttagatttttgctataataaagaaaaatgatcaaatatcaaggagaaatgatgaaaaaagcacttgttttagttgattttcaaaatgattttattgatggaagtttgggcacaaaagaggcgcaagccattatcccaaatgtcattgaaaaactctctcaatattctaaagaaaatcgtctagcaacccaagacacccattttgaagattatttaacgacacaagaaggcaaaaatctgccagttattcattgtcaaaatggtacttttggttgggaaattcgtaaagaagctcaagttggccttgctaaaatttttgaaaaaacaacttttggttcaagaacattggcagaatttattcgagatgaaaattatgatgaagttgaacttgtcggaatttgtacggatatttgtgttgtttccaatgccttgttaatcaaagcctatgcgccagaagtaaaaataagtgttgatgcttcttgctgtgctggagtttcacctgaaaaacatttggcagcacttgaaacaatgcgttcttgtcaaatagaaatcacgaatgcctaattttgctaaaaaattactgacaggtctgtcagtaatttcaacttgacaaaatccttatgataattgataatggagtgagaaataagaaaaattttgaaggtgagtgcgaggtataaatttggattatcatcaattattttcccgcttgaatgaaaaactttcagaagaaaatttgcaacttcacttacattgtgttggtggtttcgtccttgaatactatggaatgaaggcaacagaggatatagatgccttttatgaaagtaccgaaaaagttgaaaaaatcattcaagaaattggtgaagaatttcatgtcggaacctctaatgaaccttggttgagtcaagcagtcggcgaagtcatgtctcattcaaaaacagatgaaacaattatttttgtggaaagtcatttgactgttggtctgtcatcactcgaatctattcttatcgataaaatacaggctggccgaaccaaagatgttccagacatcgcaaaaataatgaaaaaattaaaaattgaaagcccagatcctctcttagaacgatttaaacatacagatggttcagcagacccagctgtcattttagaggcttttagtttagcttacggtgaagaagccttaaaaaattatttacgaaaaaatccaaaaatactgaggttattgcaatgacgtggattgaatatctcctgaatgctgctcaaaagtctaaatggaatttagaactttgggtccgttatttaaataaagtgattcaacgggacaaaattttactttcaaagacagatattgattatttaatgagttctgaagaattaacttcttttcaacgcgtttttcttgaactcgcgcttgaaaaagaaacaacaccttgggaaatgactgttggcatgtctgaaccgactcaatcgattcatcttcagtctgttttaaaagaattaaaaaaagaatgaattgactttcattctttttttattttataaattacaatttatttaatacgaagatattgaccaattaaaatggtatcacttgataaatgattccaagccttaattgaagcaattgggctaccagatttttgtgaaagtccccaaagtgtatctcctttaacaaccttatggatagaggtatttgaagctgcagaagagttagaagttgaactcgtagaggctgagcttgaacctgttgaagaacttgaagaaccggcagattgtgaaacaatcaagttttgtccaatgaaaattgtatcagaattcaaatgattccaactcttgagttgagcaatcgtcgttttatatttgacagagagtccccaaagcgtatcaccagatttaaccttaatcgtcgtctgtgaagctggtttggcaggagttaccgaagtagtaggcgttgtagttgcggcagaatttcctgaagaagttgaactatttgtattagacgaagaacttgaagttgttaatacaagcttttgcccaatatagatgactgtacttttaagattgttcgcgctttggatttgagcaacactaattccatatttttgcgaaattccccaaagtgtatcgccagatttaaccgtataagtggttgggcttgtacttgtattattattggtatttgtaactgtcgaaccaccagtgttagaagtaccagctgaagaagccccgtcaaaacgagtcaaattatattgggagataattcgattcagggaagcaccataattagggtcagttgcatatttccctgttaaagctgcagttgcatcttgataagttgctgcgtttgctcgccaagctttagcataataaggaccatttccaaagtttgtagtttttaaaacataagcattgtcttggaaactttgattaaaggaaggataaaccctaaatggcatatcttttgtgacccatttaccattgagatattcttgagttttaaaaacaacgctttttccttggtaagttccttgaataccgaataaattataatagggggcacgagaaagttggcttgaaccccagttactttccaaaatagcttgagcaatcataactgaaggataaagaccattactatcggcaactggttttgctgatgcagcaatactttcaataaaagcttctgtcgaattggttgcagcttgaaccattgggcttgtttgttggagcaaaagctcatgagtggtcgtcaaagttcctgcaatgagaacggcgccagcaaatttagtcgctggtttataaaaagccagtggttttttggctttcttttttaaatgtctatttttaactttaatacgagaaactggcataaataattcctttcctgaaaatacagaataaaataagtactaccctattttaccacggttaatggaagaaaaagatgacaattatgtggcggtttgtaaacgttttttatttaatgttttatattggctagaaaatgtgaggatttagagaaaaagtctgatttaagacgcattgattacgttttgaatacaaggagattatattttgctttgcgaaattgagaaaagggaatgaaaacaagcgacacaagatattgtgtgtgtttacataatttaacctatatattgtgtcatttccgagaatttgataaaatagatgatgtaattgaagaggatggttaatatgaaaagtgaagtaaaatatcaagatgtaacactagaagaaattaatgtgataaagcgtgacggacgctcagtgaaatttaacagtgggaaaatttttgatgctttgactaaagcggctaaaaaagtcgaactgacagatatgtcggttctttcagaacttactgacagagtagtcagtgaaatctttactcgtttttctgaaaatgtcaaaatttatgaaattcaatcgattgttgagcaagaactccttgagtctggtgaaactcaattggctgaagaatatatctcttatcgtgctaaccgtgatttggcccgtaccaaagcaacggatatcaatttcacgattgaaaaattaattaatcgcgaccaaactgtcgttaatgaaaatgccaataaagattctaacgttttcaatactcaacgtgatttgacagctggtgcggtttccaaagcaattggattgaaacttcttccgccacatgtggcaaatgctcaccaaaaaggtgatattcattatcatgaccttgattatagtccatttactacaatggctaactgttgtttgattgactttaaaaatatgtttgaaaatggttttaaacttggaaatgcgcaagtagattcgccaaaatcaattcaaacagcaactgcgcaagccagtcaaatcatcgctaatgtggctagttcacaatatggtggttgttcatttgaccgtgccgatgaagtattggcgccttacgcgaaattaaattataaaaaacatttaaaagatgcacaaaaatggattgatggtgctgaaaaacaagaagcttatgctcgtgaaaaaacagccaaagatatctatgatgcaatgcaatctttagaatatgaaattaatactttgtttacttcaaatggtcaaacgccttttgtaacggttggttttggtcttggagacgattggtatgcgcgtgaaattcaaaaagcaattttgaatgtccggattggtggtttaggttcagaacaccgtactgccattttccctaaattaattttcacactcaaacgtgggcttaaccttgaagtagggacaccaaactatgacatcaaagaacttgcgcttgaatgttcaacaaaacggatgtaccctgatattttgagctatgataaaattgttgaattaacaggttcatttaaagcttcaatgggttgtcgttcattcttacaaggctggaaagatgaaaatgggaatgacgtgactgctggacgtaataatcttggagttgttacagttaaccttccacgtattgctcttgaagccgctggaaataaagaaaaattctgggaaatcttcaatgaaagaattgaaattgctcatgatgcacttgcctttcgtgttgaacgtgctaaagaagcacaacctaaaaatgcacctattctctttatgaatggtgcattgggacgtcttgatgccgaaggttcagttgatgaattgtacaataaagaacgtgcaactgtaagtttaggttacattggactttatgaagtggcgactactttttatggcccaacttgggaaaataatcctgaagctaaagcttttacaattgaaattgtgaaacgaatgcatgaagattgtgaagattggtctaaagcctctgggtatcattattctgtttattcaacaccgtcagaaagtttaactgaccgtttctgccgaatggataaagaaaaattcggttcagttgcagatattactgacaaagattactatactaattctttccactatgatgtgcgtaaaaatccaactccatttgaaaaattagagtttgaaaaagactatcctgtttatgccaatggtggattcattcattactgtgaatatcctgttcttcaacaaaatccgaaagctcttgaagcagtttgggactttgcctacgatcgtattggatatcttggaacaaatgcaccaattgaccactgctatgcttgtggctttgaaggagattttgcggcaacggaacgtggatttaaatgtccacaatgtggcaatgatgatcctaaaacctgtgacgttgtcaaaagaacttgtggatatcttggaaatccgcaagcacgtccaatggttcatggtcgtcacaaagaaatttcatcacgtgtaaaacatatgaatggttctgtcggagctttgaacgatggaaatttgattgattcagtcgaagttgacgaagcgaaatcaaaatattttgcggagaaataagtatgaacaatccaaaaccaggagaatggagagctgatgaactctcacaaaattatattgcagattataaacccttcaatttcgttgatggtgaaggggtgcgctgctcactttatgtgagcggctgtatgtttcattgcgagggctgctataatcaagccacttggtcatttcgttatggaacgccctataccaaagagcttgaagataaaattatggctgatctttctcaaccttatgtccaaggattgacgcttcttggtggggaacctttcttgaatacgacatttttgattcctttgctcaaacggattcgtcgtgagttaccggataaagatatttggtcatggacaggttatacatgggaagaaatgctgcttgaaacagatgacaaattagaaatgcttgatttgttagatattttagttgacggtcgttttgaattatcaaagaaaaacttaatgctccaattccgtgggtcatcaaatcagcggattatcgatgtaccaaaatctcgaaaacaaggacaagtctttatttgggaaaaactcaatgatggtgaaaaaacttttgaacaaattcataaagaaaaattaatttaaaagttacttatggatattcgagcatattcgtaagcactaaagtgccaacggctatcttctgacagaaattctgtcactaaaaataagcactgacaaatgcgtcagcgcttattttttaaataattttgtaaaatctggttcgtcgtcagtaattttgaaatcttttagcgccgattttagagggagatgtttcttttttccttttaaataattttgactttctttgctttgggcactttcggctaaggaattttgcttttgcagaactctattttcatttttccttttgcttttcttattttggtcggtgctttcaaaagattcatctggaaaagtttgagaaagttgcttgataatggtttctaaaccaaagttactactaatccaaaagggtgtatcggttgctttacaagcttctttagcaaattgaactgaatgatgagccacattgcggtttctcataatgacgaaatcagctttggcaacaagttgattaatctcaaatcgattaggctttttcttatcaaagccaagaaaagaaacgccaacttttgccaagccctctctaaaatcatgccaatatttaacttcacatagaacaagtagtgttttcatgtcattccttactgatggctctgtctttactgacaggagcgaattatagtgattataacacaattttgcttaatgataaatgtattttttaaatataagtttcaaaaatttgacctcataaaaataaagtggtaaattaatagcagatgggtatggtgcacacccgaaaccgtttcaagaaatagcttgaatctaatggcgcctacaaagcaaagtctttttttgccttgtagtctgccattttttctttgacttacaaggcattaaaggaaaagaaaaggagatttattatgacagtcacaatcgaaaacatccacgcaagagaaatttttgattctagaggaaatccaaccgttgaggtagatgttagattaacagatggaacactaggacgcgcagcagtaccctcaggagcatcaaccggagaccgtgaagcagttgaattaagagatggtggagaccgtcttcaagggaaaggcgtttctaaagccgtcgcaaacatcaatggcgaaatttatgaagccttgaaaggacaatcaccatttaatcaagcaaaattagatcatttgatgattgagcttgacgggacaaaaaataaatctcgtttaggggctaatgcaattttaggggtttcaatggccatttctcgcgcggcagcgaatagtgaaaaaattctactctatcgctatctgggtggagttgatttagaacttcctcaaccatttttcaatgtcattaatggtggagtacatgccgattcaggaattgacgttcaagaatttttgattacaccagtcaaacgggaaagctttcgcaatggtttagaaaaaattgcaaatatctaccatactctgaagaaaattttagctgacaaagggctagaaacagccgtaggtgatgaaggtggctttgcccctaaacttggttctactgaaaatgcaattgctacactttatcaagcaattgaaagtgcaggatatgttcctggtgaagaaattgcgattgccattgacccagcttcaagtgaattttatgatgataaagaaaaagtttatcgttttgaagggcaaaaattgacttctaaagaactattgacttactatgaaaatttagttgaaaaatatccagcacttatttccattgaagatggattttctgaacatgactgggatggctttgcagctcaaacgaaagctcaaggtcaaaaaattcaattagtgggtgacgatatttttgtgacaaatcccgaaattttcaaagaaggaattaaaaaaggcgtagcaaatgctattttgattaaacttaatcaaatcggaacagtaactgaagcgattgaagctattagtttagcgagaaaagcaggctataagacaatgatttctcaccgttcaggtgaaacagttgatagctacattgccgattttgcggtagccatgcatgctggccaaataaaaacaggttcaatggctcgaagtgaacgggttgaaaaatataatcaattcttgcgaattgaagaagaattaggaaaagatgtatctcttgctagttttccaggatagataaaaataaaaaaacattaatttttataattaatgtttttttatttttaagaatgtgaatttataaaggagaagaggggattcgaacccccgatacgcttgtgacgtatacacactttccaggcgtgctccttcggccactcggacacttctccgacttccttaatattataacaaaatttcttcttgtttagcaataacttttaaatgttttgttttggcgataaagaatgtcatttttagtagaaatataaaactaaatgcttaaaagtgtttaaaatttggtataataagggctatgaataaaattctcgaagtagaaaatttagtttttaaatatgaaaaagaaagcgatgtaaatcagcttaatggggtttccttttcgattacaaaaggggaatgggtttcgattattggccaaaatggttctggtaaatcgacgactgctcgactgattgacggtctttttgaagaatttgaaggaaaagtcaaaattgatggagagcttttgactgctgaaaatgtctggaatcttcgtcgaaagattgggatggtttttcaaaatccggataaccaatttgttggggcaacggttgaagatgatgtcgcttttggtatggaaaatcaaggaattccacgggaagagatgattaaacgagttgacgaagctttgcttgctgtcaatatgcttgatttcaaaacccgcgaacccgcgagactttctggtggacaaaaacaaagggtagctgtggccggaattattgctttgcgacctgaaatcattattcttgatgaatcaacctcaatgcttgacccgaccgggcgtcaagaaattatgcgcgtgattcatgaaattaaagagaaatatcaactgaccgttttatctattactcatgaccttgatgaagcagcaagctctgaccgaattttagtgatgaaagcaggagaaataattaaggaagcggcaccgtctgaactctttgcaacgagtgaggatatggttgaaattggactagatgttcccttctcttcaaatttaatgaaagacctgcgaaaaaatggctttgatttaccagaaaagtatctgtcagaagacgaattggtagagcttttggctgataagttgcgctaaatttactgacagaatttctgtcagtaataaaggagatttgatcatggaaattgaacttgtaaaagtggaaaaaagtcaatcaaaccatgttttgaaactctatcagttcatttttagtctctatttgaaaaagtatcatgatgatgagattaacccagcaaacactcccataacaaaaattgaaagatggtttgataaagaatttatgagcttattttttattaaatttgacgaaaaaattgtaggtattgttcgtctagctcatgtgacttgggattttgaaggtcaagataaaattcatatcggagactttggcattttaccagattatcaaaatctaggtttggggcaaatgaccataaaaaaacttgaacagatgtaccatcctaaagatgggtgggaactatcaactattttgcaagaagcaggcaacatccatttttatgaaaaacttggttatcaagctactgggagtttgacacatattaatgaaaaaatggatattattggatttgagaaaaaagaaaaatgattaaatttgaaaaagtaaattatacttatcagcccaacagtccctttgccagtcgtgccctttttgacattgatttagaagtcaaaaaaggaagttatacggctttgattgggcatactggttctggtaaatcgacgcttttgcaacatctgaatggattgttgcaacctacacaagggacggttagagtaggtgatattgttgtcacttcaacaagtaaacaaaaagagattaaacctgtccgcaaaaaagtgggtgtagtctttcaatttcctgaaagccaactttttgaagaaacggttttaaaagatgtcgcttttggaccacaaaactttggaatttcaaaagaagaagctgagaaaattgctgctgagaaactggaaatggttggtctttcaaaagaattttgggaaaaatctccttttgaactttcaggagggcaaatgcgtcgtgtggccattgctgggattctcgcgatggaaccagaagttttggtacttgatgaaccaacagcgggccttgacccaaaagctagaattgagatgatgcaactttttgagagtattcatcaaacgggtcaaaccgttgttttagtcactcatttaatggatgacgtggccgattatgctgactatgtttatcttcttgaaaaaggacatattatcagctgcggtactccgtcagatgtttttcaagaagttgattttttgaaagcacatgaattgggagtgccgaaagcgactcattttgctgaccaacttcaaaaaacgggggcctatacttttgaaaaattgccaatcacacgagctgaacttgttaatttactaacaagtctgtcagtaaaatcaggaggtgaaaactgatgcaaaatatgctgatgggacgttatattccaggtgatagtatcattcaccgcatggacccgcgttcaaaacttttggtgatgattgcttttgttgtcattatctttttggctaatgattggttaggttatcttcttttagtgctttacactttagcgggtgttttattatccaagatttcagtttcctattttttaaaaggcctacggccaatgattggtttaattctattcacagttattttccaaatgctttttactaatggtcaacatgtcatttttagtctgtggtttatcaaaatttcaactgaatctttgattaatgccgtctatattttctttcgttttgtcttgattatttttatgtcaacaattttgacgctgaccacgccaccattgaccttggctgatggaatcgaaaaaggcttaggacctttgaaaaaaatcaaagtccctgttcatgaattaggtttgatgttatctatttctttacgctttattccaacattaatggatgacacaacaatgattatgaatgctcaaaaagccagaggaatggattttggcgaaggaaatttactgaaaaaaatcaaatcagtcattccaattttaattccattatttgtcagttctttccgccgtgcggatgacttagcagtcgcaatggaaagcagaggctatcaagggggagatggacgtacaaaataccgtcaactcaaatggaaaatgcgagatagcttgctcgttgtatctattatcataatggcaattttacttattttatggtcaaaagtttcctaaataaaagctcaagaggagaaaaaatgattactttaaacgtaaatagcttggaaaatgcagaaattttttggaaagaattagggttggaagatgaagtagcactcaatgaaacctatgacccaaatcctgaaactttagcaatttccgtagagacaattgatgaaattcatgataaaatcattgaacttggacttcctgtaagtccaattacgccagctgttgatggaagattcatgttttcttttattgctcctgaggataatacctttattgttattggtgaatgggtcgaaagaccttacactggagaaatgcgcactgaattttttgaaaatgtaaaaggactaattccacttgcgccagaacgtctgtcagagctgacagaaggccaatttgttctttttggacgtgtcacttgtccttggaccagaagatttgttaaggcccttcctgactatgctgacaaaatgatttattacgttgacacagaaaatacagacctcaatccagaattacaagcgattcgcaaagctcacgaagtagaaaccgttccaacatttatgaagagaagtgctgacggaacttttgtcaaatttgataaaaagaaagaaagtctttctgagtttataaaataaatgctgacagttctgtcagtaaaaaaacagtttcggctgttttttctttaagcagaattgaaaattttccaaatatttgataatttgctataatatagaacaataatattgtaggtaaaatgattctgtcagtaaattttttactgacagaatcataaaaaggcctataaagtgtcatcaataactgaatggccctagaatggagtaaaaatggaagcacaaaaactatcagcacaagaaataattcaatttatcgggaacgctgagaaaaaaacacgtgtcaaggtaaccttatcaggaatgcctagttttaaagcagctggttttcttgctgaaaatgggcgtccaaattttaaggcattagccaataaaggaatccaagttctgggagattttcacacacattacagcttaaaaattatcattggagattggcaagcagtacgtccattgctttctggcttgactgagaataaagattacaccctagaacttgaaggccgaaattcagctgttcctctccttgataccagagaaatcaatgctcgaattgagccaggagcaattattcgtgaccaagtaactattggcgatagtgcggtcattatgatgggggctatcatcaatatcggagctgaaattggtgaaggcacaatgattgatatgggggcaattttgggtggccgtgcgacggttggtaagaactctcatattggtgctggagctgttttggctggtgttattgagcctgcaagtgctgaacctgttcgtgttggggataatgtccttgttggagctaatgcggttgtaatcgaaggagtacaagtcggttcaggttctgttgttgcagcaggggcaattgttacccaagatgttccggaaaacgttgttgttgcgggtgttccagctcgaattatcaaagaaatagatgaaaaaacacaacaaaaaacggctttagaagatgcccttagaaatttgtaaaattaaagaaatagcttatttctgaacttttgttaatcttagcaaaagtttttttgctaaaaagagcaatatacagccgaaaaagagtaaaataaataaaaaaacttttgaaatttagcttagtaatgaggaaaaaatatgataaatttaatcgaaatcagacggcagcttcaccaaattcctgaaattggtcttgaagaatacgaaactcaaaagtatttactagccattattcaagaactgactcaaaataaatcattcattcaagtgagaacatggcaaaccggtattctagtttatctagcaggaagtcagggtcaaaagacaattggttggcgaacagatattgacggtctgcctattgaggaattaactgatttaccttatgctagtaaaaatgggcgaatgcacgcttgtggacacgatattcacatgaccgttgctcttggtttattggaaaaaatgagagaaagtcaaccaatagataatctcctctttctctttcaacctgctgaagaaaatgaagcgggcggaaaattaatgtatgatgctggagcatttgaaaattggcttcctgatgaattttatggattacatgtcagaccagatttaaaagtaggagatatcgctacgaatcagcatacgctttttgcaggaacttgtgaagttgaattatcctttattggaacaggaggacatgctgcttttcctcacacagcaaatgatgctttggtggcagccgcttattttatcactcaagttcagacgattgtaagccgaaatgtggatccgttagcttcagcagtggttacatttgggaaaatggaagctggaacaacaaataatattatcgctgaacgtgcttttttacatggaactatccggagtctgacccaagaagtcaatgaattgactcaaaaacgtttaagagaacttgcaaatggaatcgcggaatcttttaacatggaaattgagcttaaacttaaacaaggcggctatcttccagttgaaaatcatcctgaacttgctaaagaactgatggattttttcaaaaaagaaactaaggctaatcttattgacatcgctccagccatgactggcgaagattttggttatcttttgagcaaaattcctggagtcatgttctggttaggaattgatagtgatgctccccttcattcacaaaaaatgaatccagacgagcacgttctcaattttgctgttgatacaattagccaatttttacaatttaaagttaataggttatcagaagatgaaaaaacaataaattaatggctttaatcttaagaatagatatgttaagataggagaatagagtttttttaaatcattcagtagttaaattgtcacaatttaacttttttgaaatgataaaagttatttagggaagaataatgaaacaaagaagattaaaatcaaaaggagcaaaaaaagctttttggaagcttaccttgcttataggtgcgttattaatagtggtagcgggagtaggaacctattattatgatcaaggagttcaaaagcaaaaaattgcttatgaaaaacaagtagatgaggcgagaaatgcaaaagacaaggcctatgattcaagaaaagcaaacgatattgaacaggctcataagttaattgataagcttcatgttaaagataaaacttctttagataaatcaatgagccaattgacaaactatttgtcagagattgacaaagtaaaccagattgttgcaaaagcccatgaaaatataagtgaagaaggaataaaaagctctgaagaggctttagaattattaaaggctccgtatgagaaatcagacaaagaagcattggcaaaacaagtaaatgctgacaaacaaatacttattgagcgtcaaaaagaagcggagcgtattgcgaacgttcaaaatcaatatgcaaataaaaaattgattgccttgacctttgatgatggaccaaaccctaatacgacccctcaattattaaaaattttatcagatgcacaagttccagcaaccttttttgctctaggaaaacaagcccaagcctgcccccaaattattaaagaagaagctgatagaggaaatgaagtcgcttcgcatacatgggaccataaagacttggtgacactctcaccagaccaacaaaagcaagaaattgagagtgcaaatcagttaattaataaaattataggtaaaaacgtaacactcttccgtccaccttatggaagttataataaatctgttttaagtcaaacaaatttaagtgcagtcaattggactgttgacactaatgactggcgttatcgtacaagtgctccagttgttcaaaatgtttcgacttacgcccatgatggagcaatcattttaatgcatgatattcatcaatggtcagtagatgcggtgccgcagattattcaaaatttgaaagcacaaggttatacctttgtaacggtcagcactttgctaacagtacaagatgggggagctaaggctcaacaagtttattttggtagataataaaataagaagaggagaagtgattctactctttttattcgtctttaacgaaggtttattctaaaaaattcatatccaatgagtttattcttgacaacttatgggaaacttgatatactaatatagtcgtttgagagaaacgcaggcgtggctcaactggatagagtacctgactacgaatcaggcggttgtaggttcgaatcctaccgcttgcataaacagaatatggcgaaagtcatttttttgtttgatactgatattttatataaaatatcagtatcggtaagaatttaaaaattctaaaataagatttgggacttcgcgacaagcgcgaagaactgaattgctaaacgccaaagcgtgaagcacttcatgttcgggaagtagctcagcttggtagagctcaaagcatgctttgaggctgtggataggaatttgcgaagcaaatttaccttacaagtactcttaaaagtggagatgctgaacaaagaagtttcaaaaatttaatattagctacgggaagtagctcagcttggtagagtacttggtttgggaccaaggtgtcgcaggttcgaatcctgtcttcccgattaccgactaaccctaactcatctttcgtggatgagtttttttgatgtcaaaattagataatcttccataattcttgaaagtgttatcaagatatgataaaattcaagtgataatgtgagtttagaaaattactaaaagcgagcattaaatgaaaggagccatcatggcatataaatcacataaatttggtaaacgtaacggtaaaaaacatttcaacgcagtaggcgtaagaactgcaccaaaaccagaagctaaaaaagaagaaaaataatttttgtttaggaattttaaattacttaaaattgaatcctaatctcttgattttctaactcatctcttgcagatgagttttttatttaaatcactcgttctaatgtgaaaaatattgacaaaataaggatttttggtataatagaaaagttgaatatagcagtcagctagaaagctcgtcaacattttgctgttatgtcagggagcgtaagctattatactccttgtgtcaagtaactgaagctataagcgaaggtaaaatgaacgaattcgaggctgtcaatattcttcaaataaaatatttggaggacataaattatgtcacgttacactggtccatcatggaaacaatcacgccgttacggtatctcactttctggttctggtaaagaaatcgctcgtcgtaactacgtacctggacaacacggtccaaacaaccgttcaaaactttctgaatacggtcttcaattggctgaaaaacaaaaacttcgtttttcatacggtctttctgaacgtcaattccgtaacttgtacattgctgcaactaaagttaaagaaggaactgttggtttcaacttcatgactttgcttgaacaacgtcttgataacgttgttttccgtcttggtcttgcgactactcgtcgtcaagcacgtcaattcgtaaaccacggacatatccttgttgacggaaatcgcgttgatatcccatcattccgcgtacaacctggtcaagtgatctcagttcgcgaaaaatctatgaaagttcctgcaatccttgaagctgttgaagctactaaaggtcgcgctaacttcgtatcatttgatgctgataaacttgaaggaactcttgttcgtcttcctgaacgtgatgaaatcaacccagaaatcaatgaagcattgatcgttgaattctacaacaaaatgatgtaatttcttatttgcattttgaaatcgctcctgtttgggagcgatttttttgtgacttttttggtaaaatagaggtaggacactgtcctttaaaattgatgacaaaaactagttaaggattatttctaagtggaaaatgttaaaaaaattgctgaattgttgaatatcaaaaattcacaagttgaaaaagtattagaattgacggcagaggggaacacagttccgtttattgctcgttatcgtaaagaagcaacaggttcacttgacgaagttgaaatcaaaaaaattattgatgaagataatttactgacaaaattatcagaacgtaaaacggctgttttgtcaaaaattgaagagcttggtaagttgactgattcgcttaaaacacaaattttggctgctgaaaaactgacagaagttgaagatttatatttgccttacaaagaaaaacggcgcacaaaagcaacgattgcaaaggaaaatggtttatttcctttggctcaattgattgtaaaaaattcagcgaatcttgaagaagaagctgaaaaatttgtcaatgagaattttacaagccctcaaaaagctttggaaggtgccgtggatattttgtcagaagcgatttctgaagatgcgcgtttgcgttcatggctgactggtgaaatcaaaaacaatagtttactgacaagtagtttgaaaaaagatgccgttgatgaaaagcaagtttttcaaatgtattatgaattctcagaaaaagtttcagaattaccaaattatcgtgtattggctttaaaccgtggtgaaaaattggggattctgtcagtaaaatttgaaaataacgaagataaaattttacgttattttgccgcccgttttgctgctcaaaataatccaatgatgcaagtggcgattaaagatgctgtcaagaaaaaattgattccagctatggaacgtagtattcggactgatctgacagaaaaagctgaagcatctgctatcgaagtttttggcgaaaatttgaaaaatttattattggtggctccgcttaaagggcgtgtagtcatgggatttgaccctgcttaccgtactggagcaaagcttgctgttgttgatgagacaggtaaattattgatgacaacggttatttatcctgttaagccagcaaatgcaggtcaaattgctcaagcgaaaaaagatttagcaaaattcattcgagaatatggtgtgaatatgattgcgattgggaatggaactgccagtcgcgaatctgaaagttttgttgcagaagtactcaaggaaaataatttttctgatgtttattatgtgattgtcagtgaatctggagcctctgtttattcagcgagcgagttggcacgtgaagaatttccagaattgactgttgaaaaacgttcagcaatttcgattgcacgccgtttgcaagatccattggctgaacttgtaaaaatcgaaccaaaagccattggtgttggtcaatatcaacatgatgtttctgagaaaaaattaacagaaaatcttgattttgtcgtggaaacagtagttaaccaagttggtgttaatgtcaatacagccagtcctagtttgctttcacacgtagctggtcttaataaaagtttggcacagaatgtagtaaaataccgtgaagaaaatggcgcactcaaaacaagagcggaactaaaaaaagtcccacgtttgggagctaaagcatttgaacaagcggcaggtttcttaagaattccagaaggtaaaaatttccttgacaacaccggtgttcacccagaatcttataaagtgacggaacaacttttggcggaaattgccgctgataaacctgtcagtaacgaagaattgctgaccaaactttcgtcagtaaatattcctgaaatggctgaaaaacttggtcttggtcaggaaacattgactgatattatcaatgatttacaaaaaccaggccgtgatttgcgtgatagttttgatgccccaattttaagacaagatgttttgtcagctggagatttacaaattggtcaacaacttgaaggtgtagttcgtaatgttgttgatttcggtgcctttattgatatcggaattaaaaatgatggcttggcacacgtttctgatttgagtaaatcttttgtcaaaaatccaagtgatgttgtcgctgtagggcaaatcgtaacggtttgggttaaatctctcgatttacaaagagggaaaattaatttaaccttagtgaacccacgagaaaaataatctgtcagtaaattttttgattctagtttctttaagcgaagctgtcagtaaatatttttcaaattttagtttcgctaggtgaagctgtcagtaaaatttactgacactcgtctgtgcgagcctgtcaaaggaggaaaagtgttaactaatcaagaattgacagcaaaagtaaaagaaatatcactcacatattttaagcaatcatttgaccacgaagcaaaatggaatcaacgcctacggacaactggtggtcgtttctttcccaaagatttacatctagattttaatcctaaaatggctgaacttaaagattttgaaggagtgatacttcatgaattaactcattatcatctgtatcggtctaaaagaggttatcaacatcgagatgctgattttaaaaggcttctgtcacaagttggtggcttacgatatgctccctcagtgattgataagaagataaaatattattatagctgtcaaaattgcggccaactttatcctcgacaaagaaaaattgatacaaaaaagtatcgctgtggaaaatgtcgagggaaattaatcttaaaaacaagcggaaattaaaaattccgcttttttttattaagaattaagaagtttatccacattttcttcactttttccccaaaaactgttaataagttaagataaattggggataattacaaaaaaatggctcaattgagccaaaaaaatcttatccacaagataaaataaatgcgtaaagatgataattgctttttctcacaaaaaagcgtagaatagtaaaaatacatttttgaaggacttcgagctatttagctcgaaatcttttatatcatgtaaaataatattggatgaaaaagaaaagggagaaactcgtgcttaaatcagaaattattgctcaaatgccaaaagttgaacttcattgccatcttgatggttcgcttagcttgtcagtcattaaagaactcgctaaaaatgctggaattcatatgacaatgtccgatgaggaaattttagaaaaggcacaagccccagaaaatacaaaaaatttgctagaatacttgcaacgttttgatttcgtcttaccacttttgcaaacttataagaatttagagttagctgcttatgatgttgtcagacaggcagcaaatgataatattaaatatattgaaatccgttttgctccaagtcaacatctcttagaaaatctaacccttgaagaagcagtagaggctgtcatcgccggactttctcgtgcagaaaatgattttgatataagagcaaatgcactcgtttgtggattaaaacaagaaccaattcaaaaattacaaaaactgctgccactttttgataagattcctgatgaacatcttgtcggatttgatatggcgggtgatgaattaaattatccacaggaaaaatttgtagatttgattcatgatgtaaaaattaagggtgtcaatgtgacgcttcatgctggagaatgcccagcctgtgagcaaaatattttagattcaattgcaatgggggcaagtcgcattggacatggaattatgactaaaaatctgtccgaagccgaacaaaaaatgatgattgaaaaacaaattgttttagaaatggctccaactagcaattttcaaacaaaagcggtgacagagcttgcgcaatatccttttaaagaactttatgacaaaggaatacacgtgacattaaataccgataatcgaatggtttcggctacaaatttaagcaaagaatatgagaaaatctcagcttggtatccagattttttactttctgattttgaaaaaataaatcattacgcaattgatggcgcctttattggtcaagaagaaaaagaagaacttcatcaaagatttaccaaagaatacaaaaaaatctctgaataatcagaggttttttatattagatgaattattattatttaatttctatcttagaaatgatttgagcagcttgttcatcaaatgaagttggaatggcaagcgtttggctactgtccaatagtttttgagattcttcttttacccaagcagaatctttaagatatctttcgtcttggtaatgatttgggtctttataaaaattgattgacccattatgattagaactataggtaacaaaagtggttccagccattgtattatcagaactaaaagataatgttactgtgtcctgaggaacaactacagaaccagaaaaaggaaagacttggtgattagctccatttttagtaacactgatagaaacaggttgataatcatatttgtaataacttagaagggttttggttacgcgtgcatactcaacctgttcagcgctatatccagataaaggcgaagaacttttttgtactttttcagaattattggtatttgcttgactgcttgaaacagaagagctcgtagaatgagtagcagaatttttactattgctagtttttgaacttgaggtaactttagaactagaagtagtttcttttttggtttgattctcagaacttttagaatttgaacaggcagctaatgaaaataaactcaaaaatgtagctgaccaaaggattatttttttcataagatttattctccatttttattactttataataatagcattaaagttttgcaaagtaaaatttagctatgattactataatcttagaatatatttctacttgggtataatctatttttggaatgagctttatttagatatttttatttctaaggtgttgctttaggacaataaaaaaagctgaatcattatatattcagcctttttttattaataaatattattcatcaggtgtcataatcattggaacaacaagtggtgagcgttcagtttgtttatagaggaatggtgagagtgcttcacgcatcgcacgagccacagaagcttcatttgcgttttcttcatgcatcgcttcacgaatggcattgaaaaggacacgttgaccactacgaatcaaatcaccagactcacgcatatagataaatccacgcgaaagcatgtcagggccagcaagaacggttttcttttcaaagtcaacggttgcaaccgcaaggacaattccatcttctgaaagttcatgacgatcgtggagaacggcatttccgacatcaccaattcctgaaccatcaacgtaagtgtcagaggctgggaaatggtcggcatatcttgcgctgtcagcagttaatgcaaggacgtcaccattttcttgaatgaaacaattttctttagggacaccagtatcttgagcaagtccagcgtgaattttgagcattcgatattcaccgtgaacaggcataaagtatttcggtttgatgagacgtaacatgagtttttgctcttgttgcccaccatgaccagaggtgtgaatgttgttcattttaccataaataacttcaacaccagcttcagcgattttgttaatcaattggttaacaccgtgggtattcccaggaatagcatttgatgagaagacaaccgtatcgcccatttgtaaggtaatatgacggtgcattccgttggcaattcttgaaagggcagccattggttcaccttgcgaacctgtacacataatcaaaagttcatgtgaagcgtattgattaacttcatttggttcaatgaaagttcctttaggagctttgatataaccgagttccaaaccattcacgattgctttttccattgaacgaccgaaaacgacaattttgcgtccagtcttaactgctccatcaacggcttgttgcaaacggaaaatatttgaggcaaatgaagcgaaaataattcgaccttcaatacgttcaaaaattttcatgatgcttgcaccaacgactttttcagaatgtgaaaaagttggaatttcagcattggttgagtcagaaagaaggagtaaaacgccttcgcttccaagttcagccattcggtgaaggtcagcaggttcacccactggtgtgaagtcaaacttgaagtcaccagtagcgacaattttaccttgaggagtatttacaacaatccctaaaggttctggaattgagtgagtcgtgcggaagaagtcaagacttaaatgattaaatttaatgactgaatctgcatgaatttcataaagtttagcatcacgtaaaagtccgtgttcttcgagctttccacgaatgagcgcaagtgacaatggtccagcataaattggaatattggcctgtttcaagaggaatggaattcctccgatgtggtcttcgtgtccgtgagtgatgaagagacctttgatacgatcaatattttcaacgatataagtataatcagggatgacgtagtcaacacctaataaatcgtcttctgggaatttaattccggcgtcaatgatgataatttcatctttatactcaacgccgtaagtatttttaccgatttcgcccagcccgccaatggcgtaaactgcgacttcatcagcttttattttaagttgctttggcatatttctcctattctttggattttttattttattttttgactgacaagttggtcagttcggttttttaatgtaatatttactgacagaattttaaaggtacaagaaaatcactttagattgctgtcatttttgacaaaaatctaaagtgctctcctttatactccagtcagtcttagaagcttgtgatttcaaatacgccagtttctttttcatattcgacagattcatcagaaagtgagtcaataaactctacgtggtaggcagtatttttagcaagaagttcgcgtgcaaggataactccttcttctttagtagcgacatcaaggtcgaggtaaagagcctcagtagtctcacgacgtggtgagcgggtattatctttttggtagaaaactttaaaaatcattctataaatcacgagcaaaagctcgttcctttcttaatagttcgtgtttgctgttctttgcaattactatcattttagcatatttgcaaggaaatggaaagttgagttcattaattttaaaaatgaagcgcttcctaaaaaataatggtggaacttgcaaggcaagcgtggtaaaatataaggaagtagaactgatgacagagaagataaaaattatttgtagataggccgcattggataagtggctgtcagtaaaagtctatcagtaattaaaaaataacatactttcagaaatattataggtaaaaaatgaaaatattagcatttgatagctcatcaaaggctttgtcagtagctgtggttgctgacggaatattacttggtgaagtaacattaaatttgaaaaaaaatcacagtacaactttgatgacaagcattgattttttgatggctcaagttggtcttgaagccaaagaacttgaccggattgcggtagcacaaggccctggttcttatacaggtttgcgactttctgcgacagttggaaaaacattggcttttagcttaaataaagagcttgttggtctatcaagtttattggcaattgctaatcgtgttcaagacaaaaatgcttacgtgcttccgataattgatgcaagacgtggaaatgcctatgcagctctttataaaaatggtcagcaaataattgcggatcaacattgtaattttagtgaatttttggctgatttatcagaaaaagtttcttcatttgaacaaattattttcacaggagaaactgataatttcgttgaagcaattcaaaatgctggtttctctgaagaacaaatcatttctgacagtttagaaaagctcccgtcagcctatgaaattgctaagattgccgaaaaattaactcctgaaaatgtgcacgcttttgtgccaaattacctcaaaaaagttgaggccgaagagaaatggttggaaagtcatgaaaaagctgaaaacactcctgacgactacgttcaaagggtttagtggaaaaaaatttaatcctcgtcgttatttagaaatggctgacattgaacttgaacatgaccgagaaggtgttcactatcgattggcagacagagttgatattgttgctttgcttgcgattgaacgagatgtttacaatggagatattccatggaccttctctcattttgaacatgaaattgtcaaaaatgatgaagcctttttcattgtggccgaaatttctggcagtgtcattggttttattggaactagaatcaatcaccatggtcaagatgcacatatcactaatctcgcagtgtttaaagcctttcaaggacaacaaattgcctcaactttgattgaacaactgattgtattgatgagcgcactcggaaaaaatgagatgactttggaagtccgtcgtgacaatactaaagcacaaggactttatcgtaggcaaggttttgtcactgacaaattattgccagagtactatgaagacggtgctgatgccatttggatgattaagaaattgaaaaaatgaaactaaaacatctctcttactttgaagaaaaattagaagataaaaaatattttccaaccatagaaaacctatcagctcagatttatgaacttttgtcacttgcttacgaagaatcaccgtggacacgagcttacattttagctgatataatcaatgaaaattccgattatttcttcctagaagaagaggggcaaattgttggtcttttagcgatttcaacaataatggatgaattagaaattacaaatatcgctattcatcctgattttcaggggcaaggactagcgagttttttactgacagaagtgtcaacatttagtgggactttatttttggaagttcggaagtccaatcttgccgctcaaaaatgttatgaaaaatttggttttaagatttatcatacaagaaaaaattattatgacaaacctcttgaagatgctttgttaatgagaaaagagcaattttaaaaatgaaagataattatatattagcctttgaaacttcatgtgatgaaacttcagtggcaattttaaagaatggaaatgaattattatgtaatatcattgccagtcaaatcaatagtcataaacgctttggtggagttgtgccagaaattgccagccgtcatcacgtcgaacaaattactgtttgtattgaagcagcccttgaagaagcagaaatttcggctgaccaactgacggccattgcggtgaccgaaggtccaggcttaaatggcgccttgttagttggaatcatggcagcaaaaacttttgcatgggcaaatcatcttcctttgattccagttaatcacatggccggtcatttgatggctgcaagtttagtggataccattgaatatccagctatggcccttttggtttcaggtggacattctgaacttgtttacgtagaaaaagaaggaagctataaaaaagttggtgaaactcgtgacgatgctgccggtgaagcttatgataaagttggtcgagtgatgggcctgacttatccgagtggaaaagtcattgatgaattagcacacaaaggagctgatacttacaatttcccacgagcaatgatgaacacacatgaagtagaatttagcttttcaggcttaaaatcagcctttatcaatctcgttcataacgaaaatcaaaaaggaaatgacgtgattgctgatgatttagaaaatttagctgcttcctttcaagctgcggtcgtcgatgtccttatggccaaaaccaaattagccatggaaaaatatccagtaaaaacgctaataatcggcggtggagtatcagcaaatcaaggcttacgcgaacgtttgtcagcagaaattactgacgaaaagttaattattcctcctttaagactctgtggtgacaatgctggaatgattgcagcagcagcatatattgaatggaaaaaaggtttggaaaatgttcaagcaggattagatttaaatgcaaaacctagtctcgtttttgaagacgtagaagaaggagaagtttaatgatgaaattaattggaaaacttcaaaatggcatgacctttactgaagaatttgacggagtcaacgatttcctagcccttcaacaaagcgattataatgccattgctgatgaaattgaagttgttgaagtaaaaattgctgacgaagtccttgattttaaaggaaatatgggccaactttactacgaactcatgaaataaataaaaagttactgacagaattgtcagagcctaactgttgaaactttacagataggttcgattttcatcagtaattttttttatgttttgattcaaatttaccaccatttaggcagtaaggcaacgatagaatttgtgacactagagattgtgtttgtgacagttgtcgttgcgagtgatataagattatttgcagtgttaactgttgttgccacagcatttgttaaggacgtagtaataggttgaattgaagaaacaatagtatttattgccggagttacaatatggaaaatgttttcattagaatactttagagcagttgtaagcaggctaacaactggagctatgatagaatctggagcggtgacaatatcgttgataattggtccccatactggagaagcgggttctataagtgagccatcgatattaaactgatagtcaggtgtatggctgtaaaaaggaccactattaccttcgtcatagtagactgctgcgtttaaaccatttcctccataagctcctagtatgacatcatacatatttctaatattaaaataaagattaggatgagcttgaacataagcgatatcagcagttgacaaaatatttgaagggtctggtccaacaaaggcaacaactggaattcgttcttgcgccccaattgctagtgccaaatatcccccaagagaaatacctgttactgcaaaactagactttggatattgtgaaatgattgagtcagcaaattgtttagcagttacagcttgactaggtaaggtgggtccaccatttaatggtacaaaatactggcttccacctactacagtttcaatgtctgtaatccaatcattaatttcattaaaatagggattagttgctgcataagcaataataatgctactagtatttgtaaacccgtttatgattggagaaactgccattgcttgcatgccattatcgggatagccagaaagagagttatcagaatctacggctagtaatatttgataagtttgtccggtgctttgaccattcagatgaacagtaaggatatccccggttttgagagaattaaatccagggttagcaacttgtgaataggcttgaccaacagaaagagcgtcgcctgcaatgttataaaaatcaagagttgttgtattagcaagagtcgtttggtcagtcgcagaaatacccgaattactagtttgatttaaaagtgttgtatcaggattagtgatacttatatcattggcgattgtattactagagcttgaatctctaacagatgaatctgccagacttgattgtgtagcggctaggctagaaatgttgctgttgcttgcagaagtggtggcatctaatgtgtcaactgtagtagatgaactagatatacttgatgaactcgaaagagctatagaagaatccaaagcctgacttgtcggcatatccgatgattgagaggttgataaagaactgattgaaggggttgaggtgctatttgaggattcagatatttgcggagtacttgaaattactgaactaacagtagatatttcagaagtttcactattgcttgagcatgcacttgcatctaatgaattaggggttagcgaattaagggatgttagcggtgaagcagtagattcatcagcttttgctagctgtgttgtcacagcgcccaaaaggagaaaagtaattaaacttgcagaataaagccaaacttttccttttttccatgctttaaaatgagttatactactttgcataaatatctcctaactttcttcttcggcttgattttcttgttcttgtgccagtaaaatcttatcgtaacttctagcaaaaggaaaataaataaagatagtcatgacaagcattagagcttgccaaattgctgttttccagccacccactaacaaacctgagataataggaggagtggtccaagggacataaacgccattaaaaggcggaatgatttgaaaataaatagcaaaataagttagaaatcctgaaagcaatggtgcaaggaaaaatgggatagcaagtatggggttaagaacaattggaagtccaaagagaaccggttcgttgatattgaaaattgcaggtccaagttccattcgccccaaaactttcatttgttgggattttgcaaaaaagagtagatagacaacgagaccaaaggttaatccggcacctgtactgataatgaattggtcgctgaaagcttgagtaacaatatgtgctccatttgctaaagaaagtttatgttcggcataaagtttagcgttatccaaaccattggcagctaataaaggagccattattccagtaataattattgaagaaccatgaacaccgaaccaccagataaatacaggtaaaaatgcaagaacgaacactccgacaggtccatcagaaacgtgttgcaatggtgattgaatgactttataaacccattcaacaaaagtagtatttaaggcaattgtgtaaattccttctaaaataccaaagagtgtaacaattgcagcagctggaattaatgcagtgaatgaaccagctacgttttcaggaacttgttcaggcattttaattgtgatattgtgtttcataaaccaactgtaaagccaaccgacaattaagccgacgataatggctagcaccattcctttaccagataaccaagtgcggtcaatgacattataaacatagtaattagagctgggttttccagtagcaatagaagttacattggtcatgatatctggctgaagaacaatatcacagataatggcgattaaaccagctggtgcagccttgtaaccttctgcttctacccaagaataggcaattccaaagaccgcaaagagagccatgattccaaaagaagcattattgatagcaagaaagagtggtcctagcttaattttattcatgaagtcctgtccagcttgccagggaagttgaccaaggattagaaaaatcgatccgacgataactgcgggtaaaatatacatcataccattttttatcgctgtaactgccttagtattcaaaaacttcatcatcggaggcataagtgtctcatttataaatgtgttcataaaaagttctcctttttcgtttagaaagcgctttatttttttgttaattttagtataaaaaaacgtttttaccttttcaagaggtaaaaacgttttgaaactattttttttgattttggaactgtcccataaatgggacagaatgttcccttattttattaattcttttagccttttataaacggatttagcaagtttttctgaaataaacattgctggaatttgactggtcatatcatcggaaaaattaacatgccattcattaatctgatagctaataaataaatcagataaaagagctgcttcagaactgggatttgccgtaatcacagcaatttttgtatccgcgttttttcgcataccatccattgcttcgagaacttcgctagtttctcctgacacagataagataataacaagtgtatcggcaacattttgaagttgcttggcaattggccaagaagcatcttgtaatgagaaaactccaggaactcccagatttgcaaggtaacgagtagccaaagtagcggttgctcctgaagctccaactccaaaaaataagatattttctgaatgtaaaatcatctcagtaagagcttctaatttttggagtaaatcgcttggataaatgtctatagataaagaattaaaaaagtcacttgatggttcattatctttctgtgtttgtttgacaaaatttttgaaatcattaaaggacttataattcattttatgaataagcctcataacagaagctgttccagcataagaacccgctgaaatttgtcgaatactggaggatggaatctcttttatatggtcttgtagatagttgtaaattgctttttctgttggtgttaaactggtaaaatccaattttccaaaaatgctcatatatggctccttaagtaagatatctaatgtttatgattagaatgaataaagtggtacattttataatttttcaatgtaaataggtaaatgctaacttttatttttttctgtgaaatgatagaattaagaaaaatttttatggagataaaaataaaatgctgatacaaaattgttttggagaattttttggtacttttttgatgattttgcttgggaatggggtagtttgtgctaatctactaaagaagacaaaatcaacaaattctggttggttaacaattattataggttggggtttggctgtgagttttgcaatttatgctgttcagttttactcaccagcaatacttaatccagccattgctctagtttttgcagttcttggacatattagtttttttcaagcatttctgtatagcatttttgaaattttaggtgcaatgtttgcatcaattatattatggatttatttttatcctcattggcaagaaactaaggaggcaagtgaaattttgtcatgtttttctacaattcctagtatacgtaaatcgtggtcaaattttatgagtgagtttttctccaccgccttgcttgttggcatgatattgacttttagtttttatcattttagcgccttagtcagcccactatttactggtggattaatcatggttcttggtttttcagtagggacaacaacaggatttgccttgaatcctgcgcgtgattttggccctagattaattcatagttggttgccaattgccaataaagggaattcagactggtcttatgcttggattccatttttaggaccgcttttaggtgctttagttggtatgggtgcttattggacattcactacatttattttgggaagttgaaataaaaaaattgaagacttaaaaagtttattgaatacaaaaaatactgataggattatccatcagtatttttgctataaattttttaaactttgaacagtttttgtctgtcataatcatattattactagaccacagataattcatgaattgtccgtccttctttatcgaccaattgtaaccagctatttgttccagcgaagtaaaggaaatgtcccacttcattgactgattttaagacaatatcctcagtagttgtgaatgttttagcatcccaattggctttttgttcttctcttaaagtctgtgtaaaacgataggctaaacctggtgtaccatcagatttcattccaccgctttcggcgatttttgctccggcttttatcacgagttgattggatttttcccaaataatggtcgctttactgtcggaatgattaacaaaaaattcaacttcagaaagtccttttttccagcgatgttgtgctttaggagaaaaagcttttttcttttctaatttaatgccaaaagcagttaaagcggtcaaaaactcgtcagcagaaatggcacaagctttttcgatattgcttggaattttaattggctcggctttatcacgtaaaataatgccagcttcctcagccaaattaactaaatattgcgttagatattccagctctaaatcataggcagccatatttaaaatcacgactttatcaaattctaacttaggaattaattctaaatcattggcaatcattttaatctgccctttttttagtaaaaagaatagctcatcattttgcaaatcaaaacgtgcgttattttgatcaaaaatacgtaaaaaggcagttgatggaagacgaatttctaaaccaaggtcagacatgctgaccgtaaaagttaaatttttcataactttattatagcagaaagtttgacagccttatcaaacaatacatcattaagctaaagtttggtatatacaaacaatataagctgtttttttgtattttataaaaaacaaatctttaaaaaaacaaaaaaatgtagttttataaaacaaagttcggtatttacgtacaatggtaactgttaacagaatatttacaaaaaggtcattgtcagataaattaaaatgggttagaattattttgtgaaacacaccgattcatcaaccgattgataaaaatcttaaggagattcatttttataatgaaaaagacatcgaagaaagtcattggacttacagcaagcgcactaattgcagtatcattacttgcagcttgtcgaaatagtagctctgcatcaaaatctgatagcaaaacaatttcaaatttaaagatttcatttattccatccaaaaatccggatgatattaccacagcgactaaaccaatcgcaaatattttgaaatctgaattgaaaaaacaaggctatacagtaaaaaatattgatactagtgttggtacaaattatcaagcggttggtgaaggactcgatgctggttcagttgacgtcggttatggaatgtcagcgacaacctatgccatgtatcaagatggttcaactccactcttgatggcaacacgtaagggactttcaaatgatgcctcagattctgcaaaatattggaatgaacataaaccaacaactaaaactgataaagaagtgacttcttaccgttcgctaatcattgctggtaattcgccaatgggcaaaaagttagctaaagaagccaacgacggaactttgacatggaaagatttaaacgatgcaaaatgggggcttgaatcaacttcatctgcggcaggctatatgtatccttcgcaatggttaactgataactttaaacattcaattcgtgatttaaaaaatacagttactatggattcttatgattcagcaatggctcaacttgcttcaggtcaaattgatgtaatgccagaatatgctgatgcacgaatggatgacgctgctaagtggaccacaactttcggtgcaaaagaaagtatttgggatgacacaaatgtgattggtgtgacacctgccattgccaatgatggaatcatggtttcagaaaaatcaaaaatcatgacggctgacttcaaaaaagcactctcaacagcaattaaagatatggctaaaactgatgaaggaaagaaagtcattgccatttattcacatgatggctatgttgattcaacaaaagccgactataaaacagccattaaagtggcaaattcaatgagtaaagccaactaatgaacaaataaatcatttaataagggtctgggttactcaatgagttccagactctttttgtggaaattgactaatattaattaaaaagccttcattagtgaagaaggatggagaagtaatgataaaatttaaaaatgtgtcaaaaatttatccaaatggcacaaaaggtttgacggatgttaatttacaaatcaatcaaggagaattcgtagctattattggaacatcgggagcaggaaaatcaactctgattcgttgtgttaatggtttaaatgatattacttcgggttcgttaattgtgaatgatacagaagtgtcaaaacttaaaggaaaagagttaagaaaatttcggagacatgtgggaatgatttttcaatcctataatttagttcctagagtgacggttttgaaaaatgtaatgtttgctcgtgtaccagatatgagtttatttaaggtcatttttggtttattttcaaaagaagataaactcgttgccttagattctctgaataaggtagggattttagataaagcttatatccgagcagatcaactttcaggtgggcaacagcaacgagtatcactcgctcgtgctcttagtcaagaaagtgaaattttactcgctgatgaacctgtttcagcacttgacccagtcacagctaaagaagttatggatgattttaaaagaattaatgaagaattcaataaaacaattttactgaatattcaccatgttgaacttgctttagaatacgcttcgcggattattgctgtaaaaaaagggaaaattgtttatgatggtccttcgcaagaggtaaccaaagaaattttggatgaagtttatagaaaagaggcctaaatgtacgataaaatttttaagcctaaaaaaataaaacttattacaggagaagttgttgaagagaaagtcagtcgaacttggttgacttggttaattatcatcttactgattgctttttctgttattcttacaaattttgattttagtgcgcttagcagaagtggtctcttttttcaaaaattagcaagtatgattcccccaaattgggcttactttcataaagttcttcccccattattagatacgattaagatgagcttttttgcttccttacttggagcaattttgtcagttccatttgcgatattagcggcaaataacatccttaaaaatcgttttgttaatggcatcattcgtttgatattcatgctagcaagaactttgccaactttggttttggctttaattgcaacctatatttttggtctaggaacttttgctggagttgttgcaatttttgtatttaccttttctttcataggaaaacaattgtttgaggtgattgaaactgttgatatgggaccttttgaagcggcagaagctttaggggtcagtcctttaaaagcctttttcattgctgtttttcctcaagtcctacctacttatctttcaactgcactttatgcatttgagggaaatgttcgctatgctgcaattttaggatatgttggggctggagggataggaaatatcttaaatgaccgagtgaattttcgcgacttttcctctgttggtatgattttaatttctattctagctacagtcatgattattgattcaatcagcgcattaattcgtaagagaattgcctaggaatgagaggaaaaatgaattcacaaattattgaagaatataatcatagacctaaaaactggttttattatcttttgatatttattgttttattagcagtttcgatttggtcgacttcagtcgtccattatcatggcgtttcagaacatggcgctttaatcgccaaaaatattttcacagggatttttcatccagataccagtttgatgtttaacctaactgaaactggtttaccttatctcttgctacaaacttttgcaattggtttgcttgggactttggttggtgcaattgttgccattccactctcttttcttgcagcgactaatttggttccgaattggttagcttatctgattcgttttgtcttgatggcgattcggacaattccttcttttgtttatgcccttttatttattccagtcgttggtttaggttcttcagctggtgtaatggcgcttggttttgagtcaattgggatgattgcaaaactatttattgaagctattgaagatttggatatgggtgttattgaggctatggacgcagctggtgcaacaacatttcaaaaaattcgttttggagttttaccccaattattaccagatttatattcgattttactttaccgtttagatatgaatctgcgtgatgcagccattttgggattagttggtgctggtggaattggtgcgccattgagttttgcaatgtctggttataaatggtcagccgttggtgcaattttgttgggacttttagttttaattatccttgttgaactcatttcatcaagaattcggaaaaaattagcaaagggataaataatatgaaaataagaattctagaaacgagtgatttacatggttttgttctcccaacaaacttcaccgaaagagaaatgaatttgcctttttcaatggccaaagccaaatctaaaatagatgaactgacagcagtggctcaagagcagggtgaaattattgtaaaaattgaaaatggtgatttattgcaaggttcacccttggcttattatctagctaaaaaatcaagtcgcggtattaaagacttggtcaatgtcactaattcttttggttatgatgtgggattgcttggtaatcatgagtttaattatgggattgattatttaaaaagttatgttaatcaggtaaattatccaattttggctgcgaatgtattgaataatgaaggtcaacctgcttttggccctgcttataaaaccattgaagcgcagggggtgaaaattggaattgttggttttttgacacaatatattccacattgggaaaaaccgtcaattatcaaagatttgactttccaatctattctgacaactgcaaaagatattctgcccgatttgcgccaatcagttgatcttttgattgttgcatatcatggaggctttgagcgagatttacagacaggtcttccgacagaaattttgacaggggaaaatgaggcttatcagttagttgaagagtataaagattacattgatgccttagtgactggacaccagcatcgtgaaattgctgaccatctttttggagttccagttattcaaccaggctatcgtggtgcttttgttggcgaaatagaacttgaattagataatcataaaaaagttgtggcttcaaacgctagacttcataaaacggagaattgcaaagtctcatcggaggtcaatcagctgatatctgatgtcagtacagaagcagaggattggttagaccagccaatgggagaagttcatggagaaatgattattcgtgatccaatgactgctcgattgattgaacatccttatattgaattaattaataaaatacaaatggaagcgacagggactgatatttccgggactgcactttttaataatgaagctaagggttttgcaaaagaaattacgatgagatcgattctgacaaattatatttatcccaacactttagctgttttaagagtgacaggtgcagacttaaaggctgccttagagcggacagcggaacatcttgaacttgacaaaagtggcgaaattgtttttagtccacgctttattgaaccaaaacctgaatattataattatgatatgtatgaaggagttgaatatgctatcgatttgcaaaaagaaattggtcagcgaattgtacgtttaaatttcaaggggcatcaggtaaaagatgacgaaattttagaaattgtcgtcaatcaatatcgcgcagttgggggtggaaattatccaatgttttctgcggacaagattgttagagaaattactgttgatatgaccgaattgattgctgattatttgaagaaacatccgataattgaggcaagtgtgaatcataacttcacagttctaaaataaatttactgacagaaattttagcagaataataggtgctaaaaaaatctgtcagtattttttttattaagttatacttgagaatgagctaagtttttctaaagtttttactgatatacttttatttatcaaaaggaggagcctagcatgaaacatacagtaataattccaaaaatcaattatcaatttgtgaaatcagaagatgactcacttttacttccaagtcctttagaaagtcaatatttaacagtaaaatatgagcaataagagccagatgagttgagattctatgataaaatgaagtcataaagattaacaaaggagcattaatgacaatgaatatcacatctcatggtgaaaaaatagcaacaataaatccgacaataagtggtgatgcacctgattttgaactgacagatttaaaaggaaataaaattaaattatcaaaacttgaaaaacctgttttgattagtgtttttcctgatattaatactagagtttgttcacttcaaaccaaacattttaatcttgaagcagcaaaacattctgaaattgactttttgagtatttcaaataatacagcagatgagcaaaaaaattggtgtgcagccgaagatgttgacatgacaattcttgctgatgatggaacttttggaaaggcttatggtcttattttaaatggtggtcctcttgaaggacgtcttgccagaagcgtctttgttataaaaaatgggcaaattgtctatagtgaagttttgtcagagctttctgatgaaccaaattatgaaaaagcactagcagctactaaatagttataaatgacaaaataggggataattgcaattgatgcttgtcttctatttataagctgtcaacaggcagcttttttagtagtaaaaagaatagatgtaatttttctttgtactcgaaattttctattcaatttgatataattagattaatactgaatatttaggagaaaacatggctgtaaaacgtttaattgaaacttttgttccggaaaattataagattttcctcgatattgaccgtaaaaccaagaaaataaatggtcaagtggcaattactggggaagcgaaagatagtgttattgcctttcatgccaaaggtttacactttaataaagttcgtgcttttagtgtcgacacaaacttcattgaaaatgaagaagatgaagaaatcgttgttaaaattggtgaaacagggcgcgtgactgtttcatttgaatatgaagctgaattgactgacaacatgatgggaatttatccttcatactatgaagtcaatggcgaaaagaaaatgctcattggtacacaatttgaaagccactttgctcgtcaagcctttccttctattgatgaaccagaagcaaaagcaacctttgatttgtcagtaaaattcgatgaagaagaaggcgacattattgtttcaaacatgccagaactcttgaatattaatggaattcacgtttttgaacgtactgtcaaaatgagttcttaccttttggcttttgtattcggtgaacttcaatataaaaaaggaaaaacaaaatctggtgttgaagtaggtgcttttgcaacgaaagctcatagtgaagctgcgcttgatttcccgcttgatattgctattcgttcaattgaattttatgaagactactataaaacgccatatccactcccacacagttggcacattgccttacctgacttttcggcaggagcaatggaaaactggggatgtatcacttatcgtgaagtctgcatgcttgttgaccctgaaaatgcaaccattcaaagcaaacaatatgtagcaaccgttattgcacacgaattggcacaccaatggttcggtgaccttgtaacaatgcaatggtgggatgatttgtggctcaatgaatcatttgccaacaacatggaatatgtttgtatggatgctttggaaccaagttggaacgtttgggaatcattctcaatctcagaagccaatatggcgctgaatcgtgatgcaactgatggagttcaatctgtccacgttgaagtgactcatccagatgaaattggaacgctctttgacccagcaatcgtctatgccaaaggttcacgtttgatggttatgcttcgtaaatggcttggagatgaagattttgctgctggtttagcgctttacttcaaacgccaccaatatggaaatacagtcggagataatctttgggatgccttggctgaagtctctggaaaagatgtggcagctttcatgcattcatgggttaaccaaccaggttaccctgtcgttactgccgaagtcattgatgatactttagttttgagtcaaaaacaattcttcgttggtgagggtgctgataaaggacgtttgtggaatgttcctttgaatacaaattggtcaggattgccagacttactttcttctgaaaaagttgaaatttctggttttgctgctttgaaagcaaaaaataatggtaaagccctctttttgaatgatgcaaatatggctcattacattattgattacaaaggacaattgttgacagaccttctctcagaagttgagactttggagaatgttactaaattccaaatcttgcaagatcgtaaattattggctaaagcaggtgtaatttcttatgcggatgtcgtaaatatcttgccggcatttactaatgaagaatcttaccttgtcaatactggtttgagtcaactcattagcgaattggaactttttgttgatgaagattcagaaactgaaaaagctttccaaagtctggtaggaaaacttttcgctaaaaactatgctcgcttaggttgggataaagttgctggtgaatctgctggtgatgagagtcttcgtggaattgttttgagtaagactttgtatgctgagaatgcagatgccaaagcaaaagccagtcaaatctttgcagcacataaagaaaatctagcaggaattccggctgacattcgtccaattgttttaaataatgaaattaagacgacaaattctgctgaattggttaaaacttatcgtgaaacttatgttaaaacgagcttgcaagaatttaagcgtgagcttgaaggggctgtcgcattaatcaaagatgaaaaagtcattactgaattgcttgaaagcttcaaaaatgctgatattgtgaagccacaagatattgctttctcttggttctaccttttgcgcaatgatttttcacaagatgctgcttgggcttgggaaaaagcaaactgggcattccttgaagaaaaattgggtggagatatgagttatgataaatttgttatctatccaggaaatacttttaaaactgctgataaattagcagaatataaagctttctttgagccaaaattagaaaatcaaggtttgaaacgttcaatcgaaatggcaatcaagcaaatcacagcacgtgttgctttgattgatagccaaaaggctgacgttgataaatcaatcaaagaaatttctgaaaaattataataaataaaaaatcaccttaaaatcacctttttgaggtgattttttttattcattcttggtctgactttgtttttgatagcacaagtagagcgataattagaaagataaatcccatgagtgctggagcgaaatgaccaaggctgatatagatttgtccaccaattaaagggcctatcacgcgagtaagtgcttgaagtgcttgacttccaccttgaagtttaccttgctcggaagaagtcgctgattttgaaagtttaccgttaaaggcagttccaaaaatactatctccaaaagcaaagataaacattgccagaatgaagaagggccacattttagaaaaagcagaaagtgcgaaaagaaggtaagcaattatttcgcagactagtgccaaacggatgagtttatcttcattagctaattttagaagtcttggcatgataaagatttgagtcaagatatccattaaacccatgatggatatggctagaccaattaatacaggcgtccaagcaaaagaatctaatgaaaattgactaataattgcttggagtgcaccatttggtagccaaagtaagataccggcaaagagcagacgattgagatttttcatgcgtaagagctgaaaaagttgagtgaaaggattgagttgtttaagggaaaaattacgtgtgcgatgagtttcaggcaagctctcgttcattacgaatgcaccgtaaagaagattggcgattgagatgagggcgccgaagtaaaagggaactgaattgccaaaatgagctagaagtcctccaactgtggggccagaaattgttccaacaccaacagcggcggctgtccaaccaaaaactttagttcgattttcttcatcagtaatatcagcgaagtaagcaaaaagggtcacgatatttccaccagttaaaccatcaatgattcgtccgagaaaaagcatccagagactaccagctaagccaaagataagataaccgagagcagagccagctaaagaaatcagtaagataggtttacgaccaaagcggtctgataaagaaccaagagccggagcggcaaagaaagtacatagtgcatagattgccattaaactagtgacaatgagtgcttggtcatgagcattagcaaaaggtgcgaccataaaaggaacgactggtgagatgattgtaaaaccaagtcctgtcaggaaagtggtgataagcccaaaagtgagggcgtgtttattaattttcataggtaaaacctccataagatatgagcccgactgggttgaagcgatgaaatttagaaaaattggtggttctgcccagcaggcaggttcaaaattttgtctttttcataaacttctagcactctgaactcaagtacaataattgatgatgatttcttaggaagttttttgcgcagacttgcgtctgctaaagtgaaatctatagacttgtgatttcacttttctacacggtttcctcggaaacaaaaatagtataccataacattgtttccgtgtcaacaaaaaagcaaacaaaaaaactgtcagtaaaaattaatttactgacagaattatttttcaatattattccggatagcagaatcaagatgattattgtatttattgaggaattctaaaatattgttgacagactcatcagttaattcatcgaagataacttgatcattttctgaaaatttttggtgcaaactttcgtgacggtcattaatttcttgaccctcttttgttaagcgaaaatagatttcctttttattttgaggaatttgataagattcaacgagattttttttgagcagttttttagcgattttactggcagcaccgcgtgtcatgtagagatgatgagctaatttggtcacatttggataaggggttttagcaataaattcaatcgtttcaatctctgataacgaaatatttgagaattcagcctccatttgcggcttgtaataggcatcaatcttattaaataaatcagttaaagaagtcataatttgttcctgattttgctgaagattggtcataatcacttttcctctctttttaaagttgtctgtctataaatacagcgccaatagtcattgcgtcgccagatacttgtaaccacaaaattttgttcatttttccagtaatcataagttaaaataaatgttttcttgctgacttgtgaactactatagtgatttattgctaatggaattactgacagacttgtcaatgaatttttagagtcattatttttactgacagaattttcgtcagtaatttttgcaaaatttttcaatttatcagaagcactgatgatttttccatcagcaagaatttcttgaaaagtgctgtcagttaatttgtccaaattttccagatttaaaaactgttcttcttttgccaaaagttcaagtgagcgactggcgtaatgttcctcttcaggtaaggcagcaggttcaacgtggacatcaacatcataaacaccataattgtcaattaacattttctcaatgaactcggtcgcttcatgactctcgaaaacacttaaatcaggagacatttcaaccactacatcaaggaaaatattacttccataagaacgacctcggacaagcttaaccccttttacctttggaactaagcaaattgcttcgcgatattcttcaacaagattttcatcaaaaccatcagagagactaaaaacagattcatggaaaatatcataggcagtctttaaaatgaaaccacaaataactacagccatcgcagtatcaagccactcccagccgatgctacttgctaaaatagcaaccacagttccaatagaagtcaccgcatcagagagattgtccttacttgctgctgacagcgcttgtgagttcgtttttttagccaatgcccgattataaagataaacgcccagcatgacaaaagctgagaataaaccaacaagagctcccagtgggtctatggcttcttctttaccagaaagaagtgtcataactgtttctcttaaaacctcaaaaccaacgaaaaacatgataaaactagaaattaagctagcgattgattcaattttccagtgaccataaacatgatcactatctgctggaatccgagcaagtcgaagaccaatcaaaattgcaatatttcccataatatcagtcacgttgttaaaaccattagcttgaagagcactagaatgcacaattgctgcaaaagcaatttgtccaatggataaaacaatataagcgataatagaaacccaaactcctttttcagcgagtttcagattgtttgtacttgaagctgccatatgaatcctcccaaatttacatcattccattataacaaaattttgaatgaaagtttgtatctattgccaaaaaacgcttttataacaagggctcacaaaatataaataaaaaataagggctgactaatttatataaaaatacccactttctactatattaatgtattagaaatcagtcaaaaataaaataattatataaaaagttcaagtaccttgacttgcatagtaatgtgaagtataatatactttgtttaaaatgatagaaaggaaaaagaatggcagaaataccaaaggaaatgttacgcgcccaaaccaatgtcattttgctcaatgtcttaaaacaaggggataattatgtttatggcattatcaagcaagtcaaagaagcctcaaatggagaaatggagcttaatgaagccacgctctatacaatctttaaacgacttgaaaaggatgggattatcagttcttattggggagacgaaagccaaggtggtcgtcgtaaatactaccgcttgacagaaattggtcatgaaaatatgcgacttgcttttgaatcttggtctagagtcgatgaaattattgaaaatttagaagcaaataaaaaagatgaatctaataaataatttccaattaaaatttaagttactaaataagggatgaaggtaaaaaatattcgtcgcaaattgttgacttaaactttgaaaagcgttacaatatttttgttagtttatcttttgtgaaactaactattgtaatatttaacagcattaacaattaatgcttgtttactaaaaaaaaataatgttataattattttctcaaaaaatttattgaaattattttgaagtaaaatgaaattgaaaattcaatttaatgtaaacttatttacattatttaactctagaaaggaattttatgattttcaaatcaatcatgaagcataaatgggttgccttattctcaatcgtttcaacctttatttatgcaggagtacagctttaccagccccaaatcatgaaacgaattatgaccgtaatgtcatcaacaacttatagccgtcatcaaatggctgacaaggtttcaggatatggagttgagcttttggttgttgctgggatagggataatttttgctatctttagtacactttcagcggcacgtattgcccaagaaattggagcagacgttcgtgaagcgacttacaaaaaaatcaatacattttcttatgaaaatgttgaaaagttcaatgccggaaaccttgttgttcggatgacaaatgacgtcacacaagttcaaaacttgatgatgatggttttccaaattttgatgcggattccagtccttttgattggtgcggttgttctttctatcacaactcttccaagattatggtggattacagttcttttaattgttttaattgtattagttacagccgttttaatgggacgcatgggccctcactttatggctttccaaaaattgatggaccgtattaacgccattgctaaacaaaacttgcgtggttcacgtgtcgttaaatcattcgttcaagaaaaaaatcaaatcaaagaatttgatgaaacttctgatgaactttacgatcataactgggcagtaggaaaactcttctcagcaatgattccactctttactgtgattgctcaaggagcaatttggcttgctatttactttgtttcaacttttgtaacagagtcaacaacagttgcccaagatagtattggtgggattgctacattcatgacttatatgggaatgattatgtttgccattatcatgggtggtatgatttcaatgtttgcttcacgtggtatggtatcaattggacgtattaatgaagtgttaaatactgatccagccatgaaatttgatgaaaatgctaaagacgaagttctttcaggttctgtcaaatttgaccatgtgtcattctcttatcctaatgatgaagaaccaacacttaaagatattagctttgaagtagaacctggtcaaatggttgggattgtcggagcgactggtgctggtaaatctacattggcacaattgattccaagactctttgacccaacagaaggtaccgtttcagttggtggaaaagatcttaaaacagttagtcgtggaacattgaagaaaaatatttctattgttcttcaaaaagtcattctcttctcaggaacaattgctggaaatattaaacaagggaaagccgatgcaactgatgaagaaatgactcgtgctgcacgcattgcccaagccgcagaatttattacaactaaggatggtcaatatgattctgaagttgaagaacgcggaaataacttctcaggtggtcaaaagcaaagactttcaatcacacgtggagttgtaaaaaatccaaatgtcttaattttagatgactcaacatcagcccttgatgctaaatctgaaaaacttgttcaagaagctttgaataaagaccttaaagacacaaccacaattattattgctcaaaagatttcatcagtggttcatgcagataatattttggttcttgaccaaggaaaacttgttggtcaaggaactcaccaagaattagttgctgagaataaaatttaccaagaaatctacgacacacagaaagcacaggaggactaagacatggaaaataccaaatcaacaaaaaaaatgtctgacaccacacgtgccatccgttttttttacctctatctcaaaaaatataaacttcaatttgctgtaattatgattttcatcattgctgcaacttggcttcaagttattgctccgtcacttttgggggatgctattacgaacttgagtaaatatgttggggatttctttactcatcaacacgctgatgatgccagaaaagccttggaacaaatggctcaagctttgagtcaacaaactcaccaaaatattacatggcaacacgttccagaatttgctaaatcattgccacaagctgcccaagaacaattgacttctcaattaccaaaagggactactttgcaaagtctttacactgttgcaacttctcatgcagcaagcacagggaccttcatgaaaggaatgtggcaattgcttgcggtttacatcgcaactggtgtgtcaatgttgatttataccctcctctttagccgtatcgttgctcattcaacaaatcgcatgcgtaaaggtttgtttggtaaacttgaacgtttgacaatttcatattttgaccgtcatcaagacggggacatccttgctcgttttacttctgacttggataacattcaaaatactttgaaccaagcgcttgtatcggttgtttcaaatgctgccgtcttcatcggtgtcattatccaaattttcaacaaagatattacttttgcttggttgactgtggcggcttcaccagttgctattctatctgctgtgattatcattcgtcaatcgaaaaaagcaacagacaaacaacaagaagaagtttcacaacttaatgcctatatggatgaaaaaatctctgggcaaaaagcaattatcgttgaaggattgcaagaagattctattaatggtttcttggaacacaatgaaaatgttaaaaaacgtacctttgctgctcaagcatggtctggtatgattttcccattgatgaatggtttccaacttttatcaattgccattgttatctttggtggaacggcctatgttcttaacgatgatagcatgtcaattgccacaggtttagggcttttggttgcctttgttcaatacgttcaaagttactacaacccaatcatgcaaatttcatcaaactttggtcaacttcaacttgccatcacaggggcaactcgtctgaatgtcatgtttgatgaaccagaagaagttcgtcctgaaaatggtaagaaatttgatacgattaaagacggaattcaaatcgaaaatcttgattttgaatatcttccaggaaaaccagtcctcaaaaaagttaatattgatgttaaaaaaggacaaatggttgccctcgttggtccaactggttcaggtaaaacaacagttatgaacttgatgaaccgtttctacgatgttaatggtggagcaattaaatttgatggaactgatattcgtgaatttgatttagatagcttgcgttcaaatgtcggaattgttttgcaagagtctgttctctttgatggaacgattgctgataatatcaagtttggtaaaccaaacgctactcaagaagaaattgaaacagtggctaagacaactcacattcatgatttcattgatagcttacctgacaagtacgaaacacatgtttcagatgatgaatcagtcttctcagttggtcaaaaacaacaaatttctatcgcacgtaccattttgacaaatccagaacttctgattttggatgaagcaacttcaaatgtggatacagtaactgaacaacaaattcaatgggcgatggaagctgctattgctggtcgtacttcattcgttattgctcaccgtttgaaaacaattcttaatgccgataagattgttgtccttaaagatggtgaagtgattgaagaaggaaatcaccatgaactcgttgctcaaggtggcttctactctgaactttatcacaatcaatttgtttttgaataagagattattcagttaagcaatggaaaataaaatcacagttaaaattttagctgtgattttttatttagataaaaaagtctatgaaaaactactataaaatgttaaaatagagagcggttcttaaaaatataatttttttaagacaataaaaatgtgaaaagtgattttgaaataatatgaaaaaaatagtaattaatggtgggaagcgtatttcaggaaccatcccaatttctggcgcaaaaaattcagtagtcgctttgattccagcaactatcttggctaacgatgttgtaacgcttgaaggagttccagatatttctgatgtcgcaagtttagtcgaaatcatggaaattatgggagcaaaaattgaacgaaatcttgaagaaggacgacttgtgattgatacacgcagtgttgtttctcgtccccttccttatggaaaaatcaactctttacgtgcttcttattatttcaatggggcacttttgggacgttttggtcaggcaacagtaggcttgcctggtggctgtgatttaggacctcgtccaacggatttacatgataaagcctttaaagctctaggggctaagaagattcaagaagaagaagctgagcacttagaagtgattggtgattcattagttggaacaaccatttatatggatgttgtttctgttggggcaactattaatactatgcttgctgctagtcgtgcaaaaggtttaactatcattgaaaatgctgcccgtgaacctgagattattgatgtggcgacacttctaaataatatgggcgcgcaagttcgaggagctggaactgacattatccgcattactggagtggatgaaatgcacggtgctcaacatacggtgattcctgaccgtattgaagcgggaacttatcttgccttagctgctgctatgggagatggtgtcatcattgaaaatgttatttatgaacacttggaatctttcattgctaaacttgaagaaatgggtgtaggtttgaccattcgtgaagatagtattgaagttcataaatcagaaaatctaaaatcagtcaatattacttctgttccttacccagggtttgcgacggatttgcaacaaccaattacaccacttttattgaaagcaaaaggtcgtggttcgattgttgatacgatttatcaaaaacgtgtcaatcatgtccctgaattagctcgtatgggtgctaatatttctgttttagatgatcgaattatttatgacgctcctaatgaattaactggtagttgtgttcaagcaactgacttacgtgctggtgcggctttggttactgctggaattattgccagtggaactacaaaaatctctaatattgagtttatcctacgtggttatgaccacattattgaaaaattgactgctgttggtgtagatattcaattgattgaagagtgacaaaagtgatttattttcgtatagactaatgagaaaggaaataagatggctgataaattaaaatttgaaatcattgaagaattgattgttctctctgaaaatgcaaaaggttggcgtaaagaattaaatcgtgtttcttggaatgatgctgaacctaaatatgacattcgtacttggtcacctgaccatgaaaaaatgggtaaaggaattactttatctgaagaagaatttggtgttctcttaaaagaattaggaaataaataaaagccctgagatttcagggctttttaattttttaatgctcggtctcaagagagttgaaaagtttaaagacttcgctataagaatttaaaagagaagaggcctcatgattctcaggatttattttcaactcatataatgctttcaaatagaccgtagttactttttcgtaaaaaaataaatcactcttagtatgtgactcaagatatgtaaaaagcaaggggagagaatctaaaaaattattttctataaatatgggaatgaggcgaagaattatcttaagaattttaggactgataaagtctaaatattcatcttcagcggatataattttttgagttaattgctcttgtgttttattatcaaggagagaaagacaagagctatacagataaagttcataggcacagaatttattaattgaaagcagatattcttttagatagagagtatcttttttatttacttgaatattagggtcaatcagatggagttgggatttgatttggataatattgagtttgtgacattttatactggggtgaagcgtaagcaagtcggtctctattttaaggagctgatgaagttttctttatcttcaatttcaaatttttgacaaaagtcataattaaaaagagggcctttagataagttagaaaaataggcttcatgataaaattcctcaagactgacattgattgccttaagactactaagaaactttgtaagcgtcatgtccgttttccctctttcaaatttggaaatttgagcataagaaatatcttcgctagccacttctttaatttccatatttttaaattttctcagccttctaaaggttcttcctaagttagtatccataactttctccatatgttcatatatgattatttttgtttatttaaagcgttgactttaatgttaataatattatataataatttcataattttcagttaattaaagtcttttgattttatatattgaaagaaggtgggtccaatgcaggtaaaaattgatgcacataaaaaatcatttcttggtattcgttgaaaaggagaaccattaaattagcttgatattactatgaaaggaactaaaagcatgaaaaataaaaaagaagaacaaacacaagatgatgagttattgtttgaagaagttgaagattttgatatcgcattagaacaaggttgtggcgatttcgagattttatgatagttaaaaagcactctaaagttatactttggtgtgctttcttataaaagtggaggtaaaattgatgataataaatccgtttattgagattgaaccaaaggagaaagagtggattctttcagactacctacatagacaaagatatattatcaatagaaaaactattatagttataattgattttatacaaggaaataaaatgtcgaagaaagttaaagagttactaattaaaagaggaattcttgtcgatgaggatgatgcggaagtaaaatatttttatgatattaaaaagagctgggaaaaatatgggtggattgaatcttttaagtatcatatcgcaacacttgactacccctttcagggaaatctaaaaaaagctagtttaaaaatggaacagtatcaactagaggaggcagataatcttcgtgagaagcaatacagtccagaaaaaatattaaaaatttattctcttcctaaggtaaaacgtgagcaaaaatctagatttgaggctagccttgaagattcttttaaaagaaaattattccgtatgctttctatgactttcggttatgttcaagaagcaataccggaatggggaggaaaagaattattatttagaactataccaagtggaggagcaaggcaaccaagtgagggatatttatatgtaaaagatattgaggaattagattccggttggtactatataaacggaaaaaagttcactcttgagaaaatttctgattatattatcccaaatgaaatatttgaaaagtcttactctttggctgtgagcaatacagatataaatattcgagcaactatcatattaacatcagtatttgaaaagaatatgtaccgttatagagaatcaagaacttttagaagtattcatatggatattggctttttgttgggggcattagaagaattatcggatgaatcagagattgcctcatttatccagtatggacttccagagagctattttgaaggtgttttaggattaaattatctcgaggaaggttatcaggctagtatagttcttggggaaaggaagaattgatgaaaattaaaaagtggtatgctacaacaaaacttagcttttctgaaggcagagcaaagattaatatcccattgaaaaagaaaagttttgtgacagacttggattctcttaaagaaattctgaacgattacgaaaaagaggaaattcaaactaagttatctaaacaagaaattgttatggaaaaagaattagaggcctacataagtgacgggcttagccattggaagaatagaaaatgggagccagcactagatttgtatttatcttcaaggaatattagctatgcagacaaagatgatacaactggtaaaatcagagagaaaataatcaaaaaggactacggtacacctgtatttattacaagcgctcatacattcaaaaatacaattttattagattatattgattataaagaaacagaaaatttttatgatatgatacttcggcgcaagagtgttagagattttgataaattaagcaaactatcggtagataaatttaatatttttacacttgaaggaactaaaaaaataaagaaaactagagaactgatgattaaggagggaaatttattacgcagttatgcaagcgctttcagtttttattttactatttttaatgttgaaggatttgaaaatggaaattattttttagatattgaaaattcagcaatgtcattaattaaatctggagatttttctcacaaattacctgaatacttgggagaacaaaatttttcaaaaagtgcaaattttacactacttttagtagctaattttggaatatatcaatggagatataggcatgaacgcgctttacgcaacttatacatcgaagcaggaagagtgttagaacatttttctattgccggtttaaaggtgggtttacaaggagttgtaactcctgaacttgctgatagaaaattaggagaatttcttgatttaaatttaaaagaggaattacctatttgcagttatacatttggagctgagagtaatgattaaatttcaacatagttacctcatagcattagaaaatgattctatactttttttctcacaatggtttcgtaaggaatataaacttaccacaagctctaatttaaaattgtatgaaatcctttcaacgttacaatcagggtttttttctgagaaaaagtttcttaaaataatgttaagtgaaggctatagttctgattttggttataaattgttgaggattcttttagacaaaaaaattctaatttatactcatgaaaaggacaaggaatataggggacgatatggaagacaagaactattcctagacaattttgagagagattatcaaaatggagagtatttgaataatgaattacaaaataaacgagtggtaatagttggtgtgggaggttatggaacatggacagcaatgttgtttgcgagaatgggggtaaagcatattgctattgtggattcagatattgtagaagaatcaaatttaaatagacaagtattatatgattttgcagatattgggaaaaagaaggttgatgtttgcaaggagaaaatagtagctattgactcagaaataaaagttgaggtatttgatgagcatatatcatcggtggaagagttattttctatagttgtggatgctgatttggtaatgaattcttttggttatttcccacttgatatggagtatggtaaaagttcattttatgtaaatgaagcgtgcatgattaaaaaaattccatgcttaaattacaatggttcttgggttggtccgatatttgaaggggaaaattctccttgctatttttgtatgatgcaagataaagaaattataaaaggggtaaaatattctttaccagtaaaaaaggataaatttttagcagcttttgcacctagaatgtcatatagttcttcaattgccgtttgggaagcagtaagatttctattaaatctatctgctataaattatctgaaagacaatattattgttatagacactctttattatgataaaaataaaatgattaagataaaagcagtagacggttgtaaatactgtaaaaaaattcagtaaagaaagtcaggttggatatgaaattaatactaaagatggtattcccgatgtttttatctacggcaataaattttattttatcctttattgacacgatgattgtagggcatctaggaattgaagaacttggagcgactgcggcgggtagttccctatattctatttatgttcaagttgttggggcattaatcattggctttcaagttctgggagcacaagaaattgtcaagaaggggaaaaatcggttgacagattattttcaaacaaccctctttttgatgtatattatctctattatttttatctttatatcattaatcttttcaaaacaactattatggatgttttctacaccatcaatcatagcaggagcacagacttacttttttgcccgtctgccggctcttttaatattgcccctttcgatctgtataaaaacagaatatgatattcagaaaaaaaccaaaattggtttatactatactatcgttgtcgtactgacggatattattttggatgtagtattaatttatattgttcatttgggagtgtttggagcaggattaagtgacacactagcgatgtttattggtttaatatttttactaatgagaaataatcaagatgggatagtcaaatttcagcattttattaagttaaaaaaaatagaaagaaaactcatttcagaactgaatgaactaaatttgccagaagttgtgaatatgttgcttgattatttaggaacctctgtattgtttataattattagccgcattagtgtgttagatattgctgccggaagaatttctagtatctatattaaaattattttttcacttgcaatcaatattggtacagttgttcaaattttattagtaagaaatgcattagagatgcagtcaaagaagtatatcatgaatgcttttaagttatcggcaattattcttgttccatttactgtggtggcgatagtagttcctcaactttttattatcccttttacaaataacatttctctaattaaactttttaattctcctatgagattactatggttcgtgttactattagttccagcaatcacaatcatgactggaattctacgttcgaagaagagaaacaaagaaaacatgtacgtcaatgttttttcaacatggttattacaagttccggcagcttttatattctgcataatattaaaaattggaatttggggatttgtgcttagctatttatgttatttcttaggaagaattgttgggaatctattctttttgattaaggaaagtagaggtagaacaaatgaagtattggaatgattcttttttaaaactaatcaaagagttagaaggggttgagataacaaatagaagcacttcattttccgtttgggcgcaacaagaagtggggtttcatgataagtattcagattccgaaaaccttgattattcaaataaaattggaacattaataaataaatttgaaattagtttaataaaaaatgaattttcggcaattgaatgtgaaatagtcttctatcttattaagtcactaaaagaaaaaatgaataaagaggtaactgctcatgtcatacttgaaacgatgtatatgagtttgtttagaatttctcttgggcaggatatattaagagtgaaagaagcaatgataaatttagattccttattttactcacttaaaaaatataactcccttaaaagaggtgatataagaatactaaactcaattatttcatttctaaatatcactcaattctcctatgaactattgactgaaatatctaaatataaaagtaggctatcgatagttgagagggatgaaaaaattatgcttgaatttaaggatatatctgcaaagagtgtcagaaaaagtctaatttcttatctatctcatttgaaattggatagaaaaatcgaaatatcgggcaaaaacggttatgatttctttcaagaaaatatcactaaatattctcaacagcataatagttctatgaaattaggcattgtttctaaagagtttgaaattctcattccagactatgggttcttttcaaaatacttctttaataaaaagcaacatctatttattatgaatcaaaaggtagctaagtcaactatcaacaccaatcaattagaattgatttatgctcatgaaatatttccaggacattttgaacatattgatagtggttttagtaacaaatttaacttattactaccatttattactactaaggaaagtttagaaggttgggcgctttatcaagaatatttgctttctaaaaagtcagaaggtcataaatatagttacaatttgcaaatggctcgtagatatacaacagcgctttttactctaaatacaatgggaggattaagtaagaatgaaaataattgtttttttgaacatttaatggaaaattttcaagtttcggaaatggttaaattatttttattaagagcaaggaaaaatagtatggtaacggtacgttatatttcaggatttcaacaagtggtagagatgtcaaatgaggagaaggattttgttaaaaagtttggaccaatagacttagaactagtaaaaaagatagtaaaattctgattctgcctttttgatgttgattgtattattggttggattttattttgtggatagagcggataagggaaattatatttattgaatttttagaagaaagtggagatgatatgagaaaatttaaatcgtattttttgttgctttttgagggattgaaaactttttctaaagcgaataggtgggggacttttgtgcttgttattttggttccgattgaagcacttgttccgacagggattattttttctattcaaaaagtaacaaccgaactggctaaaggttcggttttctcgatgagttggggaattttttgggcagttttacttttgatctcaaatattattccgccagcgacaacggctatttcaggttatttgacggacgtcttgattgcaaatattaaccaaaaattaatagataaagcaagtgaaatcaagtcattggaagtttttgaaaatgatgaattttataatgatgtggaaacagttaggagtgaactttcttggcgaccagtaaatttaattgttttcaccctttccaatgttcgttatattatttctttactttctttgcttgttttactttttaactatacttggtggttacctttagcaatcgtgattgttttagtacctcaaagtttaattcattatcgaattcaacaggaggcttttgaaactttggtaacaaggcgaccagaagcacgtaagatgaattatctactagaaattgccttaaatcgtgattatgctaaagagagtcgtcttttcaatgttttttattttttgaagaaacggtattggaaactcttttacacggtacataaggaagaaaatcggatacgtatgcgacaatttggaattgctttgatttttattattataagttcacttgtatcaatgttcgcttttatttatcttgtatttcaagttcgttcaggtaaattatctcttggaattgtcgtaggttttgcttcaagtttggttgcagcaatttcggcctcgaatggcctagtagaggaatctgacctgctttatgatactttgatgtggttggagaaatatcttaaattgatgagaaagtcattcactgaatccggctataaaagtattactgaaatcaatcaaattagtttagataatgtatcctttgcctatccaaaagaaaatcaaaaagttcttaaaagtatttctcttgggattaaaaagggggaaaaaatcgctattgtaggtcagaatggttccgggaaatcaaccttattgaaattattagctgatttatttactccgacaagtggtcagattttaattaataatgaagatttaagagaaataaagcatgaagactactgggcaaaaatttctcctgtatttcaggatttttcaagatttaaattttctgtcggagattctattagttttgaagagaaaacaggagttgatgaagctttacaattttcaggattgcctgatttgaattcagaacttcaattgggcaaggagtttggtggaactgatttgtcaggaggacaatggcagaagttagcaattgctagagctttttataaaaataatgtggaactgtatctttttgatgaggctaatagtgcacttgatgtgcacagtgaaaaacaactctatcaaaaattgatggagctgtctgctggagcaacagtaatttggattactcatcgaatgacttcagtcaaattatctgataaagttatctacttagataaaggcaaggttttagggtttgattctcatgaaaatctgttaaaaaatgaaaactatgcgtctttgtatcgagaacaatttgaataaaaaaactgctcattacaatcgggcagttttttaatgggtaaatgttatcacaataaggataagataaataatcaaagtaataaagaaggtcaagcgccaccagagttttaaaaagcgacgataggtaaattgtttataataaagcaaatcaagcaacaacaaaacaagcgctaagccagaaatgattagcaggtagtatggaatgatgctgatacttgtaacatttttagaaaaaatttgcatccctaagatgagaaatattgtaaaaacatctggaatttttagtttgcgattggttaagtgacgaagtctaaaaaacttgaaaatgaaaaccaatgcaataaagacaataaggggataaagcgccataagtacttttataaacatagactaattgtatcggttttgccttagtttgtaaagtatttatttgtgtgagaaagtgcacgaataagtgctaagccaaagatagtaacaaggacagctttaataatttcaacaatgacaaatggtgtgaatccaagctttaaggccaatgaccagtcgacattggtaaaaaatttgagccacaatgttccgataactaacataagcaggtgtcctacagtatttatgataaaagcagggatggtcttataattaatttgatgaaggccaaaagaaataagggttcccattattaaaaaggcaattagaaaaccacctgttggaccaaaaagaaccgcaattcctgatgtccctccagtgaatacgggaattccaataaatcctagcaggagatagagtaagatagcaaaaaaagtttcacgcgcttttagtactgtggcaacaagtcctacggcaagtgtttgtaaggtgacgggcacaataccaattgggatagacagaggagatagaaccgcaataattgctgcaccaagagcaattagggttaaagaatataattttgtattttgcattaagaatcctttgttttatgtataaaataaaatatactaaaaaagaagaatttttgcaaactcttgctctaataaacaaaaaattactgacagaaattctgtcagtaattttattctctaatttcgacaaattgagcatgaacaaagtcagcgagaactttaggagcaatttttatgctacgcccaacttcgccagctgaacaaacgataaagtcgtgctctaaggcaatagaatcaatgaaaattgggaattttttattttgccaaatccccacaggattatttgcaccgtgaatataacctgtcgttttttgcaagtctttttgaggaatcatgcttacttttttattgcccgaaactttggccaattttttttctgataaatgctctgtcagtggaagaatgccaatgacagggccagttttatcgccgattagtgctagtgttttataaatatcactgcgactgatatcctcagggaggctattactttctaaagcgttaatagcaagtccagtatgctcaatttttgccttatcaagaatttgttctacaagtgttttctttaatttttgctttttagacatagctttattatagaagaatttgtgctgactgacaagataaaataattttactgacagatttatttttttgtaaaagttactgacagattttattagtaattgctataaatgaaaagtttagggaattttttgacgaaaatgatcaaaataacaaatgcagcaatagcagtcaaaattgcactgattccattgacagcaagagaataagccacggctccccagcctttccaagcgtattggctccagaaaatgattccggcaataaaatggaagaagtatttaagaagaacagcaacaaaagttcccaaaagaactggtgcaagttttagaggggctgctttttggcggaaaagtccagcaattccaagtgaaacaggggcgatgagatattcaaggaaggcttgagacaaggttaaaatataagcgtgtccagtaatcattgacagaattccccagattaatccaccgacaagtccagctgttaggccgcgacgaaaactgagaataagaattgggatacaggcgatttcaacaataatccagccataaacagtatttggaataaggctgatgatgaaggcgagtgccgccatgaaggcaatttccgttaacaaacggacattgaacttagaattagacataaaaaaactcctttttgatgcgcacaaaaggagggttagaaattagacatttgtcttaacacattcctacgctggcattacccagatcaggtcagatggtatttctcgctactgacagttttgtcaatagacccattgtgcaaatatttatttttaccctttaagtttagcatattttaagttgaaaagcatttttttaagattgttaatctattttataaattaaacttaaaaaatatttaaggcaacataaaaaatcaataattcaaaaaaaacgaaagtctgttagaataagtctatacacaaattcggacaaaataaaagcggtcgagtaagtaattgtgaaggtcagcacagagagcttgtagcggtgagagcaagcctgagtgaagcaatgaaaatggcttgataagcgtagcaagagtgaggtttaactaagctcttgacggaatggttctcgttattgaacttgaaagttgcctttgggatctgaaaattttcagtgaactaaaaagtgcttaaatcaagaatggtaccacgatatagctcgtttctttatatgaaatgagctatttttatttagcatgagcgctttatcttgaagaatttgtttagttttagaaaaattaacaggtgcacggttaatttttctaatagatgtaaaagtttatcaaaaggggaataattgattttgaaaaataaatcaattagaaaaaagggagaagaaatgaatccaagaaacagaaatattttaattgtcgttattgttgttgtaattgttgctatcgctgcatttttcggttttaatcataaatctggtggaagtaaaacggcaaataaaactgtgaatattggaataatgacaggaacaaaagaagatgatgccatttggtcaactgtttctaaaacagctaaagataaatatggaattactttaaaattcactcattttacagattatacacaaccaaatacagctttgaaaaacggcgatattgatttgaatgccttccaacattatgctttcttgaatgcttggaataaagctaatgacggtgatttgaaagcaattggtaatacaacaatttcaccaattcgcctttattctaaaaaaattacttcattgagccaaattaaatcaggagatacaattgcagtacctaatgacgcttcaaatgaaagtcgcgcactttatgtcttgaagaatgctggtttgattggcctttctgtatcaggtgatacacttgcgacagtcaaagatattaattcaaatccaaaaaatttggtcattaaagaattagatgcggcacaaacaccgcgtgcgcttgattcaattacagcggcagtaattaatgacgattttgcaacaacagcaaaattaacggttgaagagtctatttatactgaacctgtaaacaaagatagcgagcagtggattaatattatcgttgcaaataaaaaagatgctaataacaaaatttataaagaagttgtcaaagcctaccaaactgaagcaacgaaaaaagcaattgagaaagcttatcctgataagagaaaaattgctgcttggggattgaaactcgactaagtaatttcgttaaaaagtaacggttaggtgaaaactttggaaatttctactttagaaatttctgccttagggctaataaattttactgacagaagactcaaactgattacgaacggtttggtcagtagaaattggagaagattatgaatcctagaaatcgtaatataattattggaataattgttgttgttattgtagctattgctgcatttatcggctttggtcaaaaatctcaagcaaataaaacggtaaataaaacagtgaaaattgggataatgacaggaacaaaagaagatgacagcatttggcaaacggtatctaaaactgctaaagataaatatggaattactttgaaattcacacactttacggattatactcagccaaatacagcattgaaaaatggcgatattgacttaaatgcctttcaacattatgcttttttaaaagcatggaataaagcaaataatggcaatttagtggcgattggggatacagtgatttcgccaatcagcgtttactcaaaacaactcaaaaatatttcagatatcaaagagggtggaaccattgcggtaccaaatgatgcttctaacgaaagtcgtgccctttatgtcttgaagtctgcgggtttgattaaattggatgtttctggtcaaacactggcgactgtcatagatatcacatcaaatccaaaaaatttggtcattaaagaacttgatgcttcacaaactgcgcgtgctttagattcagttgatgctgcggttatcaataataattatgccgttactgctggtttaaagaaatctgatgccatttttacagaaccagttaataaagatagccaacaatggattaatattattgttgctaataaaaaagacgaaaacaacactgtttataaagatgttgtcaaagcttatgaaacagaagcaaccaaaaaaactattgctaaagcttatccggacaagagtacaattcctgcttggggcttgaaattaaaataattgtttttaatactcaaataagtctctcttcattgagaggcttatcgttcaaagaaggtctgaacacttgtgaaatagaatattttataagtattcagtagaatgtggggaaaaatttgaatccaaaaaatagaaatattattgttgcacttgcagtgattatcgttgttgctttggttgctttctttagtttaaatcatcaagcaagtaaaaaatcaaccgctcaaaaaacagttaaggttggaatcatgagtggggacaagcaagaccaagaggtttggaaatcagtagctaaaactgccaaagaaaaatatgatttaaagctaaaatttgtttatttttctgattataatcaacctaatgaagcacttctttcgggagatattgatgtcaatgcctttcaatcttataattatgtgaaaacttggaataaagcacataagagtgatattgtggcagtaggaaatacttatattacaccaatgcacatttattcaaaagaagtcagcaaattgtcagatttaaaagaagggtcaaccgttgcaataccaaatgatgcttcaaatgaaagtcgggcattgttcgtgctccaaagtgcgggtttgattaaattgacaacaagtgattctagcaaattagttggtttgccagatatcacagaaaatccgcatcaattgaaattcaaagaagtggatgcaagtcaaacaccacgtgcgcttgattctgtttccatttcggtggttaactataactatgcaaccgcagctagcttaccaaattctgaatctgtctatatggaacctctcaacaaaacttctgctcaatacattaactttattgctgcgaccagtaaagaaaaaaataataaagtttacaaagaagttgccaaggcttatgcttcaaaagcgacagaaaaagcaatcaaagaacaatatccagatggcggagaattgccagcttggaacttgaaactttgaaaatgaaaggatttatttatgaatccaagaaatcgaaaaattctttttggaagcttgcttttgctggttattatcgtgggactaattacttttactttaaggcaaggaaaaagcaaatctacttctgtcagtaaaatcgtaaaaataggtctgatgcctggtgggaaacaagaagatgccatttggaaacaagttcaaaaaaatgctaaagaccaatttgggattactttaaaatttgtcaattttactgacggagatcagcccaataaagctttggctaaccatgaagtggacctcaatgcctttcaacattacgcttacttgaaatcatggaataaagctaataatggaaatatcatatcaattggtgatacaattattacgccgattcatttgtattcgaaaaagtataaaaatgtgacggaaattcctgataaaagtacgattgctatcccaaatgatgttaccaatgaaagccgcgccctttatgttttaaaaaatgcaggactcattaaacttgatacttctagaggagcattagcaacggttaaagatatcagagataatcctaaaggcttaatgatcaaagaaattgatgcaagtcaaaccccacgtgcgcttgattctgttgctgcagcagtcattaattataattttgctatttcagcaaaaatttctgagaaagaatcaatttatcaagaacccttaaatgaagattcagctcaatggattaattttattgcggcaaatcagtctgataaaaataataaagtttataaagaagtggtcaaggcttatgagcaaaaaaatatcgctgataccattaaaaaagaatatccagatggtggagaactccccgcttggaatttaaaattgtaactaagaaaactcgtcagagacgagattttctgtcagtactgacaaaagagaaaataactttgtcagtactgacagagaatgaaaaaagataaaggaaaacaatatgacagcaattattgaattaaataatctttctgtacaatttcatcagaaaggacgattagtcacagcagtaaaagatgctactttacacattgaaaaaggggatatttatggagtaattggttattctggagctggtaaatcaactttggtcagaaccattaatctccttcaaaaaccgaccaaaggtcaaattgtgattaatggtgagaagatttttgatagtgaaaatcctgtaaaatttactggcgcgaaattacgtgagtttcgtcaaaagattgggatgatttttcaacattttaatcttttaagtgaaaaaaccgtttttaataacgtggcttttgctttacagcatagccaaatcgaagatgaaaacggaaaaaaacgttatcttacaaaaaaagaaaaaacggataaagtgaccgaattattaaaattggttgatttagaagagctttctgataagtatccagctcagctttctggaggacaaaaacagcgggttgctattgcgcgtgcgcttgctaatgaccctgagattttgatttcagatgaaggaacatcagcacttgatccaaaaacaaccaatcaaatcttagatttacttaaatctcttcatgaaaaattaggaatcacagttgttttaattacacatgagatgcaagtggttaaggaaattgctaataaagtagctgttatgcaaaatggtgaaatcattgaacaaaattcattaattgatatttttgcacaacctaaagaagctttgacgaaacaatttattgaaacaacaagttcggtcaatcgttttattgccagtctttctagaacagaacttctggcacaattagcagatgacgaagaattaattcacttagattattcaggttcagagcttgaagaccctgtggtttctgatattacgaaaaaatttgatgtaacaactaacattttctatggtaatgttgagttacttcaaggacaaccttttggttcattagttttgaccttaaaaggttcaagtgaacatcgggctgccgcaaaggcatattttgttgaaagacatttaaaatttgaagttttaggtaaaattgaaaggacggtagactaatggcagaatggtttgcacatacatttcctaatgtggtttatttaggatggacaggtgagacgggttggtggacagcaattgttcaaacgctttatatgacatttatttcagcacttattggtggtttattgggattgatatttggaattggtgttgtcgtgactgcagaagatgggattacacctaatcgaccattattttggattttagataaaattgtttctatcggacgggcttttccctttattatcttattagcagcaattgctcccttgactaaaattttggtgggaacgcagattggtgttactgcggctttagttccattggctctaggagtggctcctttttatgccagacaagttcaagcttcgcttgagtctgttgaccatggaaaagttgaagcagctcaaacggtgggagctgattttctcgatattgttttcacggtctatcttcgtgaagaattagctagtttaattcgtgtttcaaccgttactttaatttccttgattggtttgactgcaatggctggtgcgattggagctggtggactaggaaatacggccatttcttatggttataatcgctttgccaatgatgttacttggtttgcaaccattttaatcttgatttttgttttattggttcagcttgttggtgatttcttagctagacgggtttcacatcgataatttatcaaataattttagataaaaatattttataaaaaggagaaacaatgaaaaataactctgtaaaaattgttgttgccactgggattggggctgctttgtttgtgattattggttggctaattaatattcctacaccgattccaaatacaagtattcaattgcaatatgcggtccttgccctattttcagccttatttggccctttagctggtttcttgattggatttattggtcatgcccttaaagattcatttctctatggtgcgccttggtggacttgggttttaggctcaggtttaatgggcttatttctagcttttggagtcaaaagagaaactttgactcaaggaatttttggaaataaagaaatcattcgttttaatcttgttcaatttttagccaatgtcgtagtttggggaattattgcgccgattggggatgttttagtttatagtgaaccggcaaataaggtcttcacacaaggaattgttgctggtttagtaaatgcattgactattgccgtagcaggaactttactactcaaactctatgctgctaccagaaccaaatctggctcactcgataaagaataaaaagctccagatatgctaaaataaaagcagcaaatatttgctgcttttacgcttgtatcggtttaataaagcacaaaaaataaagtatctctaaaaagaaggataaaaatggaagccttaatttcgttcaaagattttacatttaaatatgatttacaaaaaaatccaactttaaaaaagattaatttggaaatatttcctggggaaaaagtactgattgtcgggccttctggttcaggtaaatcaacgattggatcttgtcttaatgggattttgcctcatttacataaaggagaagcaagtggggaactctccattgctggtttgccctttgggacttcaattgctgaattatctgaaaaggtgtcgacgattttgcaagatactgatggccaatttattggtttgagcgttgctgaggatattgcttttgctttggaaaatgatggtctgattcatgatgaactggtcagtaaagtggcctattggtcagacaaaacagaaacaaataaactcttgaatcatcgtccccaagatttgtcgggcggacaaaagcagcgggtttctttagctggtgttttgattgatgaatcgccaattttgctttttgatgaacctttagccaatttggacccgcaaacttgcttagaaacaatggctttgattaaggatattcatgaaaacaatgaagtcacgacgcttatcatcgaacacagaatcgaagaagttttaccgcttggcattgataaaattgtcgtggtcaacgacggcgaaattgttgcaattggaagtcctgctgaattattaaaaacagaaatttttaatgaaaattcattacgcgagcctctctatctctcagcattaaaagctgcaaatgctacaaaattactgacagatttttctgacctaaaaagtttggaagttcggtcagcaaaaaatttactgacagattttttagacacttataaatttactgacaaggctgtcagcaaaaataatattctgtcagtaaaaaatttatcagtaaattttgctcaacatgaagttctaaaaggcattaatttagaagttcaagaaggagaaaaaatttcaattgtcgggaaaaatggagttggtaagtcaacctttgccaatgcactctgtcattttgttgaagcgagtggcgaaattttatacagagggcaatcgattattgctgattctatttctgaacgtgcagcaaaaattggctatattatgcaaaatccaaatctgatgatttcgcaaaatattgtcagtgatgaggtggcagctggtttacgactccgtcatgttgatgaaaaagtgattcaagataaagttgaagaaatcttgaaagtttgtgggctttatccttttagaaattggcccatttcttctttgagttatggtcagaaaaaaagagtaacgattgctagtattttaatactagaacctgaaattttagtccttgacgagccaacagctgctcaggatttacaatcttatcgggaaatcatggattttcttgacgaacttaaccgccctcttcatttaacaatgattatgattacacacgatatgtatttaattacagaatatagtgaccggacccttatttttgctgacgggaaaattattgctgacagcagtccttatcatattttagaaaatgaagattttgtaaaaatgggcaatttaagtcaaccaagcctttatcaacttgccagacaaacagataccaatcccgttttactgacaaaagcgttcatcaattttcagaatcaggagcgattaaagcatgaataatcaacttagtgttctaggctatcaagctggaaattcttttatttaccaactgaatgcaacagcaaaactccttttctttctattaatttctatcagcagtatggtgacttatgatacgagatatttggcttttgttgctttattttcggtaattttattttatttttctaaaattcctttttcatcagtaaaaagggttgcccaatttgcagcaatttttgcgattttaaatctgctttttgtatttatttttgaccctggatatggcgcgcgactttatgattcaaaaacaatcctttggggacctcttactttagaagaacttttttacctttttaatctcgtcttgaagtatttttcaaccattccgctcgctttactctttatcttaactactaatccgagccaatttgccagtagtttaaataaaattggtctgccttatcgttcctcatattcggtttccttagcactgcgctatattcctgatatgcaagaaaaatttttagcaatccgtaatgctggacaggccagagggatggatttatcaaaaaaagtaggacttttttcgcgaataaaattaaatgttcaattgttactccctttaattttttccagtttagaacaaattgatactatttccacagcaatggagcttagacgatttggtaaaaagaagaaaagaagttggtattcttatcaacctttgaatgttaaagattacttggttatcttgcttgcgcttttaggagtggcgattgttattcttctcttctttgtaaatcagggccgattttttaatccatttcattaagaaaagcaggttttctgcttttttcttatcttgcaaaaatgggtggaaaatggcataataggacttgtaaaaaacttttgacaagccaattgtttgcaaaagataataaaatttgaattaaatcttaaaaaagaacttccaaaagaattagaagggaaaaacatggaaaataaaatacgtgaattgcgccgattatctcatctttcacaagaggatgtcgcacatatcgctcacgtctcgcgtcagacgattaatgcgattgagaatgacaaatacgacccagagttaacgcttgctttcaaacttgcagaaaccctagggacaaccgttgatgagctttttaactatcaaccaaccgttgtgaaaaggaaagaaaacgatgtattttggtgcgaaaaatatcaatgtgtcttatggaaaagagcaggtattgaaaaacgtaacgctgtcgattgaaaaaggaaaaacgacagctattattggagtcaatggttctgggaaatcaacgattttaaaggcacttggacgtttaattaaatcggatggacaggttatctttgataatcaacctttaagtcaacattctaatcgtgaaattgctagaattttagcgctcttacctcaatcaattactgccccagctgatattacagtctatgaacttgtcagtttaggacgtttcccacatcaaaaattaatgcaacaacgtctctcaaaagaagatattttgttcatagaagaattgatgagagaaacaaagatttgggacattcgagaaagtaagatatcagaactttctggtggacaaaaacaaagagtttttatcacgatgattttagctcaagatagtgagattattttattagatgaaccaacgacttatctagatttagctcatcagttagatattttatgcttattaaaagatttggcgacaaagagaaataaaaccattgtttacgtcattcacgatttaaaccatgccgctcgttttgctgacaatctagtccttgttaaagacggagaagtggttgaagaaggaactgttgatgagttatttactcaaaaaacgttgaaagaatgctttggattagatgtcactttaggatgtgatacttttaccaaaaaattaatgattactggggtgaaagatgcctaaaaaacattttctgacaatcttttttgccctagttttttctttactttttttgtcagtaatatacctgatgcttggcaataaaaatgttcctctgacagaaattttagtaaataaaatggtcttacaattaagatttccaagattaataagtctttatctcacaggatttctcttatccgtcagtggatttattgttcaaattatgactagaaacccaattgccgaaatggcaactttagggatttctggcggttctagtttggctttatcactcattttaactttgggctggtcaacaaatgatgggatttcagttctagtttcatcactaggagcatttattgctttagccgtcgtcatgcttttgactgcgagaacgcattttcagccattaaaagttgtactagttggaacgtcagttggactttttgcaactagtttagccagctccttaacttttgccagccacgatacacaggcttattttcgctggattgtgggttctttttcagggataactaatactaaagttcttttgatggcagtagtaagtcttatttttcttatcctcttgcttttattttcaaaacaaatttatttattgaattttggtgatgagcttgctcaatcttttgggatttctgtcaattttgttcgtttagtcattatgtttttagttgcgctggcttctggtgtaactgttgcctcggttggggtggtcagctttgtcggtttgatcgctccacatattgccaagaagcttgtcagagctaatttttggcaaaatgtaattctgtcagtactgacaggaatgttattgcttgttttagctgatttgatagccagaaatttatttaaaccttacgaatttccagcaggaagtctaaccatgcttctaggtgctcccttctttctttgggttattacaaaggaggcaaaataaaatgaaaagaaaattcactttactttttgtcctgcttttggttttgatagtggttgatttgacgcaattttcaacaaatcctcaaattctatcaatcctaattcctaattttcgtcttcctcgtttaataacaatcctgtcagctggaattgctctttccttatcaggctttattatccaaaatgttacagaaaatcctttagctgatagtggaacaattgggataacctctggtgcttcggcaggaagtgttgcttttttactgattgctgaccattttaagctgacaggactttggaatttttcctatcctatttttgctttaataggtgcccttctttcatttgtcttaatttacttttttgccttaagaaagcaagtttcttctgtcagagttttactgacaggaattgcaattaccgcttttttccaagcattaatcacaattggtcagctttcagtcaatgcctttgactttcagaaagttgcagtttggctgtcaggagatatctggcaaacgggaagcacttatttgttcatttgtgttctcttattagtaattggcttgattattttgccatttttcttaagaaaacttgaaatcctctcactaggcgaagaaatggcaactactttaggattagaagttcaaaaaacgaaaatctatctttacttgttagcgctcctttttgcagctgtcggtgttttattggttggaggattagcatttgttggtttaattgcccctcatattgctcgtgaaatcgttggttttaaatcacgaaaaagtttaattgccaccgcactttctggtatgattattttatcttttgctgatattatttcacaaacaatcattgcaccatcaagtttacctttaggttttgtagttgcctttattggcgctccatactatatttatcttattcaaaaagtttaagaaattaatttacttttagtaaatttcttataaaaaaatatcggcttatttttaaaaaatagcctaaaaatagaggagaatcttttgaaaaaagtactcacaaccctaatcgctgcaggagctttacttactttagctgcctgttcatcaaattcatcatcaaaaaaagcgatatcaagcgatgataaagtgacctttcacgctttaaatggggacgtcaaagttcctaaaaatcctaaacgtattgctgttcaaaattatccagatgaagtcgcttcattaggtgcaaatgttgttggaacagattcatgggccttcccaaataccttcttatcaaaagaccaaaagaagaatatggttgatttaggagcgccaaaattcaatatggaaaaattgattgctcaaaatcctgatttgattattacagttgataaagaccaagtagcagactatcaaaaagtagcccctactgttcttgtcaattataaggatctctcaggaatgaataaatcattggattacttcgctaaactccttaatcgcgaagatgaaaaagcaagtttccttaaaaactttaaaaaagaagccgataagcaaaaagaaaaattggtaaaggttgatgttaaaccagctaaaaacacaatttcacttcttgaacttcaaggagataaggtctacgccttcggtaacaattttgctcgtggcggacaagccttgacgactggtttaggatttaaagaatcaagcaaaatggctgaactctcaaaaggcgtaggttatgctgaagtaaatactgaaagcttaggcgaattcgatgcagactatatctttattgactttgcagataaagataaagaacaatatgctgcattaaaaaataatccagcttggcaaaacctcaaagcagttaaagaaggacatgtgattacgatggactacgacaaagtttacttctttggcggaccaacagcggctaaagaagagctgtcactctacactgacgctatcattaaagctacaaaataaaaagaaaaagtgtataatcaacttatacactttttttgtaaaaaattaaggactttatgacatgaatattaaacaattacggtacgtcgtcgccattgctaatagtggaacttttcgtgaggcttcagagcaactctttgttagtcaaccctcaatgtcgattgcggttaaagacttggagcaagaactaggttttcaaatctttgagagaacaaatacaggtgcgactttaactattgaaggcgaacgtttttatgaacaagcacagactgttttacgtaattttgaaacttttgaatcaaaatattctaagccaaaagagtctgataagactttctcagttgccagtcaacactatgattttctagcaccagttgcagtggaatttgcaaagaaaaatcctgaaatcaaaaattttagaatttttgagtcaaccacttataatattttgcaagaagtggcgcaaggtcacagtgaacttggagtggtttatctcaataaacaaaatcgctcagggattttaagaatgctcaataaacttgaattagattacgaagaaattttcttatcgcaaacgcatatctatattcgcaaaggccatccactagctcaacgtgaaacaatttcagatgatgatttaaaaccgctagatcgtgtgcgatttacacaagaaaatgaacagtttctttactattctgaagatttggttgagacttttgaaaataccttgatttataacgtcactgaccgtgcaagtttaaatggaattttagaacggacagatgcctacgcaacaggtcttggttttattgataaagagagcgtccataatgtaacagttgtccctatggagggagacaatggaaatagtttgattttagtcaagcatcgtggacatttattatcaaatgcggcgacttcttataaacgtagtcttgaagtttactttgaaaactatgaattttaaacaatagctaaaataaatactctctgaataattttcagagagtatttttataacttattataatttacttgcttggtctttttgagccaaacgaatgaggaacattgcaaggagaatgataatgattcccccaagtggagtaaagacaacacttgatcctttagaaatttgtcctccaacaaatgagcctaaagtaattccgacattgaaagctgcaatgttaaaagctgaaactagagtaatatcttttggcgtaaatttctctgccaattgaacaacgtatagttgtaaaccagggacattcataaaggcaaacaagcccaaaagtaaagttgcaatcaatcccaaagcttgcgaagctaaacttgcactgataaaaagaaaaagtaaactcaaagctaaagccgcaaacattttttgaagggcaggtaggatatttttatttgctagatgtccacctagtgaattaccaatggcaaccatcacaccataaacaaccagaataatcactactgtacttgctgaaaatctaaaagttccttcaaggattggtgtaagataagtataagctgcgaaagttcctccataaccaaaggcggtaataaagagagacattaaaattgatttattagtaaaaattctagcaagcccacttaaattaatttttccgggaattggaagcccttttggaacaagaatactagtagcaatcagtccaattaagccaataacaacaatgaaaacaaatgacatatgccagttagagtgctgaccaatgaaagtccctaaaggaacaccaatgacagtagcaacggttagtcctgtaaacatgagggcgattgctgaggcccttttctcaggtcgaacaacatcagcagcaatgactgtggaaattgacatgaaaataccatgagcaagtgaggcaagaacccgtcctactaaaagtaaaaggaaagttggagcgaaagctgacagtaaattaccaagaataaagagacccataatcgaaaccatcaaagtttttcgattccaagttcctgtaagaatagttaataagggagcaccaaccgttacccctaaagcataaagagaaacggttaaacccgcttgagataaactaatattaaaggtgttgacaatcattggcattaaaccaacactgataaattcggttgagccgatagcaaaagcattaatcgcaagagctagaagagtgagactgggagatatttttttcattatgcttctttcttaaaaattaaaatgttctggatctggaccgacacgaagttcttcattgagtgagttgatagctttcatatcttcagagtcaagtgaaaaatcaaaaatttgacgattagctatcattcgttcacttttaatagattttacatttactaaaatatcttgttgaatatcccaacgaagaataatttgagccacagattttccatgtttgtcagcaatttttttgaggacttcattgtctaataattgaccttgcattaaaggtgaccaagcttgaaccttgatatcatgaagttccaagaaattacgaagttcttcttgtgataattttggatggagttcaatttgatttaaaacaggggtgatttcagcatagctaagaagttcttctaaatgtgatttttgaaagttactgacaccaatcgcttttattttgcctgctttatataaatcttccattgctttccaagcttctttgtaagcataatgtgtgcctggccagtggataagatataaatctagataatctaaatccaattttttcaaactttcttcaaagttttgaattgtttcttcataagaatgattatctccccaaagttttgaagtgatgaaaagatcgtcacgagaaagtcctgtcatagccaaaccttctttaattccttggccagttccttcttcattttcataaattttagctgtatcaattaaacgatatccgttaacaattgcgtttctgacaacatcagcagtttcttcatttggaatttgaaaaactcccaaaccaagttccggaatttcaatctgattattaagtttcattttttgctcctcatatattttattttggcagaaaattagtatataataaataaaacctcttgaacagtacctacttttttgtgtcatacatactaaaaagtaataattggataaaataagggattagaaaggaaattaattttgaaaaaaatttataatattggtgtcgaagcgacaatggatgttattggcggaaaatggaaaccaattattttgtgtaatttaagacataatccaagtcgtccaggagaattgagacgtcaaattccaggaatcagtcaaaaaatgctgactcagcaattaagagaattagaaattgataatattatcgtccgtaaggtttataatcaagttccaccgaaggttgaatattctctgagcccttatggtgaaactttaaatggtttattagatattctttgctcgtggggtgaaggtcatgtccaaactttaaaaagtatgggcgaagaagttcaaattttagaataagaaaacttagaagaggagccacaagatgtaccaaccagctttcaataaaattcatcacatcgctatcattgccgcagattatgaaaaatctcgccatttctacgttgatattttaggattttcaatcattcgagaaaatcatcgtccagaaaaaggagatatcaagcttgatttaaagatgaatgaagaaacagaaattgaattatttatcaaatctgatgcccctaaacgcttaacttatccagaagcaaaaggctatcgccacttagctattaaaacgacaaatattgaagaagatagaaattatttaataagtcaaggagtcaaagtggaggaaatccgtcaggacgaaattactgacagaaaaatgctttttttctatgatccagatgacttaccaatagaacttcatgagtaatttttaaaaaatggaaatgaagaaatggtttttaggttagccaaagcttctgtcagtaaataaaagggcttacagaaaataaaagctagaaaaaaaaggaaaaatgtagtaaaattaactttgtaaatgaacgaactaaatttcgttcaagtaaaaataaacggagaatacacaaaatgccaaaattagtatttgcacgtcacggtgaatctgaatggaatcttgctaaccttttcacaggttgggctgacgttgacctttctgaaaacggaactaaacaagcgattgaagctggtaaattgattaaagaagctggaatcgaatttgatattgcttacacttcagtattgaaacgtgctatcaaaacaactaaccttgctcttgaatattcagaccaactttgggtaccagttgttaaatcatggcgcttgaacgaacgtcactacggtggtttgacaggtttgaacaaagctgacgctgctgcaaaacatggtgatgaacaagttcacatctggcgtcgttcatatgatgtattgccaccagcaatggatcatgatgataaatatacagctcacggagaccgtcgttacgctggtcttgaagattcattgattcctgatgctgaaaacctcaaagttactttggaacgtgctcttccattctgggaagaccaaatcgctccagctttgaaagaaggaaaaaatgtcttcgttggtgctcacggtaactcaatccgtgcactcgttaaacaaatcaaaaaactttctgatgacgaaattatggatgttgaaatccctaacttcccaccacttgtttttgaatttgatgataacttgaacgttcaaaacgaatactacttggctcctaaaaaagcataatatttgaatgaaaatactctaagttataatagatactcatctatttaggacttagagtatttttttgtaatcaatgcaatagtttgtaagttttcgaacaaattaattgattcttcattttattcttgagataatttaatagtaaagttttaaagaagaaaaaggagaatcttatgtcattagtaggtaaaaaaatagaagaattttcaacagatgcttatcttggtgggaaatttattaaagtttccgataaagatttttatggaaaatggtctgtgctttgtttctatccagcagacttttcatttgtttgtccgacagagttagaagatttagaagaaacttatccaaccttgaaatcgcttggtgtagaagtttactcagtttcaactgacacacattttgtccatgctgcttggcatgaacatagtgatgctatttcaaaaattacttatccaatgcttgcagacccttcacaaaaaatttcacgtgcttttgatgttcttgatgaagaagcaggattggctcaacgtggaacatttattattgacccagacggtgtgattcaagcgcttgaaattacggctgatggtattggacgtgatgcaagtcaattggttgataagattaaagctgctcaatatgtgcgtaatcatccaggggaagtttgtcccgctaagtggaaagaggacggagcaagtcttcacgttggtattgaccttgtaggtaaaatatagaataaaaagtgagttttggctcactttatttgtctttagaaacttaatgacagaaaggtttaatatgatattagatgaaaatcttcgtgctcagttgatgccttatatggatttgttggaaaatccaattattttaaaagttgatgcagatttagagagcgaaaatgggaaaaaaatagcagaatttacagatgaacttgcaagtttgtccgaaatgatttcaaaagaaacgggaaaactcaaccgaaaaacagctttttctattgaaagagaaggtgtttctggagtccttttttcagggctaccattaggtcatgagttgaattcattggtcttggcgcttgtccaagtaagtggacgccctccacggattgaacaagaattagttgagcgaattcaagcgattcaaaatccacttcactttgaaacctatgtgagtttaacttgtcataactgtccagatgttgtccaagcattaaacacaatgagtattctcaaccccaatattagtcacacaatgattgaagggggaatgtttcaagaagaagtggaagcaaaaggaattatggcggttccaactgttttcaaaaatggtgaagaatttcataatggacgagctagtcttgaagaattactagaaaaaattactggtccagagagttcggaagttttttctgataaagacccttatgatgttttagttgttggtggaggtcctgctggcgcaagtgcagctatttatgctgcgcgtaaagggattcggacaggcttaatcgctgaacgctttggtggtcaaccactagaaactttaggaattgaaaaccttattggaacgccttatgttgaaggggttcaacttggtcgtcagcttgaagaacatgtgaaaaaataccctgttgatttgatgaacttgcaaaaagcagttaagctagagaaaaaagatttgattgaggtgagtcttgaaaatggcgcccttctaaaaagtaagtcagttattatttcaacgggcgctcgttggcgagatttgggaattccaggagagcaagaatttaaaaccaaaggagtcgcttactgcccacattgtgatggtcctttgtttgcaggaaaagatgtagcggttatcggtggaggaaattcaggaatcgaagcagctattgatttagctggtttggttagacatgttactgttctagaatttttacctgaactgaaagcagataaaattttacaagaaaaacttgcgaccctaaataatgttactgtcctcaccaatgtagaaaccaaagagattttaggagatgacaaggttagaggtttgaattatcaagttcgcggctctaaagaaactgttcatttggaacttgctggtgtctttgttttaattggtttagttccgaatactcagtggttggaaggaacaattgacttatccgcacgtggagaaattttgactgataaagttggagcaacaaatcttcctggtgtttttgcagcgggagattgtacggatagtgtttataagcaaattattatttcaatggggactggggcgaccgcttctctaggtgcttttgattatttgataaggaactaaaattttagatgacaaaaaagaaaacgtatttgagttttctttttttatttgattaaattgataggaatcaaaattgtaaggaaaagttttcataaatgtggtaaaatgtttaagtacaaattttgaatgtaaaaactatttataaaactcattcttggagtcgaaatgtcagataataaaagaaaaaatgataagcgcaagcaatccgataagtctaaaaaatcacataaagaagtaaaaattttaaaagatccaactaaattaattccaaaacgagtgaacctcttattttttgttatctttgttttgtttatgattttaattgggaagctcttcaatatgcaggtattgaattcacatttctacgccgaaaaatcaattagtgcaggtggagatgttcaaattattgaaggtgcgcctcgcggaagtatttatgatgcaacaggaaaagctttggcatcgacagttgcggttcaggctgttgaatttacaagaagtcaaaacgctactgctgatgaaatgtatcaggtagccaataagttagcaactattttatctaataacattgatgttgctgatttgacaacgcgtgataaaaaagactatttcttggctaattccaaaaatctagaaaaaatagctaatagtttatctgaaaaggaaaagaaagataaacagggtaatgatttaactggttcgcagatttatgatgtcgaattaagtaaagttaaagatagtgatttgaattttacggcagaacaaacttttgctgcaaaattattcaaagaaatgaatagtaccactacttttaacactactaaaattgctactggaagtattacagcagagcaacaagcaacgattgccgaacaagaaggcgatttaccaggaattacaattgggacttcttgggaccgttcatatgctcaaaattctttgacgccacttatgggaactattacgtcacaaaaatcaggaattccagcagaggatttggatgcctatcttaaaaaaggttatcaacgtaatgaccgtgtgggaactgggcttcttgagaagggatacgaaagtgaacttcaaggaacacataatatcagtaaggttaaatttgacaaaaatggtgatgtttctggaacaaaaacaatccaaaaaggaaaacgtggggatgatttaaaattaactattaacctagatttccaaaacggtgttaataatatcgttaaaacacaattagatcaactgattgcccaaggctatggtcagtataatagaggggcttatgctgttgtgttaaatgttaaaacaggggcagtcttagctttatctggctatcaacgggatcctaatacaggagcaattacggaaaatactttagggactttccaaagtgtcttcacaccggggtctgttgtcaaaatgggaacattgactgctgcttggaatgctggtgtaatttctggaaatgacactttaacggcacagtctattcaatttaaggattctccgtctatcgatgactggtggggtgatgcttcaccaatggctttaacagctgttgaagctttgcaatattcatcaaatacttacatgatgcaattggcaatgagaatgttaggcgctccttatactgcagcggggcaatatctcaatgatagtaaccgagtaaaagtttatgaacagtttcgtaaggcttttgcttcttatggtttaggggcatcaactggttttgatattcctggagaatcaacgggatatctcccttcagctaaatctgaggcagcttctggggtcaatgtattgtatgaatcatttggtcagtatgataactatacgccgcttcagttggcggtttatgcggcaactttaggaaataacggaactcgtttggcgccacacattgtccaaggaatttatgaaggtggaactgacggacagcctggcacgcttatcaaaaatattactcctaaaatcatggataaggtaaatatcactcctgataatatggatgttcttcatcaagggatgtatgctgttgttcatggggctggtggattgactactggtaagccaatgagtcaatcaacggtttctatctctggtaaaacagggacttccgaaagtacaaaagtattggcagatggtagtcaagttattgtaacggctaataatgcagtggcctttgctccttctgacaacccagaaattgctattgcggttgtacttccagataatactgaaagtaatgcttcaagtggaacaaaagcaaaccaaagcattgtaacggggattactgatttgtattattcaaatgaagcttttcgtaaaaattaaaaaaaagttctctctgataggagaggctttttatttataagtgattgagaattctatcacctttccttttcattttcagtcttttatagtaaaattaataaattgaataaaatatttacaagtgaagaattggtgaaatatgtattatcctgaacctattgctcgcctgattgagtcgttttcaaaattaccagggattggtcaaaaaacagcgactcgattggctttttatacgattggcatggaagatcaagatgtcaatgaatttgcaaaaaatcttctgtcagcaaaacgggatttgagtttttgctcgatttgcggcaatttaacagaaagtgatccttgcgccatttgtaccgatccaacgcgtgatcgaacaactatattggtcgttgaagaatctaaagatgttcttgctatggaaaaaattcgggaatatcgaggactttatcatgttttgcatggtacgattagtccaatgaatgggatttctcctgatgaaattaatgttaaaacattgattacaagattaatggattcagaggttaaagaagtgatcatcgcaactaatgccacttctgacggagaagcaaccgccatgtatctggctcgaatgattaagcctgcaggaattaaagtgactcgcttggctcgtggattagctgtagggtctgatatagaatacgcagatgaaattactttatcaaaagcggtagagaatcggttggaaatttgattttttctgtggtaaaataaaaaagacaattactgacagaattgtattgtaaaaatatcgcatgctgtcagtaaaaagaagtgtctgacaaagctgtcagtaaaaaaggaagaaatatgtcaaaagaaacattaattttgttgtatggtggtcgttctgctgagcgagaagtatcagttttatcagcagaatcggtgatgagagctgttaattattctcgttttgttgtaaaaacttactttatcactaagggtggtgaattcataaaaacgcaagaatttactgacaaacctgctgaagaagaaaaactactgacaaatgatttggcagaatcttatccaaagatttcaccagcagcaatttacgaaaaagatgccgttgtattcccagttttacatggaccaatgggtgaagatggctcgattcaaggatttttagaaattttacgtttggcatatgttggtccaaatattttatctgcgtcaagcacaatggataaattattggcaaaacacgtttttgaagcggttggtgtaccccaagttccttatgttgcggcttttgctgatgaaaatcaaggagaaattgctcaagaagtagtcgaaaaattagaatttccagtttttgttaaacctgctaatatgggttctagtgttggaatttcaaaagttgatgatttagcagaccttcaacctgcgctaagcgaagcctataaatatgataaccgtgttgtcattgaacaaggtgtggatgcgcgtgaaatcgaatgtgctgttttgggaaataatagtgacgtttctgcaacgctcccaggtgaagttgtgaaagatgttgagttttatgattacaactcaaaatatattgataataaaattcaaatggacatcccagcaaaagttcctgctgatttagctcaaaaaatgcaagaatatgctataaaagcgtacaaggcagtcaatgggatgggcttgtcacgttgcgatttctttgtgactaaggatggaaatgtttatctcaacgaaattaatgccattccaggattcacacaatggtcaatgtatccattgctttgggaaaatatgggcttatcttattctgatttaattgaaaaattagttgatttagctaaagaaacttttgaaacacgtgaaaatcatcttttataaaaaatacaaatctgtcagtaaatcgattgctgacagatttttttgtcagtaaaaagtgttataatggagtcactatgaaactcacaattcacgaaatcgcccaagtcgttggcgcaaaaaatgattggtcgcaactggcagatttgtcagtcaataaaattgaatttgacagccgtttgattgaaaaaggggatatctttttgccacttaggggggcacgagatggtcatgatttcatcgaaatcgcttttgataatggagcaataatcagcttttcagaaaaagaagtcgaacaagctcatctcttggttgacgataatctgcttgctttccaaaaattagcaaaatattatcttgaaaagacaaaagttccagtcattgcggtgacaggttcaaatggaaaaacaacaaccaaagacatgattgctgctgttttgtctaagaaatttaaaacatacaaaacacaagggaatcacaataatgaaatcggcttaccctacaccattttacatatgccggatgatactgaaaaattaattttggaaatgggaatggatcaccctggtgatattgattttttatcagagcttgctaagcctgaacttgctgtcattacattaattggtgaagcacatcttgaatttatgggaagtcgcgaaaatattgctaaagggaaaatgggaattacggctggtttgcatggtgagcttattgcccctgctgacccaattattaatgcttttatcccagacaatcaaaaaattattcgctttggtttgcccggtgaagatttatttattacaaaattagtcgagcacaaagaaaaattaacttttgaaactaattttttagatgaatcaattactattccagttcctggtaaatataatgcgacgaatgctatgttagctgcttttgttggcttacattatggactttcagaagtcgaaattaaaaaagctttgaaagaagtagagctgaccagaaatcggacagagtggaaaaaagcaaaaaatggtgcagaccttttgagtgatgtttataatgccaatccgacagcagtgcgtttgattttggaaactttccaagccattcctaaaaatgagaatggtcgaaagattgcagttcttgctgatatgttagaacttggacccagtgcagcccaactccataaagatatattgaaatctattgatttcaataaaattgataaagtctatctttatggtgaaatgatgaaaaacttggcagaaatttcgactgacaaagcggtcagctattttacagatttagatttactgacagaaagtctgtcagcagatttgaaaccaactgaccaagtgttattcaaaggttcaaatagcatgaaactttcagaggttgttgaaaaattataatgataaaaaatactgacagaaagttagtatttttttattttcattaaattatcagaaaaatacaacaatattcttgacaatgtatttttgaaaaagtataataagtccacatttaattttcagaataatatgaaaattcaatagtatctttacgatttggagaaagcagatgaaacaaggaaaaattattggactcaccagccttattgccctgtcaggaattattttagtggcctgtggcacaaaaacaagtgagcaaaaaaacatcaaattttcaattcccacagatgtggcatcacttgataccacaattttaactgaccagtattcttatgatgttgctggaaatgtggaagaaggattgacacgcgttgactctaaaggaaatgctgccttagcacttgcaaaatcaattgacgtttcaaaagacggcttgacctacacggttactcttagagataatttgaaatggtcaaacggtgacaagttgactgctaaagattttgtttattcatggaaaagagcagtggaccctaaaactggttcagaatatgcctatttgatgggggcagtttctggggctaataatattatttctggtaaatcatcactcgatagtctaggaattaaagccgagtcagatacagaatttaaagtcacattggcacaaccaacaccatattttaaatttctcttgtcagaacctgtttattaccctcttgaccaaaaagttgttgataaatatggcaaacaatatggaacgtcctcagataaaaccgtttataatggaccattcatgttcaaatcagataaaggttggacaggaaccaataaaactttttcaatttacgccaatccaaactactatgataaatcagcagtcaaatctaaacaaattgatttccaagtcatttcaaatgcgaacacaggagcacagctttataaacaaggaaaacttgattttacgctcctttcaacaactgatttgattaatgccaataaaaagacgaaaggttatactgtctttaaacaagcacggacagactatattgaatacaatcaatctggtaaaaatgcctcaagtccagatgctcaaaaagcactagctaatcaaaatattcgtgaagccttaaatttggcaactaacagagcaggagtcatcaaaacagccctaccaggttcgactgttgcgacaagctttacaccagtgggaatgagcaagacctcaacaggagaggattttgcaacttatgcaaaacaagattatcgctatgacccgacaaaagcaaaagacctctgggaaaaagggttaaaagagcttggcttaaccaagctcagccttagccttgaagctgctggagatttagcaccgtcagaagcaacagccaactttttacaaacagcctatcaacaaaatctaccaggtttgactgtcaatttaaaacttgttccattcaaacaaagattgaatgacgctcaaaatggaaattttgatatggttctctcaggttggggtggagattacgctgaaccttcaactttcttgcaactctttacgacaggccaatcatataatgacggtaaattttctagtaaaacttatgatgatgcctttaaagcagcaacaacaacgccagatgttcttgacccagccaaagtagatggacactacaaagcggcagaaacagccctctatcaagggtcctacatcaatccagttgatttccaagctaatccagctttaatgaatcctaaaattacaggcttagaatttcattcaacaggtttagcttacgacctaaaatcggcttatgttaaataaaaaatacaaaaagataaattttctgaaaatttatcttttttattgaatattctttctacaaaaataaaacatgaaccagtcagagcccaattaaatgaaagggttttaaataaaagtgtagtaaaaaaatcttcttcaaaagtttgtgaaaactttccgctatttaaaaattaaatgttaattttcagaaaacataaccattatactttacaattcaggttgaattaagtataataccaatataataaattttctgacaataataaaaattgcgaagtcagacacaattcatgaaagagggaaattacatgaagacttggaaaaaagttaccttaggtacagttgcacttggttcggcagctttgcttgcagcatgcggcaatagcggttctagctcatcgtcatcatcaaaagacattaaatggaatttgacatcacctattcaaacattggattcatcacttgcgacagatacatattcaaatatcattattggtaataccaatgctggtttgacacgtgtggacaaagatggtaaagcacagccagaattggcaaaatcagttgatgtatcaaaagatggcttgacatatactttccatcttcgtgatggcttgaaatggtcaaatggtgatgctttgacagctaaagacttcgtttattcttggcaacgtgcagttgatccagcgactgcttcagaatacggatacctccttggcccagttaaaaacgccaacgagattaatggtggtaaagctgataaatcaacacttggtgttaaagcaactgatgacaaaacatttgttgttacccttgcacagccaacaccatactttgaattcttgacagctaactctgtttacttcccactcaaccaaaaagtagttgaaaaatacgggaaacaatacggaacatcttcagaaaaaatggtttactcaggaccatataaatttgaaaaatcaaaaggttggaacggttcaaaccaaacattctcaatcgtgaagaatgacgattattgggataagagcgcagttaaaactaaagaaatcgacttccaagttgttcaagatgttaaaacatcatttaacctttacaaacaaggtaaaattgaccaaactggtatcggtgacccagacctttacaaagcaaataaaacagataagaatgttgtctctctaaatgaagcaactacttcatacgttcaatataaccaatcaggcaaaaataaagcccttgcgaataaagatattcgtgaagctttcaatcttgcaactgaccgtaaacaatatgttgatacagtaacaccggcttctacgccagcaactggtttgacaccagcagggatggctaaaacaaataccggtgaagacttcgctaaatatgctgaacaaccttacaaatacgatgccacagcagctaaagccgcttgggaaaaaggtttgaaagaaattggcgaaactaaacttacgttgactttgacaactgatgatacatcagctgccaaagactctgcaacattccttaaacaagcatgggaagaaaaactaccaggtttgactctaaatatcaaatcagtaccatttaaacaacgtttaaatgactcaacaactggtaactttgatatggtcatctcactttggggtggtgactacgctgaaccatcaacattccttgatttgttcacatcaacttcaccaaataacaatggtaaaatcaataatgttacttatgataaagcaattaaagctgctgaagtgacagatgcccttgatcctgaaaaacattatgcagactataaagctgctgaagaagcactttatacagaatcaaatattaatccgctttacttccgtacttcaccagtccttcgtaaccataaccttaaagatgtacgttttggttcaactggtttgacttatgacttcaaaacggcttacctcaaataataatagagttttagagcaagaaagttaggattggcagattgccaaccctatcttttgcttagattaggaaattttttatggttaaatatattcttaaacgtttggggcttttgcttctgactttgttcctgattgtgacattgactttctttatgatgcaagtcatgcccggaacacctttctcaaatcccaaactaacaccagatcaactggaaattttaaaacatgcctatggtttagataaaccgctttggcaacaatactttatctatgtaggacacatgttcacaggtaattttggtacttcgttcatttatacaaatcaacctgttattacgatgattgcccaacgtttaccagtctcaatgcaattaggaactcaagcacttattctaggtactgttcttggagcattgatggggaaagcttctgcacgtcgtaaaaatggcgtccttgatggcgtttttggattcctctcagttcttggtatttcagttccttcattcgtaattggtaccttaattcttctttacttaggatttaatttgaaccttttcccaatttctggttggggaaccttctcacaaacaattatgccaacaatcgctctttcttttgccccaatggccgtagtaacccgttttgttcgctctgaaatgattgagtctttatcttcagactacattttgttagctcgagctaaaggtttatctgaaaaagaagtggtcaacaagcatgcgttgcgtaattcgttaattccaatgttgactttgattggtccaatggccgcaggattgttgacaggatcagtcttaattgaaaaaatcttttcaattcctggaattggggctcaatttgttgattcaattccagccaaagacttcccagttattatggcaacaacaattgtctatgcggtaattttgatggtatttatcttagttacagatattctgaccgcaattgttgatccacgagttcgtctctagaaagggtttgtcgaaatggaaaatttaaataaagacttcacccttgttggttcaaagggttcagattcaacagaaaaaattgcgaaacctgccttgagttttttccaagatgcctggcgtcgttttaagaaaaataaagtagctttggttgccatgtggattattgcgattacattggttttctcagtaatctccgcatttgttgtaccacaatcaaaagcaaactactttaatccaaataaatcacaagtttatggaaatcttccgccaaaactctcaggtgatttaccattttggaatggtgaatttaaagcaccaggttctactgaaagaacagatgtctataaatcacaaggtgttccagaaaaagataaatatgtcttcggaactgataaatatggacgttcattagctaaacgaacaattgttggtttgcgtatttcattgattattgcccttgctgccgccttgattgacttagtaatcggggtgacctatgggattatttccggctggatgggcggaaaagtcgatatggtcatgcaacggattattgaaatcatccaatctgtacctaacttagttgtagtaacaatgcttgctctacttttgggacaaggaatttcatcaattattattgcgattggtctatttgcatggaccgggatggccaggcaggtacggaacatggttctctcctataaggagcgtgacttcgtcttggcctcaaaaactttaggacaatctacttggaaaattgcagtaaaacatttgttgccaaacgtttcaggggttattgttgtccaaatcatgtttgatattccaagtatgattatgtatgaggctgttttatcagcgattaaccttggggttaaaccgccaacgtcttctttggggactttgattaatgatgggattgcaagcttgcaattctatccattccaattgattattccagcagtagtattgtctgtgctttcactcacatttatcttctttggagatggtttgcgtgatgcatttgaccctagagcaagtgaggattagaaatggcagaagaaaaagtattagaagttaaaaatttgcatgtcaatttccacacctatgctggagatgttaaagcgattcgtgatgtttcttttgatttagaaaaagggcagaccctagcgattgttggtgagtctggctctggtaaatcagtaacaacaaaaactttgatgggcttgaatgcgaaaaatgcggtaataccacaaggtgaattattatttaaagggcgtaaccttcttgatttaaaagaggaagagtggcaaaaaattcgtggaaatgaaatttcaatgattttccaagacccaatgacttctcttgacccaacaatgcgtattggaaaacaaattgctgaacctttgttgaaacacaacaaaggaatgagcaaagccgatgccatgaaacgggccctcgaattgatgcaacaagtcggaattcctgatgccgaagtgcatattaatgattatccacaccaatggtcaggtgggatgcgtcaacgtgcagttattgcgattgccttggctgctgaccctgaaatcttgattgcagatgaaccaacaactgcgcttgacgttacaattcaagcacaaattatgcatatgatggctgaattgcaagaaagaattaattcatcaattgtcttcattacccatgacttgggagttgttgctggttttgcacataaagtggcggtaatgtatgcgggtgaaattgttgaatacggaacagttgaagaaattttctataacccacaacatccatatacttggggactcttagattcaatgccaacggttgattcaagtgtggaccggttggtttcaattccaggaactccacctgatttattgaatccaccaaaaggggatgcctttgcagcacgtaataaatttgccttggcaattgattttgaagaagaacctccatactttgaagtatctccaacacattttgccaaaacttggcttttagacccacgagcaccaaaagtaacgccttccgataatatcttggcacgctggaaacgctgggaagaattgaaaggggataaatgatgacagaacctaaaaaagtaattgaaatgaaaaaccttgatttgacttttaataaaggaaaaaaaggggctaataaggcaattaataatgtttctttagatatttatgagggagaaacatttggtctcgttggagaatctggttctggtaaaacgacgattggtcgagcaattcttaaactttatgataatttcattactggtggagaaattctctttgaaggtaaagatgttcgtaatttaaaaggttcagagttgcgtgagtatcgttcagaagcacaaatgattttccaagatccacaagcttcattgaatggacggatgcgcgttaaagatatcgttgctgaaggacttgatgccaatggtttagtaaaaacaaaggctgaacgtgatgctcgtgtattggaactcttacgtttggttggattgaatgatgaccatttgacacgttatccgcatgaattttctggtggacagcgtcaacggattgggattgcacgtgcacttgccgtaaaacctaaatttgtcgtagctgatgaacctatctcagcacttgatgtttcaattcaagctcaggttgttaatttgatgagagatattcaagcaaaagaaaacttgacttacttgtttatcgctcatgatttgtcaatggttaaatatatttctgaccgaattggtgtcatgcactgggggaaaattttggaagttggaacttctgaccaagtttacaatcatccaattcatccttatactaagagtttgctaagttcaattccgtcaccagaccctatttctgagcgggaacggactccaattgtttatgacccaacggctgaattggatggacaagaacgtgaaatgcgggaaattactccaggacattttgtcttctcaacagaagcagaggcagaaatttacaagaaaaacgctactgtataaataaaaaatttaatgataaaacaattagttttgctgattgttttttcttttgtttaattaacaatcaaattaattttttaacgctttagtttgttggtaagatttataaaaatcaactataaaatcagggcaaattttgatataattaaaagaactatttttttgaggcttaaccaatgtaaaataaattaaaaatataaatgaataattaaagaaaaagagagtataaatgactttacaagaagaaataaaaaaacgccggacttttgccatcatcagtcacccggatgctggtaagacgacgattacagaacaattattgaaatttgggggagccattcgggaagcggggactgtaaaagctcgtaaaactggtaattttgctaagtcagactggatggatattgaaaaagaacgtggaatttctgtaacaagttctgtcatgcaatttgattatgcaggcaaacgtgttaatatcttggacacgcctgggcacgaagatttctcagaagatacttaccgaacattgatggcagttgatgctgcggtcatggttatcgacagtgctaaagggattgaagcacaaacgaaaaaacttttccaagttgtgaaacgcagagggattccggttttcactttcattaataaacttgaccgtgatggacgtgaaccgcttgatttactttctgaattggaagaaattcttggaattgctagtgtaccaatgaattggccaatcggaatggggaaaaatttccaaggtctttatgattttacgcatggtcgtgtggaagtttatcaacctgaggatggcaaacgttttgttgaatttgatgaaaatggggaagtgccagctagtcatcctttgacaaaaaatccattctttactcaagctttagaagatgctgaattacttttggatgctggaaatcaattttctgaggaagaagttgttgcagggcaattgacaccagttttctttggttcggctttaactagttttggggtagaaactttccttgaaacatttttagaatatgcaccagagcctcattcacacaaaacggtggacgaagaagaaattgaacctttaaatcctgatttttctggtttcattttcaaaatccaagcaaatatggacccacgtcaccgtgaccgaattgcttttgttcggattgtatctggtgaatttgaacgagggatggatgttaatcttgtccggacgggtaaaaaagtgaaactctcaaatgtcacacaatttatggctgaatcgcgagaaaatgttgagaatgctgtagctggtgatattattggggtttatgatactggaacttatcaggttggggatacattaaccacaggtaaattgaaaaaatcttttgaaccattgccaacatttacccctgagctctttatgcgtgtccaagcgaaaaatgtgatgaaacaaaaatctttccaaaaaggaattgaccaattggtacaagaaggagccattcagctctacaaatcttatacaactggtgatattatgcttggtgcggttgggcaacttcaatttgaagtctttaaagaccggatggagcgtgaatataattctgaaacaatcatgacacccatggggacaaaaacggttcgttggattaaagaagaagatttagatgaaaaaatgtctagttcacgtaatattttggcacgagatcgttttgaccatcctttattcttgtttgaaaatgaatttgccatgcgttggttcaaagataaatatccagatgttgaattaatggaacaattttcagtataaaattactgacagatattttatatagtagaaaagcttatattctttaaaaaatatcataaaaatttactgacagctttgtcagtatattttttatgaaaatattttaaaaaagtaaagggcgtaagcattttcagtcaaaaaattatgctataatagataagttacgtcaggcgagtcacataaatttcgcctgtagcaagggtttcgtaccctgtaataaaaagtttggcgtgggaacacgcagtagaaatataggtaaaaaatgaaatttagtgaactcggcctgtcagaaggaatcgtaaatacacttacagagattggttatgaacaaccaacaccaatccaagaacaaacaattaaacttgcacttgaagggcgtgacgttctaggtcaagcgcaaacaggaactggtaaaacagcagcatttggtcttccaacaattgaaaaaattgatgcttctaatccagctattcaagcactcgttattgctccaacccgcgaacttgcggttcaaggacaagaagaacttttccgttttggtaaatcaaaaggacttaaagttcgtactgtttttggtggttcaagtattgaaaaacaaattaaaggccttaaagctggtgcacatattgttgtgggaacaccaggacgtttggttgacttgattaaacgtaaagcaattaaattggatcaacttgaaactttgattcttgatgaagctgatgaaatgttgaatatgggattcttggaagacattcatttcatcattgaaaaaacaccagaagctcgtcaaacattgcttttctcagcaacaatgccaaatgacatcaaaaaaattggtgtgaaattcatgaagaatcctgaacacatcaaaattgcagccaaagaaatgactgctgaccgtattgatcaatattttgtaaaaacaaaagaatttgaaaaatttgatgttttgactcgtttgcttgatgtggaacgtccagaacttgcaattgttttcggtcgtacaaaacgtcgtgttgacgaattgattcgtggtcttaaattgcgcggttaccgtgctgaaggaatgcacggagatttggaccaaaataaacgtttggctgttttgcgtgatttcaaagcaggacatattgacgttttggttgcaactgacgttgctgctcgtggactcgacgtgtcaggagttactcacgtttataactacgacattactcaagaccaagaaagctatgttcaccgtatcggtcgtaccggccgtgctggtaaatcaggacgttcagtaacatttgtttcatacaatgaaatgggttatcttcgtgccattgaaaatatgactaaaaagccaatgaaaggcttgaaaccacctacaaaagaagaagcttaccaagcgtcactctcagtagctatggatgatgtgcttcgtgatttgtctgatgattcagctaaagcaaaattggctaaatttgacaaacaagcagcgagcctacttgaaaaatttgatgctaaagaattggttgctttacttcttcaaggtcgcgtaaaagaccctgataatcaagaagaagttaagattacagctgaacgtccattgccatataatggtgaaggaaaaggcttcaagaaaaaaggtaaaggtggcggcggacgctacaaaggtcgtggaaatggtgaccgtgatggcaaccgtggcggttaccgtggaaatcgtgatggtaaagatggcgaacgcggtggagatcgtaaacgcaactggaaagaccgtgatgataaccgtggcggttaccgtggaaaacgtgatgaccgtcgttttgacgatcgtaaacaaggagaaaaaactcctcgtaaacgtaccacaggaactgaaaaatcagctggcttcgtaatgcgtagccgtggtgacaaataaaaataatcaagaaatttcggtaaatagaggaatcatcagttagctgatgattttttcttttgtcagctgtcagtaattttattgtttgaaagttaaacaataaatctgtcagtagtttttgaatacaagatcattctgtcagtaaatttgcactgaacataattggatttaacaagctgacggaggtgataaatgatttttaaagactctgtcgctttccgtcagtttaaagcgattgcttaatgagctttaaatcggcgaataaagaacttgtcagctttactgatgattctgtcagtaattttcacaatcattttttagaattttacttaaaaagggctgattttatgctataatagcgctatgacaaataacaaatttaaatcaggatttgtggcgattttaggtcgtccaaatgttggaaaatcaacatttatgaaccacgtgatgggacaaaaaattgccatcatgtcagataaacctcaaacaacaagaaataaaattcaaggaatttatactacagaaaatgaacaaattgttttcattgatacgccaggtattcacaaaccacacaatgctttaggcgatttcatggttcaatctgcttattcgactttacgtgaatgtgatgtcgttttgttcatggttgcggctgatgaaccacgttcaaccggtgaaaatatgattattgagcgcttgaaaaaggcagaagttcctgtcattttggtcgtcaataaaattgataaaattcatcctgaccgtctttttgaaattgtagccgattatacttcacaaatggagttttctgaagtggttccaatctcagctaaacaagggaataatacagaaagattaattgatacgctctctgaaaaattggacgagggtcctcaatatttcccagaagatcaaatcactgaccatcctgagcgttttcttgtttcagaaatgattcgtgaaaaaatcttattattaactcgggaagaagttccgcattcaatcgcggtcactactgaccaaatgactcgagatgaagaaactggtaagattcacatcatggcaacaattattgttgaacgcaagagccaaaaagggattattcttggtaaaggcggcgatatgattcgtaaaatcgggaaaatggctcgtcgagatattgaaattatgcttggggataaagtttatcttgaaacttgggtcaaaatcaaaaatgactggcgcgaccgaaaaatggatttagctgactttggctacaatcgtgatgattatatgtaatgaaaatagcgaattatcgctattttttgttttattatgaaatttccagacaattgtgatataatattgaaaattataattattattgggggaaattatgtgcggttttttatttatggaaacatctgatttaacgatagaagagtttaaaagtaatttggaattgattgagcatcgaggaccagatgaccaacagcatgttcgtgatactttgggaaatgattttggtttttgccgactttcaatcatggatttatcagacttgggacgtcaaccgtttggtttaaatggcaaaagagttatgtgtaatggtgaaatctataactttttaaatctccgtaagttcttggaaacaaaaggttataaatttactggtgattctgactgtgaggttcttttaccactttttgaaactactggaatcgaaacaatggtaaaaatgcttgatgctgaatttgcttttgtcttggttgatgaaaacactgctgaaatttttgccgctcgtgacccctttggaattcgtccacttttttatggttataataaagtaacaggcaaaatttcgttttcatccgaagccaaagcactaatttcaacatgtaatgatgtgacaccatttcctccaggttactactatgccaatggtgaatttcatgtttttaatgacattgctgaggtttcaacaattgttgaagaacctttggctgaaatttcaggacatattcgtcgcaaattggaacgtgcagtcaaaaaacgtcttcatgcagatgctccaatgggctatcttttgtcaggggggttagattcatcattggtttgtgcgattgcagctaaggaattagaaagtccaatcaaaacctttgctattggaatggaaaccgatccgattgatttgaaatatgctcgtgaagtggcagatttcttacgaactgaccataccgaaattctgatgacaaaagaagatgtactttcagcagtccgtgaagtgatttggcacttagaaacatgggatatcacaactattcgggcttctattggcatgtatttaatctgtaaatatattcatgagaatacagaactgaaagttttgatgactggtgaagtttctgatgaaatgtttggttataaatatactgactttgctccatcagcgggtgcctttcaaaaagaagctcaaaaacgagtgcatgaactttatatgtatgacgtcctgcgggctgaccgctgtttagcggctcattctcttgaagcgcgtgttccttttgcagatttggattttgcggcctatgtcatgtctattaatcccagcagaaaattgaatacttatggcaaaggaaaatatctcttacgccatgcttttgaagggactgaactattgccagatgagattttattcagagaaaaagctgctttttctgacgctgttggtcactcaatggttgactatttaaaagaatttgctgacgaaaaatattctgatgaagacttagcaaaggccagtgaaaagtatccaaaacatacaccatttaccaaagaatcattgatgtatcgtgagatttttgaagaattttatccaggatatgaagattggattcttgatttttggatgccaaatcgcgattgggttggggcagaagttactgacccatcagctcgcgtcttatcaaattatggtgattctggaaaataaattttgaaatctttatcataaaaaaatgaatgagaaatgttaaaatagtcactgatgaaacttatctaatgataaattgtcagtgattttttatatttaaatttaattaagaatacaaaagaaagttgtcagtaaaaaatgaattaaaatttactgacagacttgttagtaaattttttgatgtgagggaaaaatgccagagttaccagaagttgaaacagtgagaagagagcttgaaaaaagaattgttggacaaaaaattgtatctatagaagccacttatccaagaatggttttaactggttttgagcaattgaaaaaagaattgacaggaaaaaccattcatggcatttcacgtcgcggaaaatatttaatttttgaaattggcgagaaagatcgtttgatttctcatctgcggatggaaggaaaatatcgacttgcaagcctcaatgctccaatggaaaaacatgaccatttagcccttaaatttactgacgaacaattaatttatgctgacgtaagaaaatttgggacttgggagttgatttctactgaccaagtccttccatattttttgaagaaaaaaattggtccagagccaacttatgaaacttttgatgaacagattttccgagaaaaattgcagaaatcgacaaagaaaattaaaccttttctacttgaacaaacattagtggctggacttgggaatatttacgttgacgaagtgctctggctagcaaagattcatccagaaaaagtggcaaatcaactgacagaaagttctattcatcttttacatgattctatcattgaaattttgcaaaaagcaattaaattaggcggctcaagcattagaacttatagtgccttaggttcaacaggaaaaatgcaggacgaattacgagtgtatggaaaaacagggggaaaatgtgtgcgttgtggcaatgaaattcaaaaaataaaagtggctggtcgggggacccacttttgtccattctgtcagcaaaaataatgacttgatttttactgacagcttttaaaaattaatttaaaaaactcagtgacaaagttaataaaaaaacgtatagatagaatataggggcttataaaaaatcctgaaaaatgctataattaaacaataaataaagaataacggagataaaatttggcaacaaagaaaaaaacaaattttgatgatattaccaaaaaatatggcgctgaacgtgacaaagctttggcagatgcacttgctctgattgaaaaagactttgggaaaggttcacttatgcgtcttggagaagcagccaaccagaaagtgtcagtagtaagttcaggctcacttgcacttgatattgcgcttggtgcaggtggatatcctaaaggacgtatcgttgaaatctacggaccagaatcttctggtaaaacaacagtcgctcttcatgccgttgcagcggttcaaaaagaaggtggaattgcagcctttatcgatgctgaaaatgcgcttgacccagaatatgcaaaagcgctcggtgtcaatatcgatgaacttttactttcacaaccagactatggtgaacaagggcttcaaattgctgaaaaattgattacatctggtgcagttgacttagttgttattgactcagttgcagctttggtacctaaagccgaaattgacggtgaaattggtgacagttcagttgggcttcaagctcgtatgatgtcacaagccatgcgtaaacttgcaggacatattaataaaacaaaaacaacagctattttcatcaaccaattgcgtgaaaaagttggggttatgtttggttcgccagaaacaacacctggtggtcgtgcattgaaattctacgcttctgtacgtcttgatgtacgtggttcaacaaaaatcgaagaaggttctggagataacaagacccaaatcggtaaaatcacaaaaatcaaagtcgttaaaaataaagtggctccaccattcaaggttgctctcgtagatatcatgtttggtgaagggatttcaagaaccggtgaacttttaaacattgctgttgatgaaggaatcatcaaaaaatcaggcgcttggtttgcttacaatgacgaaaaaattggtcaaggagcagaaaaagcgaagaactatctcaaagaacatcaagaaatctttgatgaaattgaccataaagttcgtgccgctcacggtcttcttgatgaagcagaagtagcagaaactacagaagatacttcaacaaaagctaagacaactaaagctaaaaaagaagaaaaagtagtagaaactgaagaaattgaactcgaacttgaagattaaaaaaacagctgattattcagctgtttttatttttttaaagaaagtaaatagtccaaagataagaacccaaatcacagaaccaatggccggaacaaatgtatctttaaagcagaatagtgaaataaagattaagacaaatccagcaatggctaatggaataaagatgtgggctgcaggtaaaacaaaccctttaggatcaaaatcgcttgatttccgatatttaagataagtaattaaggtcattagataaaccactagaaaaagattggttgcgacactggtaataaagacaaaagaattagaaatcgcaggaatcatcgagatgaatggagtaaatagaattaataatgaggtgaaaagtaaagcatttactggtacaccagcttttgaaaatttagtaaatggtttaagtattttatcattattgagttttgataaagaataaagattacgagtgattgaaaagagggcagagtttaaagccgaagcagcagaagttagtacgacaaagtttactaaagccgctgcccatttgattccaatgagttggaaaatggtaacaaatggtgatttatcagccggaatatcgcgccattggtagatactcataattgccagcagtgccccaacataaaagaggacaattcgaattgggatttggttaatcgcttttttcaaagttggtctaggattatctgtctctgctgcagtcattccgatgaattccatcgaaacaaaagcaaacatgaccatctggaagctttcaaagaaattagaaaggccatttgggaagaactcgaagcctttggtgatattagttacacttacagtatcagttcctgtatgataatgactaaaaatgaggattattgccgttaaaatcaaaccaataatcgccacaattttaatcatcccaaaccaaaattcggtttctccaaaaaattttggatttaaggtattcaataaagttagaagaactaatacaaagacttctgtcatccaaattggtaaatccggcaaccaaaaattaatataagtcccaatagcaattagctcagccatagctacaaaaacaacaaccagtaaataagaccactgaataaagtaaccaggtttttcaccgagatagcgtgaaacaaaatttaaaaaggaatgttgattgggatcttggtaaagcatctccccgatagctcttaggagaatatacataagcgcaccgattattaaataaacaaaaataattgatgggccagtgaggtgaatcgattttccggcaccgaggaataatcccgtaccaattgttccagcgatggcaataagttgaatatgcctattttttaaaccacgttgcgagggcttattttcttcattttgatttgtattcataatattatattatacgctttttcatttagtttttcagaagtcactctgtctaggaaaagatgactcgcttagatttttttatagtgcgagtagagcccaaagaaaattgtccagacaatcgctcccaaggccggataaaaggtatcagcattgaaaaacaaagaagcaaagacaattgtaaagatagctacgataaagggaacggtaatttgaggttttggtgtcaagaaacctttaggattgtaatcttcagattttcgatattgccaataagtgtagagggtgataaagtaaaccactaaaaataaattagtcgtacaagaggctgcaaaatcgaaagcattttttatctgaggaataagagtcaggacaggagccaaaagcgagagagcagttgccatataaagggcattgataggaattcccgccttagaaagttttgtaaaaggagttaatcttcctttgtcatgctgttgagcaagtgagtacatatttcgtgttgctgaaaataatgaactattaagcgctgaagcagcagaagtcaggacaacaaagttaatgagcgccgctgcccatttgattccaataagttgaaaaaccataacaaatggagatttatcagccggaatatagtgccagttgaaaatagtcataatagccaaaagtgctccaacatagaaaagtaaaatacgcactggaatttgattaattgcttttggtaaactctttttaggattaactgtttctgccgcagtcattccaataaattccatagaagtaaaggcaaacataaccatttgtaaggcaccaacaaagttccaagcaccgtgtgggaagagttgaaagccatcaaaaatgttgtttagtgaagcagagtcatgaacggtttttccgcttaaaacagtgctatagtgaaaattaccagctactaaaataatcgcagtgacaatcattccaatgattgctgctactttaatcatcgcaaaccaaaattcagtttcaccaaaaaagcgagaatttaaagtattaagtccaaaaagaagagctagcatgacaatttcaatcaaccaaagtggaacctgaggaagccaaaattgaatataagttccgattgctgtcaattcagagatacaaacaaaaacaataactaaccaataagaccactgagtgaagtaacctgtcctgacgcctgaatattttgtgacaaaatttaaaaatgaatgctgactagggtcgttgtaaagcatttctccgattgttcttaagaaaaagaacatcgcaatcccaataagaatataagcaaagataacgcttggaccagtcatttgaatggttttcccagctcctagaaaaagtccggtaccaatcgttccagcaatagcaataagttgaatatgtcggttctgtaagccccgttgagcttcatgtttctcttgaagattttccaaaagttttcctcccttaaattatcagataattccaataatgtgttaattattataccaaattaataaatttgtatcaagagtcatattcttttttgctaaaaataacagtaaagtgtatcatttgatatttatgatataataaaaatatgttaataatcgaccaaaatctattggaaatagataatttgttagaaaaaataatggacgagtttttgaaatttccagaagttgaagcttatcagaaagctaaagctgattttatggcagatgaaaatttacaaagtcagcttaaaactttacaggataattctgaatatatcgcttttcgcccagagctaagagcgcttcagcatgaaataaatttggatgagaaggtttatgcttttcgtttggcagaaaacgaccttcagcaaattttgacaactttgactaagaaaattacaaatagtatttcggaacagatttatgttgatgagaatttaccgttgaaaggagggcaacatggacgacatcatggaaagcattgagaaaaaagaaattcgccccctttttataaaggagcgaatcgcagtttatgtttattgctattcatataaaggaacaagacaattaagtaaatttggcgatgtgatttatacaagccaaaaatcaaattatagtttactctatatcaataatgaaaatctttcagatttattgagtaaattaaaagatttgaaatttattaaaaaggtgcgtgtgggtcatattaaagaacttgaccaaaacttttctgaagcttttgctcaaactaatcttgccgttaaagaggaaattgagcgcttgtaagtaagggaataaaagtgagctcacgtgtcaataatgtaattgctattgtgtattatttgagtgagcagactttttttgttaatatagtaaaaaagagaggagacttggtagagtaatactgcttcattagatgaagtctggaatttgtaaaaaagttgtattctatagattccgattatcacttcttctcaaccatgaaacgatacccaaaaccaaggaagaaaaactatgttggagactcattattacttcactcccattttagaccatttagaaccatttgatcataatgattggcatttatatccgattgtcactttacctgcggctaagcaactacgggatgcagaagatttgcctaaaaatattgtttcgttaaatgcttgttatgaccgtttgcgaaaagtatcacttgattatctaactgtaaatctttacggacgaaaacaaggaagagcttttctcttattgttgcaggatgttttagaagaaacgacgattttagattatacagtacaagttcgtcaacagattttgaaagaaatcggcgtgtctactctgaattttatggagtatcgttcttttgctaaaagacatctcgctttaatgttaaaagattttagaaaaaatgattttcaagcctctccagcaagtctgattatgactaatgaggaatgtttgaaaattgaagattgtcctcatgccctcttacaacaatacttagaacaaattgaaaaaactgcctgatgcttgtcagacattttttttataaaaaaatactgacaggattctgtcagtaaaattttaaaaattattttcgtaaatgtcttaaacagtctaaaaaacgaacaactttggattttgaaaaacgatattcaactcgatttttatctaaaaagtcaaaaaagtcttttttcccttgtttgctgtcatctacttcaagctcaagctcataatcagtatgccctagataatcattcttgtctaatgcagcaagcccaattggaagatgttgctcataacgaatcgtcgtcaaacttccaattaaagtgatttcctcaagattaatatctcgtgcagttagtaactcacagatttcacttaaatcagtctctccacagacaatatttcgctcgccaaggagttgttgagcctcttcaagactgagatcaatattatattcaatatttccaacttcttgaggaacttttaaagtcatttctgcggacttatcaaaagttctaatacgcaaagccaattttttcttgcgtaatttaaaatcttttgaatctaagtagtggttagtttgcctaacaggggttacgtgagtaaagagttttttgagctggtcatactcagccagcgacaatagcgacttatactcaatctccaaattcgtactcattaattaatttttaagattattttctaaagaaaatatctttcctttcagttgggttaaacgatatattaattaaaagtatatcaaaaggctgactataagtaaagttgcgccctaagttgaggaaagagaaaagctggctcaaagcagagaaacaaagggaagtttttaaaaatgaaggagactagacaaggactgaaaatatgatagaattaaggctatggaaaaagtagaagagaaatatcatttaaaagatttttgggattttggtttgaaacaatttcggtcagcaatttttggaattaccattattctgtcattaattgtgactacctttatcaaaattccacatcttgcacgctatgacactttattgatttgtgtcatcgtcattcaaatgatacttttggtcagcaaatatgagcgagcttatgatttaattccaatcatggtcttccatgttttgggaatgattttagaaatatttaaagtaaagcatgggagttggtcctatccagatgccggcttatttaaaattatggatgttcccttatacagtgcttttatgtactcggcaattggctcatatattgttcgggcaataaaagagtttgatttagaagcaatcaattggccacattggttgatgtccattggtatttctgttcttatttatctcaacttttttagtggaacctttggctttgatttcagaaatatcttttatctctttattttaatgattttctggaaaactaaattttcttttgtattgcggacaaaacgttatcaaatgccggcaattttgagtttctttttaatcggtctctttatttattttgcagagaatattggttcttattttagtgcttggacttattcttatcagttaaaagcttggcaatttgttgatttaggtaaaatctcttcatggactttattgatcatcgtttcaatcattattgttattgaactacagagatatttttcaaaaaagataaaaataaaaaatataattaagaactaaaaagggcaaaatgattgctctttttttattgaaatttaaagcatttaagtagcaataatgtgaataaagcaaacttatgttaaaatattagatgtgattctaataaatatagaagtcagaaatcgtttaagatttaaatactcaaaaaaggagtatgcgagagcaattgcttttgcaaagtgaaaaaaatgtttaattgggaagaattcttggacccttacgtccaaacagttggcgagttaaaaataaaatttcggggcgttcgtaagcaatatttgaagaaaggactttattctccgattgaatttgttacagggcgcgtgaaacgtcgagaatcaatcagaaataaggccaaacttcgtggttacacacgagaaaatttagctgaaatggaagatattgctggtgttcgagtgatggtccaatttgttgatgatgtttgggatgtgttagagcttttacgtaaacgcaaagattttaaaattattgaagaacgtgattatattaataaccaaaaagcttctggttaccgttcttatcatgtcatcattgagtatccaattgatacaattgatggtttccaaattgtcaatgctgaaattcaaattagaactttagccatgaatttttgggcaacgattgaacattcccttaattataaatacgggggcttaattcctgaggatgtcaaggcaagattgactaatgcagcgcgtgaagctgctcaacttgatttggaaatgggtgaaatccgtgaggatattcaagaagcacagttgctttttgatagtcctcagcaaaaacaagactttaaaaaagaaaatggtgaagaaaatgaactttggtaaaaaagtctggcttattggaaattcgagtgaaaaatccaaaaaaacgctcaataaattgagcaagattttgaaagctgaacatttcgtttttgatgatattaatcctgaaattgtgatttcagttggaggagatgggacgcttctacgagcaatgcatatgtacgaatatcagctagatcgtgtgcgatttttaggtgttcatacgggacatttgggcttttatactgattttactgacgaagatttgtttgaagtcgtagaggctctttatgatgaaaatccagctcaagcgattcactatccactcattcgtgttcaagttagttttactgacggatatcaaattgtacggcacgttctcaatgaagcaacgattcgacgtgcaagtaaaacgatggttggtgatgttagaatttctgattatctttttgaacgttttcgtggggacggcttgtcaatttcaactccaacaggttcaacggcttacaataaatcaattggaggagccgttgttcatccgcgggtaaaagcaatgcaagttgctgaaattgcaagtttgaacaatgtcgtttatcgaacattaggttcaccaatgattgtagctgagaaagatacaattaccgtttgtcctgcgccagaggatgattatagtttaacttttgatcagttgacttttgaatacaaaaatatcaaatcaattgagttttcattggatggaacaacgatttcttttgcaaattgcgctcatacaccattttgggaacgggtcagtaagtcctttattggggaggttgagtaatgcagtttgcttttagaaacgagattgaaggaagcatggttaagtcaatgctaagccgtcacggtatttctaggagattactgacaaaagtgaaatttgatggagggaaaataacagttaatggtcaggaaaaaaatgccatttatcgcctggaaaaggatgatttggtgacggtcacagtcccagatgagccagataatgaaaagttaattcccgatgattttccactcaatgtcctatttgaagatgaccactatttagttgttgaaaagccagcaggcaagccatcaattacagggtccttgcatccgactggtgccatgtcaaatgctgtcaaaggatatattagtcaaaaaaattatgctaatcaaacggtacatattatcactagactagaccgtgataccagtggaatcatgtttttagctaaacatcgttatgcacatgctttaatgaatcaacataaatttcgcgacacgatggaaaaacgctattttgccattgtaaatgaccaagatttgccagattctggtcgaattgatttaccaattggacgtcgtgatgattcgattattcaaaggcaagttcgctttgatgaaaaagcaaaagatgcactgacttcttacgttgttgctgagcggaaaaatgatttagcccttcttgatattattttgcatacaggcagaactcaccaaattcgtgttcatttttctcatttgggttatcctttaattggtgatgatttatacggtggaaatcatgatttgatttcacgtcaagcccttcactgtcatcatttacagttcttaaatccttttactgacgaaatggttcatgttgaattagacatgccagaagatatgaaaaacttattgaaataaaaaaagttactgacagattttctgtcagtaactttttatttattaaaatttccagtttttaagaattttaacagatttaatttttacagggtcaacaggagatgaagcttcgccagaaccacttgatgtaacctcggctttagcgattttatcaacgacatccattcctgagataacttgaccaaagacagtgtaacttccgtctaaacttggatagcccccttttttataagcatcaattattttttgaggatatttagtcttgtcttgaatttgactggtcatatcttgggaattttgcacaatgaaaaattgtgaactgctagagcttgcttggccagtatttgctaaagcaagtgcgccgcggatattgtacagttgattagaaatttcagtatcaaatgttttcccaccaaaaattgaagcagtaccagttccttgattagaagggtcaccagattgaatcatgaaatctttgatgacacggaagaattcattgtttttgtagtaaccatttttggcaagaacaaggaaattttgaaccgcattaggggccaatttagggaaaagtttaatattgatatttccagcagtcgttttaatttcgacctcagcttcatcctcagcaacagttgtagaaagttgtggcaaagtcaaatcattaagggcagttgtagaattttttactgcatcatgtaatttataatttgttggataatcaactttttggcttgaagaagtgcttgtactacttgctgtattatcagttgtttttggacgatttgcaaagaaaacaaggagtccaacgacaataactaagacaatcccaaagattgtaaaaagaattgtattattttttttattcgtattcataggaatattttaacataaaaatgagtaattataaatttttatcaaattaattcttgcaatttctaaaaaaaaggtatagaatatagaaaaatcacgaaaggagaatcacgaaatgaataacttctcattacgccatcatcatttgcatagataagagttgtgtcatacagtaggtatagatacagctttagagtacgctcaagtatctatgccggtgattctcaagagaccggttgtaaagacaactggtctttttatttgttcgtgctctggtttgtagaaaaaaaacaagagattagaaagcaaagattatggaaaatcaaaatcaggtcaagcgcaaccttaaacagcgccacatcaccatgattgcattgggtggtacaattggaacaggtttatttttaacctcaggagcaacaattagtcaagcaggtccctggggcgcagttcttgcttattgttttattggtattatggtttacttcgtaatgacttctctgggtgagatggcgacatatttgcccacttcaggttcattctccgattatggcggtcgttatgttgaccctgcttttggctttgcattagggtggaactattggctcaatggagcgattaccattgccgtggatttaacgacagcaggattgattacgcagttttggttcccgcaccttccgtcttggatattttcaggaattgcgacggtcttaatttttattattaatgttatggcggttggagcattcggggaaacagaatattggttatcaacgattaaagtgattacgattgtcctctttttagctattggtttacttaccatttttggagttttgggacaaggaaatgttgatgtcgttgccaatttaagtgctggcaatcatggctttgttggtggaatttcaggatttgttggagttttacttattgccggattctcttttcaaggaactgagcttttagggattaccgcaggtgaatctgaagacccaggtaagtcaattcctaaagcaatgaactctattttctggcgtatcttactcttttacatcttttcaatcattgtgattgctgcaattatcaattttaaagaccctcgcttgttaaatccaaattcgacagctgtcatgagtccatttactattgtctttaaaaatattggctttgcagttgcagcttcagttatgaatgcggtcattcttacttcggtaatttcatcagcaaattcagtaatgtatgcttcaacacgtattctttattcattgggacaagaaaaaggcgcaccaaaattctttggacgaacagcaaaaaatggaattcctttttatgccctattagccacaacaattatttgttttattgctttcttaactggaatatttggaacacaaatttatcttttcttagttgatttatcatcactaacaggatttcttgcttggcttggaatttctatcagtcatatccgttttagaagagcctatgttgctcaagggaaaaaattggaagatcttccttacaaagctaaatggttcccgtttggtccaattgttgcgctcttgatgactgcggcaattgccattaatcttgacccagccatgctctttagtgagcactggggtgaaggcttagctttatacgctgcaattcctattttcattattctttattttggttataaatggaagtataatacaaaaattattccacttgaagaagtagatttgagtcgagaaaaataatatctgaatcacaattcgtatagagttgtggttttttatttataatataaagagaagtaatgacattttttaagagttacttacccaaaattaccaagtgaaagaggaaatgggatgaagtttatcgccattgttgggaccaatgctagtttttcttataatcgaaaactcctttggtacatgaaaaagcattttacaaaagaagcacaaattgaaatagtagaaattacagacctgccactattttctgaggatatcagagaaattcctgaaggcgttcagaaaattgcagaggcaataggagaagcggatggtttgattttttcaacgcctgaatatgatcatgcgattactgctgctttgaaatcgttgatagaatggctgtcatggatgaaacctcagccattgaacggtctaccggttatgattgttggggtttctctgggaaatatgggaactgtttttgcccaagaaaaccttcgacaaattttgagttcaccgggtctggatgcttttgttttaccttccaatcaatttcttttaggacgagcagctgaagcatttaatcaacaagatgaattgatagatgaacggacaattagctggttggagcattgttttaacaattttatgatttacagtaaaacattaaaaccgatgagatttccttcgccaaaaaaagagaataataaagaaataattgagagtgaggaaagtaaaaactctacagaaaccgaggaagtttggtggactaaagaaacgaatcaaggattgccagttctttccgatgcagatacaggagcttctgagtatgaagaagtgattgaacctgaaaattcggcttatctacaatttttggaagagggagaaacttgggagtttgatgatattggagaattaagaggaaaatcggaagaagaagactgatgaaaattttagaaaaaaagtcaaccttgaaaatttccaaaacttatcgagctttagggacagtcattagcttaacaatttatggtcatcaagacgaggagttattagataaaacttatcaattaatcaagtattatgagcagctttttacggtaaatcgtgaccaatcagaattgatggctgtcaatcataaagcaggaatagagcctgttcaagtatcaggagcagtttatggcttaacaaaaatagcgcttgaaaaaagcaaggaagcatttggttttaatgcagcaattggtcctctcgttaaactttggcatattggcttttcagacgctaaattgccaactcaagcagaaatagatgaaaagttaaaaataattaatccagataggattattctaagggatgatgaattttcaatttttttgccagaaaaagggatggaaattgacttaggagcgatagcaaaaggttatattgccgaccggattaaagatttttggcatgcttacggtatctcttccggcatcattaatctaggaggaaatcttctattggtgggagaagctccgcatcagacagataaaaaatggcgcataggcattaaaaatccattaactaatgataaaaaacctgtgctacagcttttgtctggtgaaggttctgttgtgacttcgggaatttctgagcgttacttgaaagtgaatgataagatttaccatcatattattgactccaaaacaggttatccacaccataatcagctggccagtgttactgttttatccaaaaaatcaattgatggtgaaattgaaacgacccgattattttttgctgacggtccaattgaaaattggctgacagaaaatccagaagtttatggcgctatttttattagtaaagataagaaaataaaagccgttggaattccccaaagtcagatttatgttgctgaccaaagttttgaatttgaataagttaaaatttaagtatagataatttctgtcagtactttttccaataaaaatttactgacagaaataaaaaaaccgccaaaagcggtttttattttttatttcatagttgggaaaagcaaaacgtcacggattgaagttgtgccagtaaagagcatcactaagcggtcaatcccgataccgagtccacctgttggtggcataccgtgttcgagtgcttcaacgtaatcgtaatcgacaccagttgcttcatcatccccaagttctttagctttagcttgagcttcaaaacgttccaattggtcaattgggtcattcaattcgctgaaagcattggcgtattctttaccattgatgaaaagttcaaaacggtcagtaaaacgtgggtctttttcattcattttagcaagtggtgaaatttcttttggatgaccaaaaacgaaagtaggttgaatcaaagtttcttcaacatatttttcaaagaattcgttaatgatatgaccaacagaagtgaaatgtttttcaacatgaatatcatgttcttttgcaagagctgttgcttcttcaaaagtcatctcaggccagaaatcaactccagaaacttccttgatggcatcaaccatgtgaacacgtttgaattttccaccaacattaatttctttaccatcgtattcaagaacatcttgaccaaccactgttttagcaacatgttggaagattccttctgtcaaatccatgatatcttcaaaatcagcataagcttcataagattccattgttgtgaattctggattatgagtcatatccattccttcgttacggaagacacgaccaagttcataaactttttccattccaccaacaatcaaacgtttcaagtgtaattcagttgcaatacgaagcgccatatcaatatcaagactgttatgatgtgtgtagaatggacgagcagcagcaccaccggcttcattgttaagtactggagtttcaacttcaagatatccacgaccatccatataacgacggatttcactgataattttagaacgagtgacaaaacgattgaaactttctttatttgaaatcaaatccaaataacgtttacgataacgtttttcagtgtcagtcaaaccatggaatttttcaggcaaaggacgaagcgcttttgagaggaaagtcaatttttttgctttaattgacaattcacccatgtcagttttcatgatttcgccttcaacaccaaggaaatctccgaggtcagcttttttgaaaatttcataattttcttcgccgacttcatctttacgaacataaagttgaatttggccttcgcggtcttgaagatgggcgaaaccgactttacctttaccacgtttagtcatcaaacgaccagcgacaattcctgaaagtgcaagttcatgcaattcttctttcgtcttttcgtcataagcttcgtgtagttcttgtgagttgtgcgtacgtgtaaatttatgtccaaatgggtcaattcccgcttcgcgcaggttttccattttttcacggcggactttcatttggtcattaagttcttcgatttcagccaaaatagtactccttgtaattttttattctctctattttaacatattttcaaaaaattaacagaaatttttttgtcagtaaacgctttaagcatgggcttgagaagatttttttactgtcagtaaaaaatgctgataaaatgactgacagaaatttagaaaatgatgaatgaccttaaagaatttctgtcagtaaattttttaaaactcacttaaatttttgatttttttaatcacagttttgagcaatttgtcttgttcagacaaaaaagaaagaccataaaaaatgcgttgataacgttcgccaagaccttgaaaagcaatattttcattaataaatcgttttgaaatcaatgacaggccaatgccagccttaagttgactgacaatcatatcattgttattgacgctgaccaaattctttggattaagattattttctttaagataattatgtgtataatgagccacaccagaccctgcttcgcgaataaaaaagatgtcactttctggattgccagcaagaacgagttcatctttaaaaagtgggaaagtttcgatggtttcatccatcatcggtttttcaataattccaaaatgaatttcatgattacgaattaaatcaaaaacctcttgagaatcaagcatcattaattcaatgttaagttgttcaagttcaggaattaaatttttaaaaatcaaaggtaaaacagtagttgctgaactatgggaagcagcaattttaaaaggtttacgactaggtgtctgattttttagggaaaattgtaattcattccaatcatggagcgtttttaaagctttaggataaagaagatgggcactttctgtgggaattacttcttggtgttgccctcttgaaaaaaggtgaacttttagttcttcctccaattttttaattctaacagttgcggttggctgtgaaataaaacattgattagcagctctggtaaagcttttggtttcaaacacagcaataaaagtttcgagtaaagcgaacataaatcttcctttaattaataaaagtaattttaaaaatgataataatttattttacaaaataaaggagattgtgtaaactaattgatgctagacaattaaaaaaggaaaaagtagaaaaatgttaaaaataaaaaattatattaaaaatgatagacaggccataatgagtattttgccaggatttctgctctcctttgccattgctatagtaagttatttactcaatcgtttcatcttccatagtttaggttcagcaaccattgcaatattattaggaattattttaggtaatttgtacttcaaacaagtcactttgtttgcaggaacagcttggtcagaaaaaaaacttctggaattttcagtgatgtttttaggggccacagtcactttccaaaccattggtaagttaggattctccggagtaggatttatactaatacaaatgatttcaacaattatttttgttttgtttatgggcaaaaaactaggattttctgctaatgtttctgccctaatggcttctgggaatgcagtttgtggttcatcagcaattgccgcagttgaaccagttattggagctgaaaccagtgagaaaagaacatcgattgcgatggtcaatcttatgggaactattttaatgctaagtcttccaattttaggaacttggatattcggtaataatgatttattaaggggggcactgattggtggaacagaacaatctgttggtcaagtcgttgcttcagcaacaatggtaaatccaaacacaacaaccttagccactctatttaaaattatgcgaattatcatgctcgtttttgttgttttatattttggtttcagaagtaaaaaacaaaaaagaaatgaacaaggacctactcaaataaaaattaaaagaaattcttttttaccatggtatgttcttggtttcttagtgctttgtactttagatacattgattcattttgtgccggaagtttcagctaccgcaaaatttctatccggttggtgtgaaaccattgccttagctgctattggtttacgactaaatttggttgaatttataaaagcaggaaaaaaattactgatttatggtttatctactttagtctttcaagtagttcttgcacttattttaataagtcttttaatcaaataattagaataaaaaacgataataaagtcactaaaccagagatttagtgacttttttgtgctaattattatcagttaaatttttgaacctagtaaaaaattattaatcaatcggactcattaatgttaaaccagattaatccccaaagtgaagcaatgactaaaaagagtagagcaagcattttattttcctttatgtttgtaaggtttggatagattacttaatagattttattacctctttaagttgactgacagatttttcaaattgtttcttttcataagcatcaatatttagttcaatgacttctctaacaccattttgatttacaatagatggaacaccggtaaagacaccttcttgaccatattcaccacgtaaataggcagaaactggtagaattgcttgttcattatttaagatggctttgacaattctagctgtactcattccaatgccgtaataagtagcctgttttttatcaataatctcataggcagcattttttaccttatttgacaaattagacaaatcttcaacccctatttttttatttttaacaataaattcaagaataggttttccacctaccgtagtgtgtgaccaaaccgcaacttcagaatcgccatgttcgccaataatatatccatgaacactccgtggatcaatttctagctttgtggccaactcttttctaaaacgagtagtatccaaggttgtaccagttccgacaattcgagattgatcaagaccagaagtttcccaagcgacataggtaagaatatccacagggtttgaagcaattacaaaaataccatcaaaacctgaatccataacctgagtcacgattgagcgcataattttagcatttgtattaaccaaatctaaacgtgattgacctggtttttgattcacaccagccgtaacgaccacaatatcagcatttttacaatccttgtaatctccagctctcacaataacattttcttgcccccaagaaacgccatctaataaatctaaggcttcaccctcagctttatcctgattaacatctatcaaaaccaactcattaacaagtccttgattaatcattgaataagcaatacttgttccaacaaaacctgttcctataacgactacttttctgcttgtaattttcatttttagctccttttcaatttttatatatatttttataaagcctatctgttaaaaagccaaagataactaatcatagtacataaaattaaaatgatagaaattacaaaactaatgatgataaaagccaattttatctcctccttcaacgcctttttctgatgtcttttataaaatctataattattctatccctatttttgtaatgtgtaaaatgaatttattttatcgttattattaataaaaataataaaaaacaaaagcagtttgctcatgtttttctatttttattaattctaatgaatttcggtttctttttttattttactaattaatttttgaatcacagggtctttttcttcatcaaaagaaactcctagaaactctctatgataattacccccaagctcttgataagggatatcatcagttaaaaatgatttagaaatcaaagaagaacctaagcctgctttgatatgggaaataatcatctcattgctattcatacgaacaatatttctttgagcagaaggagcggatttgagatatcttttgatataatatccaattcctgaaccagattctctggtaaagaatgtttctgaatccgtatttccggcaagtactaattcatctaaaaataaaggaaatgtttcggtttgatcgctaatgagtaatcgctcaatgattccaaaatgtaaatcatgatttgcaactaattcaaatactttttctgagtcatacatattaatttctacatctaaatgttccaactcgtcttcaaatactttaaagattcttggcataatacttagagcagcactgtgtgaaaccccaattttgaaaggatgttttgcaagagattttttttgtacctctgcttggtcttcctcccatttttttagataggcaatagccttgggatagaataatatggcggcttcagtcggaatgatttcttggtgttttcctcttaaaaataatgttgattttaactcttcttcgagtttcttgattctcacggttacagtgggttgggaaataaataaatattttccagctaaggtaaaacttttagtttcataaacgacgataaaggtctcaaataatgaaaacatgtgattttctccctaaaatacaaaaataacaaattattttttttaatttatatgattataataatttattttacaaattaaatcaactattatatattattaatagaatcaattatttaagacgaattaataaaaaatatagaaagagaagtttatgatgtattcaaaattcatatcatttttaaaacaaattcccctcccgatatgtggcttaattttgggtttaatatccttagggaatctcctttacagtaaaggttaccctattttaggaaatttttacgatatgttaggtttattcctgatgtttttaattttgctcaagatagtactggcaatgaaacatacaatttcgactttgaatgacccaattgtagcctctgtttcaccaacttttacgatgtctttaatggtactaagcgtatttttaaaacgtttgtccggctttagtcctcttgcgaatgttatttggtggactgctttaattttgcatcttatcttaatgatgtattttatttatcttcatgtgctaccaaaagaattaaaaatacatgatgtttatccaagctggtttattacttttgtaggcattggggtaatatcggcaacatcaccagatttcggtcttgaagtgggtaaagttgtggtttggataacattactcttttactttattcttcttcctattgttatgcatagagttttcattttacgaaaaatgcacaaatctttacttcctttgattacaattatcacagcaccaggttcacttggtttagtaggatacctcactgttgtagaagcaaaatctaaaatattcgttatctttttatttattttatcgcaagctatctattttataactttaggcttgctgacaaaacttttgagaagtgccttttatcctagttatgctgcctttacatttcctctcgttatttctgcaactgcggtaaatttaacaagtaaactcagcgtttttcagttcctgaatttagaattattagcgaatatggaaatccttatagcaattgcaatcgttacttatgtgctcatcagatactgtatttttttaggatcaaaattaattcagattatgtctgaaaaatattcccctgaaagtatataaaaataaatcattgataaaaattaccactaggtcaataatctagtggctttttattttgcttttaaaatggagtatattaagctcaatagagccttagaaaatgagacaataattttaaaaaagcctataaaaaaaaggacacattgtgttataattagaacgctgcgtgctttttttctttaaataaagaagatttgactggttttttgacttaaatcattcatttttaatgattaaaagtatgcaaaagaatataggagaataaaaatgactgtattatatgatgaaatcatggttcgttatggtgaactttcaaccaaaggaaaaaatcgtggttactttatcaatcgtttggcaaaaaatatccgcgaagtccttgcagatatgcctgaattaagaattacagcagtaagagatagagcacacattgaacttaatggagcagattatgctgaagtttcaaatcgtttaacaaaagtttttggaatccaaaatttttcaccttcaatcaaagtcgaaaaatcaatgcccattatcaaagaagaagttgtggcactttttaaggagatttatagcgaagggcagacttttaaaattgctaccagacgagctgaccataactttgaattagattcaacagaattaaatattgctttaggagatgttgtttttgataatttctcttacgcaaaagtacaaatgaaaaagcctgatatcacattgcgcgttgaaatcagacaagatgcgacttatcttagttttgaagatataaaaggtgctggaggaatgccagtcggaacagcaggacgtggacatctaatgctctcaggtggaattgattcgccagttgcaggttatttagcgttgaaacgcggagttgagattgaggctgttcactttgctagccctccttacacttcaccaggagctttgaagaaagccaaagacttagcggctaaattaaccgtttttggaggttcaattacctttattgaagtaccatttaccgagattcaagaagaaataaaagccaaggctccacaagcatatttgatgacaattacacgccgttttatgatgcgcgtggttgatcgggttcgtgaagaacgtggtggaaaagtgattattaatggagaatctttgggacaagttgctagccaaacgcttggctcaatgtctgccattaatgaagtaactaatactccagttattcgaccagtagtaacaatggataaaaatgaaattattgaaatagctgaaaaaatcgatacttttaatttatcaattctaccatttgaagattgttgtactgtctttgcaccaccttctccaaaaacaaatccaaaacttgaaaattgtattcaatatgaaaagagaatggatgttgaggggatggttgaccgtgcggtcaaaggaattatgctcacaacaattactggtgaaaactgggaccaaactgaagaagaagagtttgctgatttcttataataaaaaatgctacttataatattatgagtagcattttcatttgattaggaaactacgattgatagtctaaacttgacaaagattggaaacaaggatataattaccaacgttatttataaacttagaaaaaattaattgagttcatcagtataacaagacttattaggaattttatttaaagaagatgatactcaatttataggaaaggattttatgtcagacagaataaaggctttaattgccttagggatatttacatttatgtcaacattggatggttcaattgttaatattgctctaccaacaatgtcaaaggagcttcatgtctctacttctcaaatcacttgggtggtgacaatctatttaattgtaatttcagcgattgtactgatttttggccgtttaggcgatttaataggtaaatcacgaattgcccgcattggttggggaatttttattttaggctcggcacttgctgggttaaattttggttggggcttaggttttcttctttttgcacgggtgattcaggctattggggcgtcaatgtttatggcaaccggttttggaattatttcagaaattttcccacctgaaagtcgagcaagagcactttccatttcagcgatgtttgtatcggttggctcaatcgctggacctgcccttggaggactgattttacaggtcgcttcatggaattatatcttttggataaatgtccctatcggaattttagcatggatttttggaaatcatgctttgccaaaagaaaaaaccagtggaaaatggtcggatattgattttaaaggtggaacattaatgacttctgttattgttttacttttcttagctcttaattttggacaagctttgggttggaccaatccattaattattattggtgcattgcttggctttattctctttggaatatttattttaacagagaaaaaggtcgctcagcctttgcttgatttaggaatttttaaatcaaaattattttcaatgagtattattatggctctctttaattttacagtagcgatgttctcaagtattttgttaccattctacttacaagattttagaaattatgggccaggcttggcagggatgattatgatggcttatcctgttgctatgctgattgctagccctttagcaggttcggcagcagataaaatggataaagaaattgttacttttgtaggaatttcagggattgttttgtcacagctcggctatttactgataaatccgcattctgctccatggctagttgttgttattcttttgattcaaggaatgtctatggggattttccaaagtccgaacaatgctttgattatggaaactgttgatcgtaagtatttaggaattgctgggtcagttaattctcttgcccgtaatatggcctttgttttagggacgtctttagcaacattgattttattcacagcgatgtctaatcagttgggttataaggtaacaacttatttgcacaatcaaccagatgtatttttacacggtttccacgtggccttctatttttcaacatttcttgttttagtgacttgggttcttggcttattccgtttgttgggacgtaaaaagtaaaataaaaacaatctaaatgattgtttttttttactgacagaatttctgtcagtaaaatgtttacatgtgtaaattttcacgtactaaatatattgataatttagaaaagtttgctataataatttttataatacaaaaataatttctataaaggaacaaaatatgtctaaacttcttgttgtaaaaggtcacccacttactgctgattattcactttcactcaaaggtcttgatgcgttcgtcaaagcctataaagctgctcatccagaaaatgaaattgaagaactagatgttttcagtgctgatattccaactttgaatactgaattggtcagtgcaatgttcgcaggtgaaaatgctgaacttacagcttcacaaaaagataaattggctcgttttgctggttttacagaacaatttttgtcagctgataaagtagtcattgctaatccaatgtataacttgatgattcctgctgaacttaaatcttgggttgatacagtcaatgttgccggtaaaacattcaaatatacagccgaaggtcctgttggtttagcaaatggcaaaaaagtcttgcacttacaagctaatggtggagtttatggagcacaagatccagcaacaatttatatgtcagcaatcttcaattttatcggtagcgattttagacaaattgccgttgaaggacatgcttatgatccagaaaaaacagaagaacttcttgctgaattcattaataaggtagagttagaagctcaaacattctaaagaaaagtctgtcattgaacagactttttattgaatttactgacagaaattaggagagtcatattttttctgtcagtaaattgaaaggataaaaaatggtaaaacatctttttaattcacatattgattgggtagggggaagaaattccatcggtgacttacaggctggagcactgaatgaaaaaatttcaattcctaaaactatggatggaccaggagtcggaactaatcctgatgaaatgctactcggagcagccagtacttgttattcgattacattagctgccatgcttgagcgaaatgatattctcctagaacatctgaaagtagatgctaaaggggtagttgatgtgacaaaaggaacctttacttatgaaaaaataacttatcatgtcgctatgaaattgacaaaagagtcagatgaagttaaagcaattaaacttgccaaacgggcagaaagttcttgcatgatttcaagagcgattcaaggaaatattgagttagaaacgattattagaattgaaaaataaaaagttactgacaggactgtcagtaactttttattttaatttttatttttccgacgttctaagaagtcaaaaagtaatgtatgatgattacttgcaagtgaataatcttcaagaatattaacattaagacgcatatctttagcttctcgtgcagtaattgctccagaaagttcatgttcaaaaatgactttacgttccaaataataggcccgcatcatttcggtaatgttgttaggctgagccttattcatcatccgtgaaatatgaccaccagttgcaacgatttcagatgttcttaaacgttctgattgcaagaaattcaatagttgctcatcaaagacaccatttaaattatctagagcttgcaagataagttcggtattattgaaataaagttcagtaatttcatctcgtgttgtttccattgccgcctttgttttcttaaaataaaagtcaacatgtaagacacgagaggtaagtaaatgaaaagcacgtaaggcaataacataaacaaattggatactagaaaccagtgaatggacaatacttgtttctaatgagcgaatatatcgttgataagttcggtaagtatacattgaaattttattttcacgcaaggcaacttcaagaccttcagattcaattcggataatcaaaagttgcaaatcattgtaatcaatcgccatatctgttgactcttgttcaatgattaattgttgaattcgttcctgataagcatcaatagcgatatcataaccctgagggtttttagccgatttcatatcgtgatgtaattcatcaactacttcagataaaatcgcaattttagagatattattaactttagaaacttttttaaccgcaaagaaaggaagaatgaacattccaactaagaaacttaagccagttaccgcagcggctagaaagacgagaacgggttgaacatctacagttcgtggaaccaaaagaatcgttgcgatacttactgttcctttagaaccagcaaaagtgaggagaaatacatcgttccaataagcagaaaatggttgtttttgtttaagggagcgaagccaataataaaaagcaatgacaacaaatctgagtgcaaataatccagcagtcaaggcaagagcaagaacaattaaaagtgctgatgaataaacaggatcaactaaaagtggaactacaagttgataaagttcaattcctaagaaaagaaagacaaaggaatttaaaataaatgttaaagtatcccaaattgtactcttgagtttttcaacttgagcatcaaataaagtagttctcttaagaccgtttgctgacatgactccagcaacaactgcagcaatgattccagaaacatgtaattcttcggaaatgagaaaggcagcaagagggacaaccagctctaaaagaagataaccagaaacatcccgtgcgtcaacatcttccagaagtcttaagacaagtcctttgatgtaaattaaagtaaaaccaatagcagctccaccaagtgctgaaataaccaatttcattgttgcatctgggaaagagaaataaccggtaactaaagcaactaaagcaatctgaaaagaaataattccggaagcatcattgagcaaaccttcaccttgcaaaacactcataacccgacgagggaaagagaaattttttgataaagctccaacagctacagcatcagtaggagcgagacttgctcccaaagcaaaacaagcggctaaaggtaatcccatataaatccaattagaaatcaaacccaatccaagggttgtaataaagacaagagggaaaattaaaactaaaataattttactatgttttaaaatgtgtttgacatcagcttcctcgctctctctaaaaagaagaggagcaataataaatcctaagaaaaattcaggtgcgacatgtaaaacctcgtcagcaccaaaaaagcccaaaataagtcctaaaaccacttgaataagagggagggcaagttttgggaaaactttgttaaggacatttgaaaaaactaataccaaaaggaaaacaatgacataaaaaataatatggagcatagagtcctttctgtgtaattgattaatgagcgccaaaaagtacaaagtagagctatcaaagctagctctaccgtacctaatctactaatttatctcaaacgattaattgcttttttctttaaagcaattttttcattgatttttgagcagtcttttttacctaaaagcgctttacaacgtttgagttccaaatcagtgagttgacgttttacacgttctttacgagcagcatcaaactcaccatttttaattaattcaagtttttgttcaagaattaattttttatttttaactgcatcaatataatatttaagctcagaaatatcatcggcacttgcatttttagccaacaaatcccctaatttttcatcaagggtaacaagcttatcagtaagtagttcaagtttagcgttgagcttttcttctttttcttcatccgaaagggccatgaaagcttcaaatttcttactatcatcaagtttttcagattcttcaggacgtttattgatgtacatctcacgcaatttatttaacttatcttcaaattttttatctatcattttgatcacctaaaaacatattcagtacagttattataacatattgtggcctaaaagaaagagcaatgctcaaatttttttaataaaaaattctgtcccatttagaacagaatttttgttttattaataagtcaaaacgaagtttttctttttcccacgacgaatgacagttaaacgattttcaattttatctgaatctgtaagaacataatcaagtgcttgaacacgttcaccattgatataaatcgcaccatttgtaatatcttcacgagcttgtctttttgaaggagctattccagcagagattaaaagttcaactaaagttaaatcttcatcatcagtaacttgatgttgtggagctgctttaagaccagttaagattgatttagcatctaattgacgcaaatctccaccgccaaataagatttctgatgttttaactgcttgttcataagctgcttttccgtgaactaagctgacaacttcacgagccaaaactttttgggccaaacgctcatgacgagctgcttcaaattgttcttcaatctcagcaatctcttctaatgaaaggaaggtgaaaattttcaacatttttacagcatctgcatcatcaacattaagccaaaattggtacatttcataaggagatgttttatcagcatcaagccaaattgcatttccttctgatttaccgaattttttaccagttgaatctgtaattaatggaatagtaataacatgaccttgcttgttagctttacgacgtaaaagctctgttccagcagtcatatttccccattgatcagaaccaccaagttgtaaagtaacattgtgcaattggttcaattcgtagaaatcataaccttgcataatttggtaagcaaattctgtataagaaattccactttccatccgtgattttacagagtctttagaaatcatgtagttaacggtgaaatgtttacccacatctctgaggaaatcaataaaagtcagattttcaaaccagttgtagttattggtcatttctgccttattttcaccattttcaaaatccaggaaacgctcaagctgactacggatttttccagaccattttgttacagtgtcttttgtttgaagtgaacgttctgaatctttgaaagaaggatcaccaatcaaaccagttgcaccaccaacaagcgcataaggtttatgtccagccatttgtagacgtttcattgtcaaaattagtacaagattacctaaatgaagggaatcagcggtagggtcatatcctacataataggaaaccatgtcctccgtcagcgctttagaaagcgcagcttcgtccgttgtttggaaaaccaaaccacgtgctttaagttcgtcaaaaatgttcataaaaaaatcctttctataatgattgagctgtccactttggataaaaagtaaaaaaattaacagcactgttttacattataacaaattaataaaaaaaattctgaaagtggcgaaaaattattttaaatttgatataataaaggcatgaaaaaatcctcaattgactcgcaagaagaagcacgtgcgcgtttaaaagaaaaaatggaaaataagcggcggaaacaaagtaagcctctgtccaaaaatcctaaagataatgatgaaaaatcgggttggtcaatcacttttaaggtggtccgcggactaattgtaatttttggaataatttttgctttagcgggtgtctttggtgcggcgacaggtgtaggctattttgctcgattggttgagcaaacgaagacaccagataaaacggaaatgcttgcaaaaattaatgatattcatggcgtttctgtcattaattatagtaatggtcaaccaatttcggatatctctagtgatttggtgcgtgttactgtcaaaagtgacgagatttctcctaatgttaaaaatgctttaattgcaacagaagatgatagctttaaaacgaataagggcgtggttcctaaggcagttgttcgtggaattcttggttcagtaggtggtggcacaagttctggtggttcaacccttacccaacagttaattaaacaacaagttttaggagatagtgttaccttccaacgtaaagctagtgaaattgtctatgctcttaaacttaatagctacttgagtaaagaccaaattttgactgattatttaaatgtctcaccttttgggcgaaacaataaaggacaaaatattgcagggattcaagaagccgctcttggtatatttggaaaatctgctaaggatttaacaatacctgaggctgcttttattgctgggttgccacaaagccctatcgtctattctccttatgcggctgatggttctctaaagtcaaaagaaaacatgagttatggtctcgagcgtcaaaaagaagtcttgttttatctttatcgtgggggctatatttcagaagctgattacaagaaatacaaagcttatgatatttcaacagaatttttacaaccaggagtagctcaatcacaagaacatggttatttatataatgttgtttataatgaagcaattactgatatctataattatttgattaagcgagataaagtttcggcaactgatttaggaaatgatagtactaaacaacgttatcgagaattagctgaacagtcattgcaaaacggtggttatacagtaactacaactattaatcaacaagtatatgatgcaatgcaaaacgctgtaaccaattacagtggcttgatgcaagacggtacgggtcttattcaaactggtaatgtattaatggataataaaacaggggctgtttatggctttattggcggtttggatttttcacaaagccaagtaaaccatgcctttgatactaaacgttcacctggttcttcaatcaaaccaatactagcttatggaccggcaattgacatgggcttgatgggttcagcaagtgttctatctaactatcccgcaaaatattcgagtgggcaagacatcgaacacgtcggcaatatgggaacggagatgatgccattttcagaagccttgaatgtttcttataatattcctgcttattggacctaccaaacgattttgaataaaggaaaatctgttgaaccttacatgacgaagatgggatatgatgttgcagattattctgtagagtcacttcctcttggaggaggaattgatccaacggtagttcaacatacgaatggttatcaaactttagccaatggtggaaaatatgaaccatggtatattgttgatagtatcaaagatgatacaggaaatgtaatttatcaacatcaaactactggggggactcaagtatattctgaagcaacatctaccattatggaatatatgcttcaagatgctattaaatctcaaaaaacaagtaagttttatggtgagttacaaagccttaattcttctcttgcaactaatgttcaatgggctggtaaaacaggaacaactgataattatacagacgtttggatgatgctttcgacaccttcagtgacacttggtagttgggctggtcatgatgacaattctgcaatgtctcagaattcaggttttattaataacgcaaaatttacagctaatttagtgaatgcaattaatgctgccgatccaaatattttcggacctggtcaaaaatttaccaaccctaatagtgatccaaatgtgactaagagtaaagtattagtttctacgggtgaaaaaccaggaaaagttaatgttaagttatcaaatggtaagacacaagaggttaatctcggtggagacactacgacaagcttctgggctacaaagtctggtgctcctacaaccacatatgatttttctattggtggttcggcaagtgatatagctgctggttggaaaaagatattacctaattataacttcggtcaataaaatacaaaaaatcactaggataggtttcctagtgattttttcttttgtttttaaatttaatagtttttaatttcagctactttttcagtactaagtgatgttacgatatttctcaagaaagtttgtgcttgattgaaatcatcaatattgaaaattgtttgatgactgtgaatataacgagcgacaactccaatcgttgttgaagggactccattattagctaagtgggcagcacctgcatcagttccacctttagccatataaacttgggttttaactttagcattatcagcagtttcaagcaagaaatttttcattccagggagcataatatgacctgggtcaaagaaacgaagcgttgttccttctccaagacgaccgttgtcatcaccaaacgtatcgctagcaggtgaacaatcaacagcaaagaacaaatcaggcttgaacatagttgtagaaactttggctccacgaaggccaacttcttcttgaacattggctccgataatcaatgtagcaggcaattctttgtcagctaaaaattcaagaagttcaagaatcattaaacaaccgtaacgattgtcccaagctttagaaataatatttttaccattagcagagagaattgtttcagtttctggaatgattacatcaccttgagcgattccaaattctgcagcttctgcagcattctcaaaagctccatcaaagacaatatcagaaatggctggaatttgaggagtaacaccggttccacgaagaagatgtggaggaagcccaccagttacgacaggaatttttttacctgtacgtgtgaataatgtaaaacgttgtccagagacaactaatggattccaaccgccaagtggaacgacccggaatgttccgtcagctttgattgagctgaccataaaccccacttcatccatgtgggctgcaatcataatacgtggggcatttgctacttttgaagttttagtgacaaatataccaccaagaccatcaaattctggttgataaccaagatcaatcatgcgtgtttttaaatagtcacgaacaggtccctcaaaaccagaagtcgcttgaatttctgtcagtgcttttactttgtcgaatagtttcatttttctcctccggaatactgaaaaatttactgacagatttgtcagcaaaaattttgatgatttacactataattataccaataaatatgttaaaatttccatatgaaaaaaatactaaagtttggtttgggaattattgcgggtgcaacagttgctcacgttgcttatcatggctataaaactatggaagaagaagtgattcatgaacttactgacagagctcggcaacatttttcaacaagaaaaatagacgctttttggatttttgaggagccaactacgggtgctctttttgagggaggacttgtcagtgaaaataaggcaatcacttttgaaatcaatgctaaaactttagaagtctttgaaaaaaatgaagaaattctgtaagaaagcttagtattcatttagaaataaaaggagaatgtagaatgattattccagaaaatattgaaaatttagccgaacttgtaaaaggaccggaaaagacagtcttctttttcacggctggttggtgcggagattgtaattttattaagccaaaaatgccagaaattgaagtagaaaatccagactttaaatttgttgaagtagaccgtgatgaatatatggatcttgcgattgaatggggaattatgggaattccaagttttgtcgtgattgaggatggtaaagaaaaagctcgtttagtaaataaattacgtaaaacaaaagaagaagtcaatactttcttagcgagtgcgaaatagtatcatcgcaggacaagcattgatatattaagaattatattctataataatcaatgttaagaaattaaaagggaaaaataagaaaatgattgcaacatacaacacaaatgtcggtgacgttttaatgcttatcactgcaaatgataagggagaaaaagtaaacttcgaacgtaagggaaaagtagctcgtgtttttattgaagaaactggagcgacggttgcttggaatatttttgaagcgaaatctctattgggtaatttatcaggagatggtcaagtcaacttatcatctgatgatattgaaacgttgaacaaagagcttgggaaatcaggatttagcgatgttcttgttcacgatgcacaacccaaatttgttgtcgctgaaattgttgaaatggaagatcatccagattcagaccatttacatatctgtaaagttaatgttggttttgccgacccagtacaaattgtttgtggtgctccaaacgcagcccttggtttaaaaacagttgctgctttacctggtgctatgatgcctaatggctcattgattttcccaggagcccttcgaggtgttcaatcttacggaatgctttgttcagctcgtgaacttgaattacctaatgctcctgaggttcgtggaatcattgaattatcatcagatttatctgctggtaaagcttttgattcagaaacaatgtggcaagcataataataaaactgtcaaaatagtttattttggcagtttttttatctaaaaaaataaaataattttttcacaaagttcacaagcgcttacaaaagaaaatagaatgacttatgctaaactgaataatgtaaaaagaattttacatttaaaggaggattattagcatgaaaatcgtagttatcggtacgaaccacgcaggtatcgctacagcaaatacattaattgatcaatatccaggccatgagattgttatgattgaccgtaacagtaatatgagttacttggggtgtggaacagctatttgggtcggaagacaaattgaaaaaccagatgagctgttttatgccaaagcagaagattttgaaaaaaagggagtaaagatattaacagaaacagaagtttcagaaattgactttactaataaaatgatttatgccaagtcaaaaactggagaaaagattacagaaagttatgataaactcgttctggcaacaggttcacgtccaattattcctaacttgccaggaaaagatcttaaaggcattcattttttaaaactttttcaagaagggcaagccattgacgaagagtttgctaagaatgatgtgaaacggattgctgtgattggtgctggttatattgggacagaaattgctgaagctgccaaacgtcgtggaaaagaagtcctactttttgatgcagaaagtacttcacttgcttcatattatgatgaagagtttgctaaagggatggatgaaaatcttgcccaacatggaattgaactccattttggggaattagctcaagagtttaaggcaaatgaaaaaggtcatgtatcacagattgtaactaataaatcaacttatgatgttgacctcgttattaattgtattggatttacagccaatagtgcactggctggtgaacatttagaaacctttaaaaatggagcaatcaaagtggataaacatcaacaaagtagtgacccagatgtctacgccgtaggagatgttgcgacaatctattctaatgctttacaagacttcacctacattgcccttgcctcaaacgctgttcgttcagggattgttgctggtcataatattggaggaaaatcaatagaatctgttggtgtacaaggttctaatggaatctctatttttggttacaatatgacttctacgggcttgtcggttaaagctgcgaaaaaaatcggcctagaagtttcatttagtgattttgaagataagcaaaaagcatggttccttcatgaaaataatgatagtgtgaaaattcgtatcgtttatgaaacaaatagtcgcagaattattggtgctcaacttgctagcaagagtgaaataattgcaggaaatattaatatgtttagtttagctattcaagaaaagaaaacgattgatgaattagccttacttgatttattcttcttaccacacttcaatagtccatataattacatgaccgttgcagctttaaatgcaaaataaaccataaaaatctatcaattgatagatttttatttttttttgtgacaaatgctctaacttttcgtataaaaagttaggaggattttattatgaataaaaccatgttaattggacgcttaaccagtgcgccagaaatttcaaaaacaacaaatgataaatcatatgtccgtgtgaccttagcagtcaatcgccgtttcaaaaatgaaaaaggagaacgcgaggcagattttatttcaattattatttggggaaaatctgcagaaactttggtttcttacgcaaaaaaaggaagtcttatttcaattgaaggagaaattagaactagaaattatacggataagcaaaatcaaaaacattatgtcacagaaatcttaggactgagttatgatttacttgaaagtagggcaacaatcgctttacgagaaagcgctgtaaaggttgaagaaaccttacttgatgcggaagaactccccttctaatttatttcataaaatctaaatgttttctcttgactaaatctgaccattgagataaaataagaatatattagcactcgtttaataagagtgctaaaaaataaaaaatggaggaaaatataatgttgaaacctttagagaatcgcgtagttttacgtgtaaaagaagaagaggaaaaatcaatgggtggaattgtgttaacaagcgcttcccaagaaaaacctcaaacagctgaagttgttgccgtcggtgaagggaaaacaaatcatcatggaacactgatttctccactcgtaaaagtaggggacacagtaatttttgaaaaatttgctggaacgaccgtaaaaatggatggtgaagaattcttgattctcaaagattcagaccttcttgcaattgtagagtaaaattataaaagcaatcatttttttggttgtcttttgtctatcttaaaatctataaaattaaaaatatattcttaaaaaggagctaaaatgtcaaaagatattaaattttcaagtgatgctagaacagcgatgatgcgtgggattgatattcttgctgatacagtaaaaacaacccttggaccaaaaggtcgcaatgttgttcttgaaaaatcatatggatcacctttaattacaaacgatggtgtaacgattgccaaagagattgaacttgaagatcattttgaaaatatgggagctaaacttgtttcagaagttgcttcaaaaacaaatgatatcgcaggtgacggtacaacaacagcgacagttttgacacaagctattgttcgtgaaggtttaaaaaatgttaccgcaggtgcaaatccagttggtattcgccgaggaattgagcttgctgctgagacagctgttgcgtcaattaaagagatggcaattcctgtccacgataaatcagcaattgcgcaagtagctaccgtttcatcacgtagtgaaaaagtgggtgagtatatttctgatgcaatggaacgtgtaggttctgacggagttatcaccattgaagagtcaaaaggaatgcaaactgaactcgatgttgttgaaggaatgcaatttgaccgtggatatttgagtcaatatatggtttctaatacagaaaaaatggttgctgagttagataatccttatattcttattaccgacaaaaaaatctcaaacattcaagaaattttacctctccttgaacaaatcttgaaaacaaatcgtccacttcttattgtagctgatgatgttgatggagaagcattgccaacgcttgttcttaataagattaaaggtgttttcaatgttgtagctgtaaaagcaccaggatttggtgatcgtcgtaaagctcaattggaagatttggctatcttgacaggtggtacagtaattactgaagaacttggtcttgatcttaaagatgctactcttgaagctttaggacaagcagctaaagcaactgtggataaagaccacacaacaattgttgaaggtgctggttctgctgatgctatttctgatcgtgtagctattattaaagcgcaaattgaaaaaacaacttctgattttgaccgtgaaaaattacaagaacgtcttgcaaaattagctggtggtgttgcagttgttaaagttggtgctgcaactgaaacagagctcaaagcaatgaaactcttgattgaggatgcacttaatgcaacacgtgcagccgttgaggaaggtattgtttctggtggtggtacagcacttgttaatgctattgctgctttggataaactttcagaagaaggagatattcaaacaggaattaacattgttcgccgtgctcttgaagaaccagttcgtcaaattgctgccaatgcaggatatgaaggttcagttatcattgataaacttcgttcagaaaaagtaggtacaggattcaatgctgcaactggtcaatgggttaatatgattgaagaaggaattgttgaccctgcgaaagtaactcgttcagctctgcaaaacgcggcttctgttgctggtttaattttgactactgaagcagtagttgctaataagccagaaccagctgctccagctatgccgccaatggaccctagcatgggaatgggtggtatgatgtaataaaaaaagaacccttagggttctttttttatttgctgatgagtaactaaatatcgtaaagttgactagcatgttcgtgactagtatcaaggatcttcaagtcctttttagtatcgacatcatgttgctgtaagtaaccatccatagtaagatgagcaagttctttgatattattatttaaactcaagtgccctagaaaaattcgttttgtcttattgccatgaatactaaaagcagcctcagcgccgtcctcattagataagtggccttggtcacttaggatacgttgctttgtccgccaaggataggctcccatgcggagtatctcaatgtcatggtttgattccataagataagcatctgcattttcaatggttccacgcattctatcggatacataacctgtatcagttagcataacaaaacttttgttatctttcatgaaacgataaaactgtggtgcgatagcatcgtgactcacgccgaaagattcaatatcaatatcaccaaaagtcattgtttttcccatttcaaacagatgtttttgttcaacagggatttttcctaaagcatttttactatctagttcagaccaagtatcttcatttgcgtaaaggtcaataccatattttcttgccaaaacaccaatccctttgatatggtcactatgttcatgggtaattaataaagcatcaatatcatgaatgtcacggtcaatttctgatagtaaactttctattttttttccagatagcccggcatcaacaagaattttcttctttggagtttctaagtaaaaagaatttcctgttgaaccagaggctaaaatggaatatttaaagccattttgttcagtcatacagtctattgtagcagaaaaatagtgggattgccatgagcttttatattttatttgaaaataaatttatcaggaaattcattagcttaagagagttttttgtggtaaaagtctaggtttattcataaaaaagagtccacaaatatgtatggactctttttagggaaaattattcattatcctcaaattcaaactcatcagtgccatcatcccagtcatctgcggcttctaaagaatatggaagagtgaaactaaaggtagttccttttccttctccttcagaacttgcaaaaattgttccgccatgtattttaacaatatcatggacaatagagaggcctaaacctgttcctccaacttttgaatttcttgaagcattatcaactcggtagaaacggtcaaaaattttaagtaaatcagattttggaatccccattccttggtcactgatggagattagaacatcactttcacgtttttcaacggaaattgtaatagttccacctttaggtgaatacttaattgcatttccgatgatattgtcaatgacttgagcaattttatcggtatcaatttcgacccagatgggctgttcagagtattttctgactagagtgaaattagaagagattaaatcgtttgattcggtttctaaaatttggtctaaacggttaatttgatagtctaagaaggcaattaaattaatcgtttctttattaagaacgattcggtcttgatccattcttgataaagtcaaaaggtcggaaatcattcgaatcatccgattagtttcagtaagtgaaacattaataaaggatgaagctgtttctttatcctcaatagctccgtcttctagtgcttccaagtaggcttttactgaggtgagcggagttcggagttcatgagaaacattggaaacaaagagacggcgctctcgttcggccttatcttgttcagtcatatcatgtaaaacggcaataattcctgagatgaaaccagattcacgacgaaagagggcaaatttaatgtggagcgaaatggattcattcccagcatcctgtgtctcaatagttatttcaggttctttttctaataaatcataaaaattatattggtcagaaatttttaagacttcaacaatatttttttgcatcaagagatcattatctgtattcaaatagtgcaaagctgatttattggccataataatatttccgcgccggtcggtggcaatgacgccatcaaccatatatgcgaggatactatctaattgattacgctgattttcaagattgttctgtgtgcgaacaatatcttcaccaagttttaaaatttcatcgtataattcattgatttcactcgtcccttttgggattttatcacgatttaaatagccattttttatgtcattcatctgtttagaaacattcacaatcatgcgatgttgctgattgagaaagactaaaacaaagacgagtgaaaataagtaataaccaataaaagtacttaaatgagcaaaattgtaatcaaaactgctcataaaaaggatgacaaaaagaagtaggtgtgcaactactcctttaaaaatcattgaattaaaaaatttaatcatgtgggttgctcatgtagtagccaaccccgcggcgtgttgaaacgtattgtggacggcttggtgtatcttcaactttttcacgtaaacgacgaacagtaacgtcaactgtacgaacatctccaaagtagtcataaccccaaacggtttccaaaaggttttcacgagtgattacttcgccaaggtgttgagcaaggtagtaaagcaattcaaactcacggtgtgtaaggtcgagttgtttatcatttttataagccgcatagtgtgctggattgatacggaggtttccgataatcaattcttttttgacattgtcagtagattcagcaggcgcgacattgatacgacgcaagtttgctttaatacgagctaaaagttcacggtttgaaaatggttttgtgacataatcgtcagcaccaagttcaagaccaattactttgtcaaattcactatctttagctgacaccataataattggagtgtcagaagttttacggatttctcgtgcaacatcaagaccatcaagtttaggtaacatcaaatcaagtaaaataaggtcaggttgtacttctttaaatgcttcaagagcttcttcaccatcaaaagctgtaaagacttcaaaaccttctttggttaaattaaattttacgatatctgagattggtttttcatcatcaacaacaagaatttttttcatagttgtcctttcaagtggaaaattttttattgaatgttactcgtatttatttgaattaacaaatcaagtaagctgtttcagttatattatacaatttttagtaaaattacgcaaaaagtgacgctattatttttagaaaaaagataaaatgtttgtttttttggtataatagaggctatgaatggaattctaatttcccttgagggacctgatggagcaggaaaaacaacggttttaaaagaaattttacctgaaatccaaaaaatgaagcgtgaaattgtcccaactcgtgaaccaggtggtgttcgagtagcggaagaaattcgccaaattattcttgatccaaagaatacagagattgattctaaaactgagttaatgctttttgcggcggcgcgccgtttacatatgcaagaaaaaatgttgccagctttacaagcaggtaaggttgtcattgttgaccgatttattgattcatctgtcgcctatcaggggtatggccgtgatttgggtgtcgaagttgttgattggcttaactattttgcaacagatgggttgaagcctgatttgacgctttattttgatgttgatacggatgttgcccttgagcgaattatgaaaaatcgagctgatgaggtaaatcgtttagatttggaaagagctgagatgcatcgtaaagttcgtgaaggttatttggagattgttgcaaaagaacctgagcgttttgtaaaaatagatgcaagtcaacctttagaaaaagtggtagctgatacactttccgttctcaaaaaaagatttgtcagtgaattttaaagacaatttaatctgtcagcaaaattaagaatgctaaaaaatacttacatttttcaaaaaatgaggatgttaaatagtttttttaattttgttatttagactagatttggtaaatatttagaaaggtttcttgtggaaataaaagatattcagcctcaactttataagcagttctcaacgattttgcaacatggaaaattaagtcatgcttatttattttcaggtggatttggttcttttgaattagcaatctggctgagccaagccttattttgtgagaatcctgaaaatgctttgccttgtggtcattgtcgttcctgtcgtcttgttgcccaacaagaatttaccgacttacatatcgttgaacctgatggacaaacgattaaaacagcacaaattcgggagctgacacaggttttcaatgaatctggttatgagggaaatcaacaggtgcttttaattaaggaagctgaaaaaatgcatcctaatgcagcaaatgctctattgaaatcaattgaagaaccagaaacagaaattgttgtttttttactgacagacaatgaaaatatgattttacaaacaataaaatcacggacacaaattattaattttccaaaaaatgttcaatacttacaagattttttggaaaagaatggtattttaaaaacacaagcagaacttcttgcggaaatctgtaattcgactgacaaagcattagaattagctcagcagagctggtttaacgaaggacttcaaagacttcaacaatttgtaaaacttctaaaaacatctgctgacgaggcattcttgtatttgaaagaattagtcgaaatttttgatgacaaagaaaaacaaaatcaagcgtttgaacttttattacaactttttaatcaagaaagaatgagtcaggaacttttaaaaacatttcaggcaataaaaatgtggaaaagcaatgtccgatttgagtcaagtttaacttttattgttttatgaaacttgtcaaacttatcctttgattgaaaaatcttatatcaggagaatattatgatttatgaaataaaatttgcacatggcgaatcaaatgtatttgcaataagtgatatagaacttgctccacaaacagaagttatccttcgatcagataagggaaacttttacggaaaaattgtacgtgaaatttctgaagaagcgaatcttgaaattcaccacacgattgtgcgtgaagtaaatgaggatgatctccaagttatagcaaaacttgaagaacgttctaaacaagccaaagataaagttcgccaccttgtcattgaacaaggtttagaaatgaaaattattgatgttgcttataattttgaccaaatgcaactttttatttcgtttacggcagagaatcgtgttgattttcgattgcttttgcgtgagttggcaacaacttttagaattaggattgaacttcgccaaattgggccaagagatgcggcgaaaattcatggtggacttggaccttgtgggcgtcctttatgctgttctgagtttgtttatgaatttccaaatgtttcaatcaaaatggccaaaaatcaaaatctatctttgaaacaaaataaattaaacggtctttgcggtcgtttgatgtgctgtttaacttatgaagatagtttttataaagaagcccaacaacttttcccagattttggtgagtttgtaactacttcagaaggaaaaggaaaagttgttggcttaaatgttttaaaaaatagagtgaaaatccgctttggagaatatagcaaggattttgaacttgcagaaattgaggtgaatcatggctgataaatatgatgttttcgaccaactgggcgaacttgaaaatacattaaataccacattagcgcaaatttcaggaattcgccaagtgcttgaatcatcaatgactgaaaatgcaaccttacgcatggaattagaaaaattgcgtgaccgtttggcagaatttgagaaaaaagaagttaaaaaagaaacgcctaaagaccagccaaatcctaacttgattcaaatttttaatgaaggtttccatgtttgtcatctgcattatgcagaacgattggctgaaggggaatcttgtttagattgtttggagcttttgtatcgctgatggaaaataaatttagtattcaacggtcatttaaaggcctaaaaactgctggaagtctttatttggttccaacaccaattggcaatatgcaagatatgactctacgttctcttgaaactttgaaaactgtagatttgatttgttcagaagatacgcgaaatactttgcgccttttaaatcattttgaaattaaagttccgcaagaatcttttcatgaacataattcccaagaaaaaattcctaaattaattgattttttgaaaaaaggacaatctattgcacaggtttctgatgctggaatgccttcgatttctgacccaggccatgatttagttttagctgcaattgatgaaggaattgatgttatcgctcttcctggcgcctcagcaggaattactgccttgattgcctcaggattagttcctcaacctcatattttttatggcttccttcctagaaaaaaaggggagcaacaaaagttcttgaaaagtaagctttcttatccagaaacacaaattttctatgaaagtccttttagagttggggatactttggctaacatgcaggaaatttatggagatagagaagttgttttagttcgcgaattaacgaagatttatgaagaatatcgtcgtggtaagatttcagaggttttagaatctttaacggaccaaccaataaaaggggaatgtctaattattgtttcaggagcggatgaagtggctcaagaagttcaagagccagaattgacagcgctcgaagcagttaaagttttagttgaacaaagtgtaaaacccaatgttgccattaaacaaattgctaaagaacgaggtctaaatcgtcaagaattatatgcagaatttcatgatttataagcaaaaagttactgacaggcagtctgtcagtaacttttttatatttttgattgtttaaaatttctgtcagtaaaatttaacagtgcccgtcaacattttcgttaatccatttttgattttcctcatcaaaaattcttaaagaacgttgtgaacgtacaaaatcaatgatttctttacgatttagctttgttttactgacagccgagccaacagtaacaatttccattttttcgatgagtgattgaagaatttcgtattgattttccataagttatccttagtgcaaattgatagattcattataacaaaaaaagatggtcatcaaccatcttaaaaagagtaaatccaagtatttttagcgccattttttagaagacgttgactgatacgaatagcatctttttcattttcagcaagagcaaccatgacaccacctagccctgaaccagttaatttagcaccaagtgcaccatttttacgagcagtttcgactaaattatctagacgtggatgagacactcccaaatcagataatctttcatgagctttattcatgacatgaccaaattctttgagtttgtctgtcatcaaaaaatcttttgaatcggtcgctaattgacctaaatgattaattgaatcttgtgttttttctttttcttcaacaagtttttcgcgaacaatattgatggcttgactcgtaaagccgtgaacaccagtatcgccaatcacgataaaaccatgaagattgagttcaaagggttcaattgtgctgtctttaataaaccacaaagggtgttcagaatttacagttgccacatcaattccagaagattttccgtgagtaatattttctgaaaagttggcataaaagagtaaatctttttgcggaagttcagcatcaaagaaatcataaaaagctctgataatggcagttgccaatgaagcagaagctcccaagccacgtccttgaggaatatttgaatcaatttctaaagagaatggcaattttgatgaatgaaatttagagagtaagcgcataatgagttgacgaattccttcaaattcatctcccattaaatcaagtcttctacgaaattcgttattttcaatgtattggccatattttgatgaggtaattgtcactgtagttttaagaattgttacaggtaaggcaattgctggctgaccatatacaacggaatgttctccaattaagattagtttggaatgggcaattcccgtccccattttattgatagtcattattaacaattctcctgctagattagtttctcattttgaaaatgtgaactgcaaattagcatttttgggttaaattaaagtcttatcgaaggaaaaattcgataaactttttccaatatcataattatgaatacaaaaacgtacctgacaattttataaaatttcctcttgaaaatcaagtttttgtttctcttttggctgtaaattcatcatttagtctgaaaaaatgtattttttagtgtaaaaaataacttattgaaacgataggagagaagaaagaatcaaatttttgatataatagtttcatgaaaaatattgttactgcaagggcgcatacaaatatcgccttgattaaatattggggaaaagcggatatcgctctaaatattccaacaacctcttctttgtcaatgactctggagccattttatacaacaacctctgttgaatttactgacaatgagtctgattccttgattttgaattctgaagtggcaaacagcagccgtgtcagtcaatttttggaaatgatgcgtggacaatatggaaatttccctaaagtaatgattcaatcagaaaatcatgtgccaacagctgctggtttggcttcaagtgcttcaagttttgctgctctgacagctgctatgtttggacttttagatttagaaaaagatgattcagaaatgtcacgaatagctagacgcggttcagggtcggcttctcggtcaatttttggaaatttttcagtttggaataaaggagaagatcatcaatcttcctttgcggaatctttttacaacgaagatattggtctttcaatgattgttgctgaaatctctgctgaaaagaaaaaaatgtcgtcaactaagggcatgcaattggcacaaactgcaccaacttacagtgcttgggttgaaaaatcagccattcaactggaagaaatgaagcaggccattttaaatgctgatattgaaaaagttggtctaattgctcaggataatgcattaggtatgcatgaacaaaatcgtctctctaaccaaccttttgattatttcacgcatgaaacaagacgagtgattgactttgtgaatcaggcctaccaatcaggattgcttgcttttgtgactatcgatgccggcccaaacgtcaaaattattactgaccacgcgactgaaaaaattctcttagctaaattacaagcggaatttccaggattaacatttgatatcgcacgtgctgggggtgcttatgaatatctctgagaagaaaatgacgatcaaagtgccaggaaaacttttttttgcgggggaatattcggtcacaaaagaaggaaatctcgcccttatcacaacaattgaaacaaattttgaagtaagaatttcagctactacagggaaatcaatttttaaaacaaatgttggattgtctgattttgaattttctttgtctaaaattgaatttactaaagaaaatccgtggaattttgcactgacagctttaaaaaatactttgtcagctgctgacagcattgaaaaaaattctgtcagtaaaattttatcttcatctccagaaatatctcttgagattgtcagtgatttaggctttggtgaaaataaaaaaggctacggctcaagtgcttcagtcgtttgtggtctagttaatgcagtcaatcagttttttgatttgcagttgtcacttgaaaaacgttttgaaattgccgcaaaaacacattttgaagttcaaggttcaggttcaatgggcgatattgctgctattatgtatggtggttctgttttttatcaaaatcataagcgagtcatacctctcgaaattccttgggcaacttatgtggttcaaacaggaaaagcggcaaaaacgagtgaaaaaataaaaataaagctttctgatgaattttatcaagcttcaaatgagctggtcattgaattggcaacggcgattgatattcaagattttgctttattcaaagaaaagttatcagaaaatcaacttttgcttttggagaatattccagaaggttatatgactaaagaattagctattgctttaaacttactcaatagctatcctgaatttgctgctaaaatctctggggctggttttggggagaatattattttatttgctcaaaatacccaagctattgctgaagtccaaaataaattatcggaatatggaatcaatcttgaaaaatttaaggttgctcaaaaaaataactgagataagtctgctaaaaaagcagagttagattttaatgaattgagaaataactgatgaaaactgaaaaagaaatccatcaacatcgcaaagatgaacacttatcgttagcttttaaatattggcgtgaagaaaaaaatcagaccttgggcctgactttttctgatagtcgaatcattcctaatagtttgccagaattatctactgaaaaaatcaacttttcatcagaagtatttggacagaattttgaatttcctttttatattgaagctatgactggtggaacagagcgagcagataaaatcaatcgtcaattagcagaaattgcgaaaaatcaacatttagctatggcggtcggctctcaatcgattgctttgaaatttccagaattagctgctggtttcagtgaagttcgtaaaattcactcttctggttttctttttgccaatatcggcgcaggtcattctctagaaaatgccaagcgagcggtggatatgattgaggcaaatgctttagaaatccatgtcaatacagcgcaagaattgccaatggatgaaggagaccgtgaattttattggttagaaaatattaatgaaattgcaagtcaattagaagttccagtcattgtcaaagaggtcggttttggaatttcacaaaaaacctttaaagcactcgcaaaaacagctgtctcaggaataaatattgggggagctggcggaactaattttgcttggattgaacgtaaacggagtaaaaatggttttaacttggatgaatttggtttgtcaacgcttgagagtcttttagaagctaaaatggctgataatagaaaaagtttgattgcaacaggtggaattacttcggctcaagagatttttaaatctttaattttaggggctgatttgtcaagttctgctggttttatcttgaaaaatcttatgcaaacagggcctgaaaaagtagaagaaattattgaacaatggaaacaagatttaaaaaaattatttgttttaactggttcaaaaaatattgaagaatgtcgaaaggttgagctcctttactcgactaatatgcttaattttatccaacaaagaaaataataaattataaatcaaatcatttggcaatggtttcaaaaacgactataatgagaatagaattaaaaaaataaactaactgaattcattctcaatctagtcaaaataccaaagtattaagacttcaaaatgggttcacatcttaaaaggagaaattactatggcatttacattacctgaacttccatacgcgccaaatgcgcttgaacctttctttgatgaagcaacaatgcgtttgcatcatgggaaacatcatcaaacttatgtgaataatcttaatgcagcaattgaaaagcataatgaacttgatgaccttagccttgaagaattattgacagatttgtcagcaattccagaagacattcgtacagctgttcgtaacaatggtggtggtcatttgaaccatagtcaattctggctttggcttcgtccaaacactgacggttctgaaaaccatgctgacggcgaaattggggatgcaattgcgaaagaatttggtagttttgaaactttcaaaacagaatttaaagctgcagccacaggtcgttttggttcaggatgggcttggttagttgttgatgaagctggaaaattgaaagttgtatcaactgcaaatcaagataatccaatttctgaaggtttgacaccagttttaggacttgatgtttgggaacatgcttactatcttaaatatcacaatgtacgtcctgattacattgaagcattctttaatcttgtaaactgggataaagttaacgaactttatgctaaagcaaaataaaatgatgaatgaggctctcctttaaaggagagcctttttttattttagagaaatctttttcaatgttagactattcttttggaaattcatcttatttttacaaaaagatgttttaaggagatttttttaaacataaatgtttatatttttgattaaatagtgctaaaatattattgtaatcggttacattttgttttaaaaaatatggaaggttaaatgcattaataagtgcataggaatagaggattatgaaagatattggaaactcttcaaactttaccgaagaagaagagctatttttgttgcggaataaacaaggaaaaattgtcggaattaaagatttaaagcaggcaaattttcaagaaacaatgaaagactggaaaaaacatttaccaaaacccagtcttctatcaattatcatttgggtggcggtcgctttactaggcggtcttgcttggtcgttgattgctctggctcaaggagagacgattaatgcgatttggtttgttattgcagcagtatgttcttatttgattggctatcgtttttatgctttatatattcaacgtaagattatgcgtccaaatgatttacgggcaaccccttctgaaagccataatgacggaaaagaattcgacccaaccaatcgagttgttttattcggtcaccattttgcttcaattgctggagctgggcctttggttggaccagttttagcggcacaaatgggttacttaccagggacaatttggattattttcggagttatttttgccggaggggtacaagatatgcttgttctctggtattctcatcgtcgtcgagcaaaatctattggggcaatggctcatgatgaagttggcagatttgctggtggcttgacttcatttattgtatttatcatgacaatgattgttcttgctgttttagctttgatttgtgtgacggcgatggcaaattctgcttgggcagtcttttcgattgggatgaccattccaattgccttattaatgggaatttatttgaaatatattcgcccagggcatgtgaatgaaatttcagcaattggttttattctccttttagttgctatttttggtggccgttgggtttcagaatcttcatttgcgcatattttcatgctttcgccaaccgctttagtttggtgggtcatgggctatacttttattgcagcaattatccccgcttggattttacttacgcctcgtgattacttatctatgtttatgaaaattggtacaattgctgttttagcaatagctgtagttggtgtgcgtccagatgttacgattccagctctgactaattttgcacataatacagatggtcctgcttttgctggttccctctttcccttcttatttgttacgattgcctgtggagccttgtctggtttccatgtaatgatgtcttctggaacaacgcctcatttgattgctaaagagtcacaaacgcgaatgattggttatggtgggatgctctttgaatcatttgttgctattatggctttagtcgctgcgatttctcttaatcctggaatttattattctatgaatacccctcaagctagtattcaaaaactcgcagcttcaagttatcaagcagataaaagtgccgaatataatgctgccaaagcaattccaaatgtagccatgatgcctgatggttcaaaactcagtattgactgggaaggaacgactggtgaaaaagcacttgagcaagtggcaaaagatgtaggtgaacaatcaatcgtttcacggactggtggtgcaccaactttagccgtttcaatgtcaaatattctacataaggttccacttattggtgggacaaatatgatgggattctggtatcattttgcgattatgtttgaggcgctctttatcctgtcagctgtttcagcggcaacaaaatcgactcgttatttacttaatgatgccttgcgtggcttcaaaaaattaggtcgcttaggtgatgatgattggttacctagtaaaattataacgacagcagtgattgttggagtttggggggctttgcttttgatgggcgtttctgatccgaatggtggaataaaaatcatgtatccgctctttgggatttctaatcaattaatcgcggcggtagctctggctattgtttgtgtcatggttatccgtaagggctatcttaaatgggtttggattccagcacttcctttagtttgggatgtttgtgtaacttttgcggccagttggcaaaaaatcttttcaaatgatgtcaatattggttactttgcttcttattcagcagcaaaagcccaagtggcttctggtaaattatctggtctagcattaacaaatgcgcaagcaaccatgcgtaatacaatgattcaaggaagtctgtcagtcattttcttactttgtgtggctatattattagtcatctgtgcctttaaagttgctaaaattttaagaacaaatgaagttggtgataaatttagctcagaagaagtttttgaagaatcaaatctttttgaaacttcaagtttctggcctagtaagcttgaacataaggttttaaaaagtaaagttaatgaataatggaaaataaaagttactgacagaatttctgtcagtaacttttttatttataatttattctcattttattcgaggttagctgtcagtaacttttagtaaaattttttaaaagtttcgtctaaattttcttttgctaaatcaagaatttgattttcaggtaaaatggcggtgccttcagcacgaacaatttcaaaatctgaaaatcccatgatttctgaaaaaatcattttgagatattgtggtgcaaaatctaggttttgataaaattcatggtcactataaattgacccactagcaaaaagtagcagtgctttgtaatcattagtcatcagtccagttgataatttacctttgtcatcaggggaatcaaggtatctaaaagtttcacgagcaatgagaatattgtcaatgtaatctttaagacgagatgtaatattaaaattatgcaatggagaaacaatgaccaagcgatgatgtgctttaaattgtgtcagtaattgctcagaaacttgcgctattttaagttcgtcggctgataatttttcgtcagcaatttttttattccaaatctttaaaagttgattttgctcgattcttggtaagctggtatcaaggtcataaagattaaaaatggtcaattcattctcagaaaattgacttttatacttggccaaaaataattcttgaagttgattagaaaagtgatttggattgttaaaatcggggtgggcattaattaataaagttttcaacgataattcctcatttcttttgataaaataagtataaagcataaaggtgccaaaataaggcacctttaaaaataaaaggaaaatgttgatgaaaaaagcagaacgattaaatcaagaacttatctttttaggaaataaacagggatttcagctcaaagatttgatgaaggaatttcaaatttccaaaagaacagctctgcgagatgttgaagaattagaagcaatgggtctgcctttttacactgaaaacgggagatatggtggctataagctgattaatcaaggtttatggacaccagtgtattttaatgatgaagaaattgaagccattttctttgccttagatgccttaaaattattatcaagtacaccttttgaaaaatcttatcgacatattcggcaaaaattgtcagcgactttacctgaaagtcaacaagaatatatcagcaaaatgctgacagtagtcaatttttatggaattgcacctgtcagtaaagtgactgatttaaaattactgatgacagcaattctgtcagagaaaattgtcaaaatgacttattcacaatataaaatacaagaaattgagcttcaaatttacgaaatattttatcgaaatggcttatggatttgcagcgcttatgatgttactcatgaaaaatggggaacttatcgttgtgattatatgtttaatgtcgaaatgattgatgatggacgtcaaacgaaaaaattatctgaattaaaaaaaatacaagaaatatatgaaaaagaatatcataatattccatttcgctgcaggctgacagaatttggtaaagagctatatctcaaacatcattatccgaatatgcaactagaagaagtggcaggacttccttatattatcggtggttatcatgctgacgagttagattatatgacccattatctctgttcttacgggaatcagatggtcattgaagaaccccaagaacttatagaaagttatgtaaaacaactgacagaaatgaaggcggtttatcaagaataagtctgtcacaggggcaaagacaggttccttaaatgttttttttctgatataatagaaaaaagtcccttccatggataaatcagcaaaaacagagattcgtcattttttaaatgaaacgaataatcctcaacaaatgaaagaaaaaaatgaaatttacagactttaattttaaagattatattaaccaaacgttagagaatatcaaatttgaaaaaccaactgaagtacaagaaaaattgattccaattgttctctcaggccgtgacttggtaggggaatcaaaaactggttcaggaaaaacacacacttttttactcccaattttccaaaaaattgatactgatcttgatgaagtgcaagcagtcattacggctccttcacgtgaattagctactcaaatttacaaagcagctcaagaatttacaaaagttaatgacaagcttcgtgtttcaaactttgtcggtgggactgataaggcccgtcaaatcaaaaaattggaatcatcacaaccacatgtcgtaattggaacaccaggtcgaatccatgacttaatcaaatctaatgctttaattgtgcatactgctaatacttttgttgtcgatgaagcggatatgacacttgacatgggatttttggcagatgttgaccaaattgcttcaagttttggtaaacgcgtgcaaatgctcgttttctcagcaactattcctcaaaaacttcaaccatttttgaaaaaatatttgcataatcctgtcatgcaaaaaatcgccaataagacagtaatttcagatacgattgaaaattggcttgtttctaccaaaggaagttctcataaccaacttttgctccaattgacaaaagcaacgaatccttacatggcaatgatttttgccaataccaaaggtcgtgttgatgacattcatcatttcttgacaagtaacggacttaaagttgcaaaaattcatggtgatgtaccaccacgtgaacgtaaacgtatcatgaattcaattaaaaatttggattatcaatatgttgtggcaaccgatattgctgcgcgtggaattgatattgaaggtgtatcacacattatcaatgatgaaattccaaaagatttaactttctttgttcaccgagtgggtcgttctggccgtaatggattacaaggaacagccattacactctatagtccttctgatgattcaagtattcgtgagattgaaaaaatgggtgttacattccaaccaaaagctattaaagatggtgaaattgttgattcttatgaccgtgatcgtcgtgaaaaacggacgaaaaaacaagatgaaatttcaacaaaaaccattggcgcccttaaaaaaggtaaaaaacacgttaaaccaggttacaaacgtgcaattaaatggcaaattgaagaagataacaagaagaaacgccgtgctgagcgcaataaaaatgcccgtaaaacacgtgattctcgtaaacaaagtttctaattaatgaaaaaggtttttaagattataggcgcttttgtcggtctaattcttttgatttcagtaatttgccttactttgattcttagtaaatctactgacagaactgctgaaaattccacagacattaaaacaattttagtccttggctcacgaataaatcaaaataaaaaaccagccaagattactcaagagcggctagatgcagcacttttgcttgctaagaataatccgcaagccaaaattattgtgtctggagcaaaaggagctgacgagcctgttagtgaagcttttagtatgaaaaattatctgataactcatcacattagtgctgacagaattattagtgaagataaggcgggtgataccgcggaaaatatcgcttattctaaaaaatattttgatggaaaaacggtgattgtcactagcgattttcatctttaccgagccttgtatctagcaaaacaagaaggtgtaaaagtagaaggctttgctgcaaagacaaaagccaataatcttctttattatcctaattattatggtcatgaaattcttggcttaatctatgctttcgtttttggaaaaggctaagaaaatttcaattataataaggataaaagctgtcagtaatttttactgacagctttgctaaaatttggcaaatcctttcaaacaatgattctgtcagtaaatttttaaaagaatttgtggcggagctaaatatttccaaatacggagagtaaaaaatgatgtttctacccgaacaaatcagtaaacttaacgagcttgaaacgctagtttttgattttatcattaaatcacctgaagaagtccaacaaatgacgattcgtgatttagcaagtcaagcccatgtttcaacttcgacaattgtccgactatgtacaaaacttggttttgaaggttggtctgatttaaaattttacctcaaaaatcaactcaaagaaaaaacaccagaagagcaacattatgataatatgctcgaattcaacatgtttttacgtcgaatgaatacagataattatcaggcaaaactcaataatgctgcacaaatgattgctaaagctgattataccgtgtttttaggcttaggaacatctggttccttaagtgagtatgctactaaatattttgtaaacactggattacgaagcttcgttatctctgacccgtttcaagctgttcaagttcagggaatgggaaatgttgtggcagtaatcatgtctgtgtcaggtgaaacagaacaagttgttaataaagaattggagtttaaagcgggcggagcaaaaattatttcgattacaaataatgaagattgcaccgttgctaaacttgctgattaccaactctcgtacaatcttgttaacgaatggtccaaacagtatcctttagggaatttgaccacgcaactcccagtactagctattttagaaattttagctcataaatcaattgattatcatcttaaaaaataataaatttgttccaaaaagagaaacaaatatttcaaaaagctactatttgatagtagcttttttattttatgacacaaaagtcggttaaagcttgctgtaaagcgaaaaataaactaattagtaaaaattataaagcactttcaaaaaatggataacgcttgcattatgaaaatgaaaacgttataattatttttataaagaacgttaaattataaaacgttaagaataaggagaaataattatggcagataaagttattgcacttgcatgtgcagccggtatgtcaacatcacttttggtatcaaaaatgcaaaaagcagcagcagataacgggaaagattacgaaattttcgcaaaatcaacagcggacattgataacatgcttgccggaacaggctcaccaaaacctgacgttcttcttttaggcccacaagttgccttcatgaaaggtgaaattgctaaaaaagctgaaatcgctggtgtgccaatggacgttatcaaaatgcaagattatggaatgatgcgcggagataaagttcttgcagcagctgaaaacttgatgaattaaggtttgaaaatttcaaacttgtgaaagagcgaaagctcttttactatgtaaaaatctaagcaaagagaaatgggaagataagaaatgactgataaatacgagaatccaacaagtgatgactacatgggtgttgtaatgggcattatcatgagtggaggaaatgccaaaggtttagccttccaagccattcaacaagccaaagctggtgaatttgccgaagctgaaagttcattaaacgaagcgagtgaacaacttcgtgaagcacatgacgttcagactgaccttttgacacgtttagctcaaggcgaaaaaattggttggaatctttacatggttcatgctcaagaccacttaatgaatgcgattacctttaaagaccttgctgtagaagttgtcggtcaagaacaacgcctgcaagcacttgaaaacaaataatatagctcctagcttattagaaaagcaagattaaaagttgcggagacgcaacttttttctaaccaaaaagtttaaagaagaaaggagagaatgatgagtttttttggaaatgttgactttcaaaaattaacctacacggaaagaacttgttatagttatttacgagataatgttgataaaattccttatatgcgagtccgtgatattgctctggaagcacatgttggaacttctagcgtcatgcgcctcattcataaaatgggttatgattcatatacagattttaaagagtacattattgataaaaaagaattggaaaaaggaagctcaaatacggcaattcccttttcactagatattttctctaacgatattgaacaacgtttggataatctggcacatcgagtcattgaaagtgacaatatcatttttacaggagtaggttccagcggtttaatttgtgattatgcggccagaagattagcgggagttggaattaataccttttcatttagtgatgtgacttatccaattgcttcaaaattacaaaatacaaccaacactttagtaattgctttatccatctctggggaaacgaatgaaatcattgaagtactgaccagcctgcgctctaataaagatgtctatatttcatgtatcacaccaaaattgaattcaagtattgctgaactgagcgattttgtccttacttatcgaattaatgaacaccgaatcaatacgcattatgatttgacgagtcaattaccaacagtttatttgaccgagcgtttaacagatttggtttatcaattatcaaattaaaaagccaaattggcttttttatctactcgaccgttcctaatcatttgatagataaaataaaaaaaattaaattgagataacaaatataatttgcaaggctaattttcgcaaccttaaaggaaacttatatgacaattttggcacattagtcttcacgagtggtacagaaccaaagttttggaaaaacaagaaaccgctttctttcttttgctctttagtgttataatgaaaatgtaaaaaagatgaacgtgaaaccagttcatcaaaaaaagtaaaggagactgttcaaccatgaacaattttattcaaaacaaaatcatgcctccaatgatgaaatttttgaatacccgtgcagtcacggcaatcaaaaatggtatgatttatcctattccatttatcattattggttcagtattcttgattcttggtcaattgccattccaagcaggccaagacttcatgaacaaaatcaaattgggcccactctttttacaaattaataatgcttcatttggtattatggccttgcttgccgtattcggtattgcttacgcgtgggttcgcgatgcaggttatgaaggagttcctgctggtttaactggtattatcgttcacatcttgttgcaaccagacacaattcatcaagtaacatctgttactgacccaactaaagtttcaactgcttatcaagtaggaggagtaattgaccgagcttggttaggtgggaaagggatggttctttcaatcatcgtcggactcttagtcggttggatttacactggctttatgcgtcgtaacatcacaattaaaatgccagaacaagttccagaaaacgttgcggcatcattcacttcacttgttcctgcaggagcaatcattgccttagctggtgttgttcacggaattacaacaatcggattcaacacaactttcattgaattagtttataaatggattcaaactccattacaacacgtaactgatggtcctgtcggcgtcttcgttattgcctttatgccagtatttatctggtggttcggtgttcacggagcgacaatcatcggtgggattatgggaccattgcttcaagccaactctgctgacaatgctgccctctataaagcaggacatctcagtctttcaaacggagcccacatcgttacacaatcattcatggaccaatacttgacagttactggttctggtttgaccattggtttggttatcttcctcttagtgagtgcaaaatcagttcaaggtaaaactttaggacgtatggaaattggacctgcagtgttcaatattaatgaaccaattctctttggtcttcctattgtcttaaatcctattcttgcaattccatttatcttagcaccattgatttcaggaatcttgacttacttagtgatttatctaggaatcattccaccatttaacggagcttatgttccatggacaacacctgcagtcctttcaggataccttgtaggtggctggcaaggtatggtttggcaagttattattcttgcattgacatcacttctctactggccatttgccaaagcttatgacaatattcttcttaaagaagaagctgaaacagaagctgaaattaatgctgctgaataatagcaaattttagatgagctcaagaattcttgagcttatcttattaaaaatgttaattctaaaaatttaaaaggagaaattatgactttaaaaaaagacttcctctggggaggagcagttgctgcacatcaacttgaaggaggatggaatgccggcggaaagggagtttctgttgctgatgtcatgacagcagggagcaatggagtagagagaaaaatcacagatggggtaattgagggagaaaattatccgaaccatgaagctattgatttttatcatcgctacaaagaagatattgcactctttgatgaattgggattaaattgttttagaacttccattgcatggactcgtatttttccaaatggagatgaagcagaacctaatgaagaaggattgcaattctatgatgatttatttgatgagtgtttaaaacatgggattgaacctgtaattactctatctcactttgaacttccttatcacttagtgacagaatatggaggctttcgtaatcgtaaactcattgatttctttgtccatttttcagaagtcgtaatgaatcgttataaagataaagttaaatattggatgactttcaatgaaatcaacaaccaagcaaactatttgcgtgattttgcaccatttactaactctggtttaaaattcccagaaggagcaagcgaaaaagaacgtgaagaaatgatgtatcaagcggctcattatgagttggttgcttctgccaaagttgtcgctctgggacataaaatcaatccagatttccaaattggatgtatgattgccatgtgtccgatttatcctgcaacttgtaaaccagaagatatgatggcttcaaccgttgctatgcaacgtcgctattggtttgcagatgttcatgttcgcggacattacccaagctatttaaaagcctattttgaccgtaaggaatttaaacttgatattcttgatgatgatttgaaagcattggaagaaggaaaagtagattatattggtttttcttactacatgagttttgcaattaaagaccatggtaaagctcctacttttgattacaatgaagataaagatttagtcaaaaatgaatatgttaaagcttctgaatggggctggcaaattgatcctttaggattacgttatgcaatgaattggttctatgaacgttatgaaaaaccactcttcattgtcgaaaatggttttggagctgtagatgaagttgaagctgatggaagtattcacgacccttatcgagtagattatttaaaagctcatatagaagcaatgaaagatgctgtagactatgatggagttgacttaatgggttatactccgtggggctttattgaccttgtttctgctgggacaggtgagatgaaaaaacgctatggcgtcatatatgtagataaggataacgaaggaaatgggacattagaacgttcgaaaaaagactcctttacttggtatcaaaaagttatcgcaacaaatggtgaagaactttaaaaataaaagacacgaaagtgtctttttatttttattggaatgtaaagaaaacacttcaaaagcgaaaaaagtagtataaagggtacagtaatgtattttattaattttttcacgagcttagtagccttatatagtaaaaatatcagattataagatgttttattgtaaaaaacgtttccaatatgaaaagaacaaggtataaatttccaactaacttttgacaaatttgttcattttgctaaaatatctttactgagtagttcatgtgtaacagaagggggggttatgcaagcaaaatatcggggacagcttgtagaagtctggaaaatttcgcatcgaccaattcgtgaaacatgggttaggcacgcttttgaacaagaacgcctttcttggaatgaatggaataaaaacgttttaaattttgagtcaatttcgggagatttggctttagttggcgattttttgattcaaaaagacggaagaagatttcatgttgtcagtagagaaaatgttcagcgggatttggtctttatcgatactgaagcgaattataaaattggtaattaaaacagaaaagttgcatagctcaagtcattttttattgatttggagttagcaaatgattgttaaagcctgtcggtcgtgactcaaatgatttaactggaagtagagtgagctcatgcttgccataaatttatttttccgctataatagttaatgttgtggcggcgtagtgaagtggtaacacatggctctgcaaaagcttaatcgtcggttcaaatccgaccgtcgccttaataaaaaaagatacttgcttggaaaagcaagttttttgttttaaattacatcatttttttaatagaaatttgcctttttgatgtgcttcggtaatcatactgactggtcttttgtgttaaaataggagctatgaatatcgagtcaaaaattaaagagcttacggaaaaattaaatcagtatgcttatgaatattatactttagatgagccttcggtagaagacagtgagtacgatcgactctatcaagaattggtaaaattggaggctgaaaatccacaactaactagagcggattctccaacgcaccgaacaggtggggttattttagacggatttgttaaatttagacacccttataatctctatagtttaggggatgttttttcgcgtgaagaattagcagtttgggaagaacgagttcgcaaggaaattgttaatccagagtatatttgtgaattaaaaattgatggtctttcattgtctctttattatgagaatggtttgcttgtgactgcagcgactcggggcgatggaacaacgggtgaaaatatcacagaaaatgtgaaacggatcaaagatgttcctttaaagcttaaagaagcaattgatattgtggtacgtggtgaagcttatcttccacgtaagaattttgctaaactgaacaaagagcgtgaacttgaaggagcagctccttttgctaatccaagaaatgcggcagctgggactttacgtcaacttgatacaaaaatagttgccaaacgtggacttgcaactttcctttatcaagaagcaagtccagcaaccaatgacactcaagaagaagtcttagaatattttgaagaacttggtttccaagttaatcctgaacgtaaatttgctcgaaatatggatgaaatttgggaatttattgaagaggctacccgtctgcgtgacgaattgccctatgacattgacggggttgttgtaaaagttaataatcttgctgagcaggaggaattaggttttacggttaaggcaccgcgctgggcgattgcttacaaatttccagctgaacaagcagaaacagaaattttgtctgttgactggactgtcggtcggacaggagttgtcaccccaacagcaaatatgactccggttcttttagcacagacaacggttgctcgagcaactttgcacaatgtggactatattgaagaaaaggatatccgtattggcgatcatgtcttgatttataaggcgggggatattattccgaaggttgggaaagttcttttggacaaacggccagaaggtcttgaagtcttagaaattccaacgaaatgtccagagtgtggttcggagttaattcattttgaagatgaagtggctttacgctgtgttaaccccttatgtccggcgcaaattcgggaaaaactaattcattttgctagtcgtgatgctatgaatattgtgggcttaggcccatcagtcatttcacaactttttgataaaaaattggtggctgatgttgctgatttatatcaattgacgattgaagatttactgacattagataaggtcaaagaaacattggctcaaaaaattgtgtcagcaattgcgcagagtcgtgaaaattcggcggaaaaattattatttggtttaggaattcgtcatgttggtggtaaagcggctaaattacttttggaacgttttgctaatcttcgagcgctttctaaagcaacagaagaagaaatttctgaaattccatctttaggtggggtcattgctacggctgtcgtttcttattttgaaactgacggatcaaaaattttactggatgaacttgaaaatgctggtttaaattttgattatttaggtgctgttaatgttgaaggaatattatcaggtaagacagttgtcttaactggtaaattgacgactttgaagcgctcagaagcaaaagaaaaattggaagcgttgggagcaaatgtttctggttctgtttctaggaaaacggatttggtagtcgccggagaagaagcaggtagcaaactgacaaaagctcaagacttaggaattgaaatctggtcagagcaagatttgcttgatttataaactaatttgtattgaatattgctgacagactttagtgagagcgtaaatttactgacagaaatttgaaccttggttcaattggtggggtcactcttttgggagtttgtcagtaaattattttttaagaatggatgagagaaggtttcggagaaaatgatgaaggcgagattgatttacaatccgacatcgggtcaagaaattataaaaaaacatattgcagatattttggataaattagagcaatatggttatgaggccagtgcttatcaaaccacagcagaacaagattctgcaaaaaaagaggcggcaagagcaacagaagctggctttgatttaatcattgcggcgggtggtgatggtactattaatgaagttgtagctggaatttctccttttgagaaacgtcctcaattagctattgttccaacgggaacgacaaacgacttcgctagggctttaaaaattccaagaggaaaaccacttgaagcgattgaaattattggtaaaaatcagattctaaatattgatgtcggtcatgctgtaatcagagaaacacaagatgaacagtattttattaatatcgctgctgggggcggtttgacagaactcacttacagtgttcccagtcatttaaaaacggcttttggttatttggcctatttagcaaagggggcagaacttttacctcgtgtgcgtaaagcaccggttcgtgttgttcatgatgaaggcgtatttgagggtgatatttcaatgttctttgccgctcttactaattcagttggtggctttgaaaagattgcacctgatgctaaattagatgatggacttttcacactgattttggtgaaaacagataatctatttgaactcattgctttacttgcgattgtagctaatggaaaacatttggatgatgttaatttggagtacattaaaacaagtaaaatagaaattgaagccttaggcggtcaaaaaattcttcttaatttagatggagaatacggtggagatgctccagttcaatttgataatctcaaaggtcatttggatatgtatgtaaaccttgatgaaatcaacgatgaccattaccttggagacgaagaaaccttggcattagaagcagttgcgcaaaaatttgccgaagaagccaataaaattaaagacgaagatgaagaagattaaaaagttactgacagatctgtcagtaactttttctgtcagtaaaatacgacggctcggagcattttagttgaggctaagagaattgtcaactatattaataattctgtcagtaaaatgtgcaacttgtacaattaatttaggcaaatcactgattgaaaacagaaaacgtttacagtagaatgatattaaagaacaaatgttattagaggagaaaaaatgacaacactcagtttagacaaaatctacaaaaaatatcccaatgcgacgcaatacgctgtcgaagatttcaacattgatatcaaagataaagaattcattgtattcgttggtccttcaggttgtggtaaatcaacaacattgcgaatggtcgctggtcttgaagatattaccgaaggtgaatttaaaattgacggtaagatcatgaatgatgtcgcaccaaaagatcgtgatattgccatggttttccaaaactatgcgctttatccacatatgaccgtttttgataacatggcctttggtttgaaacttcgtaagttcaaaaaagatgaaattaaacgtcgtgttgaagaagctggaacaattcttggtctttctgatttgcttgatcgtaaacctgctgacttatcaggtggtcaacgtcaacgggttgcaatgggacgtgcgattgtccgtgatgccaaggttttcctcatggatgaacctttgtcaaacttggatgctaaacttcgtgtttcaatgcgtacagaaattgcaaaaattcaccgtcgaattggagcgacaacaatctatgtaacccatgaccaaactgaagcgatgactcttgctgaccgtattgttattatgtcatcatcaccaaactctgataaaacagggacagttggtcgtgttgaacaaatcggaacaccacaagagctttataatgaacctgctaataaatttgttgccggttttatcggtagtcctgcgatgaacttctttaatgtcaaagttgcttctggaaaattaacaaataatgaaggtttgaatatggaccttccagaaggaaaagcaaaattgcttaaagaacaagggtatgaaggaaaagaagtgattcttggaattcgtccagaagacattcaagcaagcaatttggcacaacaagcctatccaaatcaaacaattgaagctgaagttgtcgtttctgaacttcttggagcagaaactatgctttatcttagagctggttcaactgaatttgtttctcgtgttgaagcgcgtgatttccgcaatccaggagaaaaaattacagtggctttgaacctaaacaaatcacatttctttgatgctcaaactgaacatcgcatcattgattaaaatttacgccctcttatctctaaagattctgtcattaattgatagaatcttttttagtttgtaagtgaaaaaattactgataggtcttgtaaataaaggcttttcaacgataatgtcaaagataattgacactaagcagcttcaacttttcaggcttaaaatgctaaaattaacttagtcaaaataatattattaggaaagctctcgtctttttcgatttggtactaaatcacataaagaacaccgacaccgctctttatgccgtaaaaatgtcgaataaatgctctcctgagaaggtttgaaaaaaatgaaaaaaacaatggacggaaacatggcggcagcacatattgcttacgccttttcagaaattgccgtaatttatccaattaccccaagttcaccaatggcagattatactgacgcttggtcagttgctggtcgtaaaaatatctggggctcaacagtaaaaattacagaactacaatcagaagccggtgcagcaggtgccatgcacggtgttcttaaagcaggagggcttgcgacaacttataccgcttcgcaagggctccttttaatgcttccaaatatgtataaaatggctggcgaacttttgccagcagttattcatgtcgcagctcgtgccgtagcggctggggcgcttaatatatttggagaccagtctgatgtgatgtcagccagaacaactgggtttgccatgttagcagagtcatctgttcaagaagtgatggacctgtcagcagttgcccacttagcaacacttgaaggttcagttcctttcttgaatttctttgacggttttagaacttctcatgaaattcaaaaaattgatgttattgattatcaagatttattaccaatggttaatcaagaaaaattagctgattttcgtgaccgtgcaatgaaccctgatcatcctacagtttcagggacaaatcaaaatgcagatatctatttccaacaaagggaaacagtcaattcttactatgaagctcttcctgaaatcgttcaaaagtacatgggaaaaatcaatcaacttcgtgggacagattatgatttagtcaattattatggcgcacctgatgcgacagaagtcattgtttctatgggttctgttgctgggacaattgagcaaacagttgattatttaaatggacaaggccgaaaagttggttttatcaatgttcacttatatcgtccatttccattggaaaactttcttgaaaaattaccaaagacagtcaaatcagtagcggtcttagaccgtacaaaagaatctggttcaaatggagaacctcttttccttgacgttcaatcagcgcttttcaattctaatgttaaacaagtgattggtggccgctatggaattggtggaaaagatactcgtccagaacacatcgtcagtgtttttgatgaattagtcaaagcacaaccaaaacgtatgtttacaatcggaattaatgacgatgttacaaacttgtctctgacaaattcaagagtccttgatttaacaccagcagatacatttcaagcaaaattctggggctttggttcagatggaacagttggcgccaataaagcagcaatcaaaattattggtgaccatactgataaatatgttcaagccgcttttgaatatgattcaaaaaaatcaggtggattaaccatttcacatttacgttttggtgattcgccaattacttctgaatatatgacagttacacttgattttgttgcttgtcacaacatgacttatgtacgtaaatataacttgaccaaaggcttgaaagctggaggcctatttctattaaacacaagttggaatctagaacaactttcaaaaaatcttccgaatgaaatgaagaaattcattgccgaaaatcaaattcgattttatacgattgatgccatgaaaattgctcatgaaaccggaatggaacgcagaattaatacgattatgcaggtcgcctttttcaaattggctcatgttatgccttttgatgaagcctatgagattctgaaaaaagatgctcaaaaatatgcaaagaaatcaccaaccattgttgaacaaaatttgaatgcaatggcacttgctttgaacggcttgcatgaagtaaagattccagaaagctgggctgaaactcaagaggaaaaaacgaaagttcttacgacagaaagttctcgtaaaaaatatgtttttgaaattgtaaataaaaccaatgcctttgaaggtgatgaactttcggtacaaaccttagtcgataacaaaatgacttttggagatgaaccattgggaacaagtgcttctgaaaaaaggggaattgccttagaaattcctgaatggaatgcccaagcttgtattcaatgtaatgaatgttcatttgtttgtcctcatgctgccatcagaccatttttagtcgacgaagacgaatggaatcaagcgccagaaggtttccatgttatggattataaaggagctgatggcttaaaatatcggattcaggtctctgttgaagactgtacaggttgtggattatgtgttgaagcctgtcctaaaaagggtgaagctttaaaaatgattccttatgagggacaagaaaaagaatctgtcaattgggcttttgcgcaaacccttaaaacaaaagaaaatccagctcgtccaggtacaattgccgctagtcaatttgaaaaaccactttttgaattttcaggagcatgctcaggctgtggtgaaacaccatatattaaattattgacacaaatgtttggtgaccgaatgatgatttccaatgcaactggctgttcagccatttatggtggaacacaagcaacaccatatacaacaaatgagtttgaacaaggccctgcatggtcaaactcactctttgaggataatgcggaatacggatatggaatgtggttagcttctcaaaccagacgtcaaaaattagcagcccaagtccttgaagccttgccagaaatgtcagatgatttgcaaaaattggcgaaagactgggtagaacacttagaagattcagaaggaacacgagcaagagccgaaaaaatgaagggaatgcttgcttctgaacacttcaactcagctaagttggatgaaatatataaacaaaaagatcaatttgtaaaaccaacccaatggatatttggtggagatggttgggcctatgatattggttttggcggtttagaccatattgtagcttcaggtgctgatgttaatatcttgattatggacaacgaagtctatgccaatactgggggacaagtttctaaagcaactccagcttcagcaattgcacaatttgctgctggcggtaaatctaatacgaaaaaagatttaggagcgatgctaatgacctacggagatgtttatgtggctcagattgcttctggagcaaacatgatgcaaacaatccgtgcctttgatgaagctgaaaaatttaaaggtccatcagtcattattgcttatactccatgtatttcacatggtttatatggaggaatacatttagcacttgatgaagcaaaagaagccgtgaattctggttactggcaactttatcgctataatcctcttcttgaagatttgggtaaaaatccgatgattcttgatttcaaaaaacctgattttagtaaagttagagatttcttattgacacaatctcgttttggtaacctattaaaagtggatgctgagcatgcagaaagtttgtatgctaaagctgccaaagattctcgtaaacgatttatgcgttatgctagaacatcaggagatttagataagtatttagaacgtgaagtaaaagtactggcgaaaaagaatcctgaatcagagggggctattgtagctactttgccaaaagaacgtaagaaacgtccagttgatcctgagcgtgaagcaagacgagctgctcgtaaagcagaacgtgaggctaaaaaataatatattcattactaatgaaaagttactgacagaatttttgtcagtaactttttttattctcgtcagctaaaaattacagttttgctaatgtaaaaattacagatagattaagggaataagaacaagatgataaatttttatttaggaataaagcagttcacttaaaattttggtataattagactaacaatataaaaggagggggacttttgaccgacttcaatcaattttttaaccttgagttttggcaaaagatttttgaattgaatgaatcacctctgcgaattgctattgcaatattagacattgcaattatcagttttttcctttatcaagcgattaggtttgtacaaggaacaaaattaatgacgcttgttcgtggtgtgattattttcatttttatcagaattattgccggacttattggacttacaacagttgagtggttactcaaccaagttattacctatggggttatcgccggagttatcatttttcagcctgaaattaggcgagcgcttgaaagcttaggaagaacaaccacattatttacaccaacgagaaaaagtagccctgatgggcatatttcagcttacgagaaatcttttgcttacatgtctgagcgaaaaattggcgctttgattgcgattgagcaagggcaaaatttaaatgaatttgtaagtacagggatttgtttagatgcggatattactagtgaattacttattaatattttcattccaaatacacctttgcacgatggcgcggtcattgttcagggcaacaaaatcgctgtaacttctgcctatcttcctttgaccgaaaaatcggggatttcaaaacaatttgggactagacatcgtgccgcaattggactttctgaagtctcagatgctttaattttagtggtttccgaagaaactggtggaatttcaattgctcacaatggagaatttttcgcggatatttccaaagaaaaattccatgatattctagtggccattttagttcctaaagttgaaaaaaatgaaaaaggaacaggaaagaatagaaaaaataaagcaggaggaaagaaaaatggcaaataaattttttaattccaaaacattttatatccttgcctctgttttctttgcgattgtccttttctttaatgctaatgcaacatccatccgtaatcagggaactaatcagtctggagaagtttacacagccacaattaataacgttccagtagaattaaaatataattctaataaatatttcgttagtggttataacagcactgcgacggttcatctttctggatataatcgcttgtctatcactaatgaagaaaattcggacacaagaaatttctttttaagtgttgatttgaccaaattaaaaacaggaaaatttgatgtaccaattcggattgaacaactgcctggcggagtaacggcaacgattgaacctaaaacaatgaatatcactttagaagacaaagtgaagaaagagtttgaagtaacaccaaaagctgattcaactcaattgccagaaggttttacaattgattcactttcagtgagtgatgaaaaggtaaaagtgactgccggggaagagagcatcaaaaaaattcaagcaattgaagctgctttaccaaatgatgttaatttaaatgaaaattattcaggcacagtcactcttcatgccgtagacagcacaggtaaaattcttccagcacaaattgaaccttcaacgactcatttaaaagttgtagtaaataaattaactaaagatgtgccggttaaagtgacacaaaaaggaacgcttgataagactttatcatctattaagacaaaagtatctgataaaacagttactctttcaggagaaaaaagtgctttagaagcaatcaacgaggttgaagcatcagtggatatctctggagttgtaaaagaaacaaaagtaactgttcctatacgtgcaacaggagtaagtgctgatccacaagaagttgaagtaacattaacacctgtaaaaataagtggataaattttcagagtcaaataaaaataataaaaatggagacaagaaaaaatgggtaaatatttcggaacagacggtgttcgcggagaagcaaatgttgaattaacgccggagatggcttttaaacttggacgttttggtggctatgtccttagtcaacatgaattaggtacaccaaaagtttatgttggtcgcgatacacgaatttctggacaaatgcttgcgagcagtttgatttcaggacttttgtctgttgggattgaagtttatgatttaggagtcattgcaacaccaggtgtagcatatttagttaaaaaagatggtgcctctgctggggtcatgatttcagccagccataatccagcacttgataatggaattaaattctttggtggtgatggttataaattagaggatgaaaaagaacttgaaattgaagcattgattgacgctgaagaagacacattgccacgtccatctgctcaaggcttaggaatgctgcatgactatatcgaaggtgttcgtaaatatcaagctttcttaaaaacaacagcagaaggtaattttgaaggctataaggttgttcttgatacagctaatggtgcagcttatacttctgctcgtgccgtttttgctgatttagaagcgaatttgacagttattggtgaaaatcctgatggactcaatatcaatgtgaaagtaggctcaactcatcctgaagcgatggctaaaaaagttgtcgaaacaggaagtgatctcggacttgcctttgacggtgatgctgaccgcctgattgccgttgatgaaaatggagaaattgttgatggcgataaaattatgtttatcgttgggaaatatcttcttggacaaggaaaattggctcaagatacgctagtaacaactgtgatgtctaatcttggattccatttagcgcttgaagaagcaggaattaattcagtgattacagcggttggtgaccgttatgttgttgaagaaatgaagaaaaataattacaacttcggtggtgaacaatcgggtcatatgattttccttgattacaacacaacaggagatggtcaactttcagccattcaattgttgaaagtaatgcgtgaaactggcaaatctttatctgaattagcaagtgaagttacgatttatccacaaaaattagttaatgttcgggtaaaagataatgcagctaaaaaatcagcaatggatgtgccagcgattcaaaaagtaatttcagaaatggaaacttcaatgaatgggaaaggtcgtattttagttcgtccttcaggaactgaaccactcttgcgtgtcatggctgaagcgccaactcatgaagaagtcgatcatgttgtagataccattgttgaagttgttgaagcagaaattggtgtaaaataaagaaaaaaggcaagaactgattttgtttttgctttttattatcaagtaaaaactctccttattgggagagttttttatcttttttgtcgtctagcgaattctgtgaaacgaaagcggtcgacttgatggcgagattcagtatactgaaaaagagtattatcagcaagataaacatgggatttgacagacacgacatgatggtctttgggatttaagtcaagatatttaaagtcatcttcgcaggcaaaatcaatcgtgacttccttttgagcataggcaatgtcaagccctagaatatcttctaagtagtcataggttgaaattttagcatgttctggagttaaaccttcggaatatttttctaaaaataaatcccaatctaaaattgaaaatttgccatctactttgcgccttctgagaatacttatggcgtgttccccaacggcaaaaccagttgtttctgacagtttagggttaatttcaagtctttcaaaacgaatgacctcagtttcactatggaaacccatagaggtttgtagttctttgtatgaagttaagccagagatagggaaaaggagcctatcatgagcgaggacaatgctaccatagccatgtcgtctttgaataagccctttctcttctaaaatttttaaagcctgtctgactgttgaacgactgctctcgtaattaacagagagctcattctcactcggaagaatatcgttcgttttatagatatcgttaaaaatctttttttctaaatcttgcaaaatcacttcatatttcttcatactttatattttatcacaaaaataattgttaccgcttgctgaaaacgtttttatatgatacaatgattttgttaacttgtacgtacaacttcaaaagataggagattcttatgtttggaataggaaaaaagaaagaattaaaagacgataaagggctatataatccagtttctggagaagttattgaactttcaaaagtaaacgatccggtattttcaaagaaaataatgggggatggttttgcagttgagcccaaagaaaataaaatttttgctccagtttctgcaaaagtaactttggttcagggacatgcaattggctttaaacgtgctgatggcttagatattcttttacatctaggtattgatacagtggctcttaaaggggcaccatttaaaattaaagttaaagtggatgatattgttaatggtggtgatgagctgggaactgttgattgggggcaaattgaagctgctggtttggataagacaacaatggttatttttacaaatactaaagatgtcctatctggctttgaagttaaatatggttcagccaatgcacgtgatgaattaggtcaggcaagtgttaagtaagtaaaaatatcaaccaataaatttatagcgcaaagatgacgggaactttggatatagattttgtgactattaaactcgtcaattattattttatattatgaaatgcttcatagataatgaagctaaaggagaacttatggcaaattattcacaacttgcgactgatattatcgcaaatgtaggtggcgctgaaaatgtcacaaaagttattcattgtattactcgtcttcgtttcactttaaaggacaaggataaagccgatacagcggcaattgaagccttacctggtgtggcaggcgccgtttataattcaaacttgaatcaatatcaagtggttattggacaagcggttgaggatgtttatgatgaagttgttgaacaacttggtgattcggtagttgatgatgacgcaacggcacaagcagtcgctgcaacagcaccagctaatggtaaaaaacaaaatccgattgttcatgctttccaagtggtcattggaacaattactgggtcaatgattcctattattggtttacttgcagcaggtgggatgattaatggtttacttagtatctttgttaagggaaatcgcttaatcgaagtgattgatcctgcaagttcaacttatgtcattatttcaacactggcaatgacgcccttttacttcttacctgttttggttggcttttcagcggcaaaacaattggcacctaaagatactgttttacaatttattggtgctgcagtcggcggatttatgattaatccagggattactaacttggtaaatgcgcatgttggaacgaatgcggcaggtaaaaatgttgttgttgaagcagctgctcctgttgcaaatttccttggagtaacttttaatacaagttattttggaattccagttgctttgccaagctatgcttatacaattttcccaatcattgtagccgtggcaattgctaaaccactgaatgcttggttgaaaaaagttttaccacttgccttgcgtccaattttccaaccaatgattactttctttattaccgcatcaattgttttacttttggtaggtccagttatttctacaatttcttctggattgtcatttgtgattgatcatatcttgtcattgaatttaggaattgcaagtattatcgttggtggtttgtatcaatgtttggttatctttggattgcactggttggttgttccacttatttcacaagaattggcggctactggagcaagttcactcaatatgattgtttctttcacaatgctcgctcaaggggttggtgccttgactgtcttctttaaatctaaaaaagcagaccttaaaggactttctgctccagcagcaatttcagccttttgtggggtaactgaaccggcaatgtatgggattaatttgaaatatgtgcgtgtctttatcatgtcttcaattggtgccgcgattggtgcaggtgttgctggatttggcggattacaaatgtttgggttctcaggttctttgattggtttccctaacttcatttctaatcctttgacacatcacgctcctgcgggtaacttgatgctcttctggatcgccactgcggtatgtgcggttgcaactttcctattggtttggttctttggttataaagatacagatgtaatgggagaaggcgttgaacaaaaaaatgcatttaaagatgcagttaaataattaataaactcagttggaggcagtgctgataaattctgcttcctttagttttatatgagggggaaaaatgactgaaaaagattggataatccaatatgataaaaaagaagtaggaaaacgttcttatggtcaagaatctttaatgtcattgggaaatggttatttagggcttcgaggtgcgcctttatggtccacttgttctgacaatcattatcctggcttgtacgtagctggtgtcttcaaccggacgagtacagaagtcgtaggacatgatgtcattaatgaagatatggtaaattggccaaatcctcaattaataaaagtatatattgatggtgaattggttgattttgaagcggcagttgaaaagcaagctacaattgattttaaaaatgctttgcaaattgaacgttatcaggtgaaattggccaaaggaaatttgactttagtaacaacaaagtttgtagatccgattaattttcatgattttggttttgttggtgaaattattgctgacttctcttgtaaattaagaattgaaacttttactgatggctcagttttaaatcaaaatgttgaacgttatcgggcttttgatagtaaagaatttgaagtaacaaaaatttccaaaggacttttggttgctaaaacaagaacaagtgaaattgaacttgcaattgcttctaaatcatttttgaatggattggctttccaaaaaatagattctgagaatgatgagattttagcagaagcaattgaaattgatttgcaaaaaaatcaagaagttcagtttgataaaacgattgtcattgcaagttcttatgaaagtaaaaatcctgttgagtttgtactgacagagctgtcagcaacttctgtcagtaaaattcaagaaaataatgcgaattattgggaaaaagtttggtcagatgccgatattgttatcgaatcagatcatgaagatttacaaagaatggtcaggatgaacattttccatattcgtcaagcggcacagcatggtgctaatcagtttttagatgcatcagtaggttcacgtggcttaactggtgaaggctatcggggccatatcttttgggatgaaatttttgttcttccttactatgcggctaatgagccagaaacggcgcgtgatttgctcttgtaccgaatcaatcgattgaccgcagcgcaggaaaatgcgaaggttgatggagaaaaaggagctatgtttccttggcagtccggcttaattggtgatgaacaatcgcaatttgttcatttgaatacagtaaataatgaatgggaaccagataatagccggcgtcaaagacatgttagtttagccattgtatataatttatggatttactcacaactgacagaagatgaaagtattttgactgacggtggtttagatttaatcattgaaacgacaaagttttggttaaataaagccgaattaggaaatgacggccgttatcatattgatggggtcatgggacctgatgaatatcatgaggcctatcctgggcaagaagggggaatctgtgataatgcctatactaatttaatgctcacttggcaattaaattggctgacagaattatcagaaaaaggatttgaaattcctaaggaactacttgaaaaagctcaaaaagttcggaaaaaactgtatctagatattgatgaaaatggtgtgattgcgcaatatgctaaatattttgagcttaaggaagtggactttgcagcttatgaagcaaaatatggggatattcatcgcattgaccgtttgatgaaggccgaaggcatttcgcctgacgaatatcaagtggctaaacaggctgatacgctgatgttaatctacaatttgggtcaggagcatgtgactaagttggtcaaacaattggcttatgagttgcccgaaaattggttgaaagtcaaccgtgattattatcttgctaggactgttcacggttcaacgacttcacgtccggtttttgctgggattgatgtgaaattaggggattttgatgaagcgttggatttcttgattacagcaattggcagtgattattatgatattcaagggggaacaacggctgaaggggttcatattggggtcatgggcgaaacgcttgaggtgattcaaaatgaatttgctggtctgagtctgcgagatggccaatttgcaattgctcctcatttaccaaaaagctggacaaaattgaaatttaatcaaatttttagaggaactaaagttgaaattttgattgaaaatggacaattattactgacagcgtcggcggatttactgaccaaagtttatgatgatgaggttcaattaaaagccggagtgcagactaaatttgatttaaaataaatggttttactcttaataaagttttgatacaaggatttacaattattttttaataaaaaagttactgacagaatttctgtcagtaattttggaaagttattgcttaaaaatatatttttaaaatgacgagaaagaaggtaaaaagatgtttaaagcagtattgtttgatttagatggtgtaattacagataccgcagagtatcattttagagcttggaaagctttggctgaagaaattggcattaatggtgttgaccgccaatttaatgagcaattaaaaggggtctcacgagaagactcgcttcagaaaattctagatttagctgacaaaaaagtatcagctgaggaatttaaagaacttgctaagagaaaaaatgataactatgtgaaaatgattcaggatgtgtcgccagccgatgtctatcctggaattttacaattactcaaagatttacgttcaaataaaataaaaattgctttagcatcggcttctaagaatggtccatttttattagagagaatgaatttaactggatattttgatgcaattgctgatccggctgaggttgctgcatcaaaaccagcaccagatatttttattgcagcagcacatgcagtgggtgttgcaccctctgaatcaattgggttagaggattctcaagctggaattcaagccatcaaagattcaggggctttaccaattggtgtagggcgcccagaagatttgggagatgatatcgtcattgtgcctgatacttcacattatactttagaatttttgaaagaagtttggcttcaaaagcaaaaatgattcgtaattaataaattacataaaacgaataaaaaaataccacttttgagtggtatttttaatttttgatttgtctttccaaccaatcagaagcccaagaaacccagcgatgtactgacggaagacaataggcatcagaaggagcggttgtccgattagccaaagagacaccatgaggtccagattcaaaaaagtgagcttcaaaaggaacttgatgttttgagagtcgatcacaatatttaaggctgttatagataggaacaccttcatcatcagccgtatgccagataaaggttggaggagttgaggaagtgactttttccgaaatattatattctgagatattttcaatttcaaaattaaaatgtgacaaatcactaggccaaccaaaagtgaaggaagtcactggatagcagagaataactccttttggtcgatggttttgttcagaattaccataccaagcggccagatgccctccggcagagcaaccaagtaagaaaacttgctcaggattgatttgccattctttatgattttgatgaatcagagaaaaaacagcttgaacttcttcaagattttgtgataaaaagttatagtttgttcctttgttcatcacggtgtaattaaggagaagcacttgataacctttggcgagaaaagctaaggcaagagggtcagattctctttgtgaaatatgttgataaccaccaccagggcagataataatagcaggaaaagtataattttcgttttgacgaggattttggagctgataaaaatcaacccatgcagtatcatttaaagaaaacgttgatttattcataagcttattgtaccaaaaaatatttgaaagaaatatcaaagtacctcattgtttatttattacattaataaattttaagttcgtttaagaaaactatcatagaatttgattatgaagaaaattatttatagtataggtctgatatccttgcttaattttggaacgattgcttatggagaaacggcaaccgggacttcagcaagttcaggagatgcaacagctcaaagctcaacagggacttcaagtacctcaaattcagcaagttcagctagcagtagttcgcaaaatacaagttcctctgaaggaacgaattcgacaagtcaaaatcaaacacaaacaagtacaactgctcaaaatcagacagataatgttgggcaaaatcaaacgcctccggtagtagaaaatcgagatagttcaacagataaaaattctggcagtcaaaaagaaactaaaaattcaaccacaattattaatgaaaccgtcaacaataatgcaaaagggaacaatattcttttgatgacattgaccagtttgtcagcatcagtcacaatcattgggggaattattgcctttgtgcgtcatctgcgtggccgtggcaagaagaaaaatcctgtcaataaggcacaagtttctaaaaatgggaaaactccttcaaattcaatgacagctgagccatcagtaagttctaaaaaagcaccaaatgaagaaaaagtactgacagaaactcagcaaattaatatgcaggcggatgaattgctcaaaaatcataaaaaacaacaaaaagaatatcgtcgcagaagaagataaaaagccatttaaggttttttattttgcccgaatttttgaaaaactgtcagtaaaatttactgacagcttttattttaaagactgtgataatgaaggagataaactttttgaagtggcaatactggaattttctaaggtttgactatttttagattcatcagttgcaaacgttagatagtgtcttaggggatgtgttataataaaatcatgaaatttaacgaagaagaaatgttacaatttgcacaaaaattgggaagaaaattagaggctcaagatgttattgttttaactggcgagcttggggctggaaaaacaacttttaccaaaggcttggctttgggcttagatattcatcaaatggttaaaagtccaacttatacaattgtcagaagtctggaaggacgtttgccgctccatcatatggatgtttatcgcattggtgatgacccggatagttttgatttagatgattatttattcggagatggggtttcggtcattgaatggggcgaaatgttaggcgatgatttgccagaaaattatctggaagtcatttttgataagtattctaaagatttggtcaacgatcaagagcgtgaaattattttgaaaccacatggaaaaagatatgaggagctcgttaataacttatgactacagagctaattgttagagaagcaaatggcgccgacagttctagagtcattgaatttctcaataaggttggaacagaaagtaattttttgaccattgatgaagtaggaattttaatctctgaagcagaaatgacggactttttaaatcaacaagctgagaaagataataatgcttattttcttgcattcgttggtgatgaaattgctggtattttgcatttgacggcggattatcattatcgagtacgtcatattgcggaactttttatcgctgtgtcagaagattatcaaggctatggcattgggacgattctactagaagatgcacttgagtgggtagaagaagttggaacaatcaaacgtttggaattaactgtccaagcacgtaataaaaaagcacgtcatctttatgaaaagtttgattttgaattagaaaatgtcaaaaaatggggcgctcgagatgaaaatggtcaattaattgatgtttgcgaatatgttttattttttgactaatagttgacccttttgtcagtaaaattaaatataattaaagaaaaattaaaatctaatttttcttttttttgttgtgaaaaatcagaattttgatataatgctaatatgaagctttggataaaaacacttctcatgcttggaagtattattttagtaacggcaattgctgcaggcggatatacattaaccgttctgaacagtacaacaaaagcctttaaaatgacttacactaatgctgggaataaaaagacagaacaagtcattcaggcaactaaacctctaacaatcctacttatgggggttgacacaggaggcgaagggcgtggaacttccgattcatggaatgggaattctgactcacaaattctgatgacgcttaatcctaaaacgcacacgacaacaatggtttcaattgaacgtgatacgatgactaacattttagatgctgacggaaacattgtttctaagcaaaaaatgaatgcagcatatcccttaggttataactcagggtcatcttctgacggtttaaaaaatgccgtaagttatgccatgaaaactattagtgctcagactggtattaatattgacagttttgcaacagtcaattttgatgggctagtcaatatggttgataatgttggtgggattgatattaacaataccacaggccaaactctctatatttcagatacagagccgcaatatactgcgaaagttccacctgggaaacaacatattaatggtgaccaagccttagtttatacccgtgaccgacatcatttaccaaatggtgactatggtcgggcagcccaccaacgtgaagtcattgcagcactcatgaagaaaattttagccttagataatatcacacgctatgaacaatttttgaatgaagcctcaaaagattttagaactaatatcccaattaatgcctcaacaattacttcattactaggttataaagattgctttaacaaagtagtttctattcaatatgaaggcgttggtcaaatggtcgatggtgtttcttatcaatttatgccaacagatatttatctcgcgatgcaaaatatcatgaagaaatcgcttgatgaatcaacagtgaccactttgccaagcagtttgattacttatgaatcagtttttggttcaggaacagcacctttttattatcttccttcagctactgtaactgaaaaaggaaaatcaacggtgacttatggtgttgatacgcaaggaaatcttgtttctttgaattctaaaaattcagggaattatgtttcgacaagtggtggctcagttcaatcagattcaagttctagctcctctagctcagcaagtgattccacggcaacatcgagttctgattccacttatcaacaagataatacttacaatgatggctataataatagtaatgacagtacaacatctagctatggaacagatgatacaaacacagggaactatggctacggtacaagtcaataattgaaaaaaataagagaatatgataaacttgtttctgtcagtaattttagcttaaaaatttactgacagaaacaatttggtccgatagctcagctggatagagcattcgccttctaagcgaacggtcgagggttcgaatccccctcggatcatggtgccaaacctcgccccaccttcgtagtggggcatttttttatatttttttacgaaaagcaatttaaaagatacatattaaaaaaggataaaccattataaaaaaagaaaataaagtcctaataaaaattgtgctataatagaaaaatgacaagatacaaagccacaatagcctatgatggcacagattttgcaggttttcaaagccaaacaaatcaaagaaccgttcaagaagaaattgaaaaagtactgacgaagttaaattcttttgagccagttattttacaaggatcaggccgaacagattctggagttcatgcttttggtcaagtcattcattttgatttaaagggtaaagttcgtgatttggaacgtctgcgatttggtttagacactcaaaccccagcagatattgcagtaaaaaaagtggaacttgtcccagatgattggcatgcaagatatcaaaagcatgaaaaaacctatgagtattatctagaaaattcaattacacggagtccatttcaaagacattctaaagcctattttcgctatccacttaattttgagcggatgcaagaagcaatgtcaaagttggttggagaacatgattttacaggttttacagcatcgggttcatcagttgatgacaaagtaagaacgatttatcaggcagaaattatccgtcttgacgaagaaaatttcaaatttatttttcgtggcaatggctttttgtataaacaagtgcgaaacatggttggaacagtcattaaaattggtaatgaccgaatgcctgtcagccaaatagataaaatattgacctctaaaaatagagattttgcaggaccaacagcagcacctgaaggtttatatttgaaagaagtcaaatatgcggaaaatactgacatctaaaagctactgtcagtaaaattaatggagagaagatgccaaagaatttaaatgaaagcaaaaaaattctaacaattgcaggttcagatatcctatccggaggcggaatgcaagctgatttagcgacttttgcagccaatggactttatggcttttgcgccttaacaagcattgtaactgtcaaagaagataaattttttgttcatccagtagaaaaagaactctttcaagaagagttggaaagcttaagcgatgtggacttttcagccataaaaataggtctactaccaaataaagaaatacttgaactgaccaaaaactggctgacagctctgtcagtgaaatctgatactccaattatattagacccagtcattgtatttaaagaaaatgctgactattcggtcaatgaaatgcgtgaccttttcatcagccaactctttcctttggcgactgtaatcaccccgaatctcaaagaagcagaaatactgacagggctgtcagtaaaaagtaaatcagagatgaaagaagcagccaaacttttgcatgattttggagcaaaaaatgtcgtcatcaaaggaggaaatcgctttgaccaaaaacaagccattgaccttgcttatgatggaaaagctttttatgaattatcaagcccgattatagaaaataataacaacggagcaggttgtacctttgcttcatcaattgcggccaatatggcttataatcacccctttaaagattcagtcaagaatgcaaaagacttcgtttatcaagccattcaaaatgcaaatgaatatggtgtttttcaaaataaaaaataaatttccaaaagtaaaccaaacttctaggaaaagtaggagatgaaactcatggacaacagaaatatcaaaaaattaactttacttgcgatttggacagcagtcacttttgttctaggtcgcctatttaccttccctattccaggttcagccggtaatatattaacccttttggatgtcggaatttatacagcagtctttctgtttggtaaacgagaggcggcaataattgggggctttgcagcctttctacttgatttgactgcaggctacagtaactacatgtttttcagcttaattattcatggcgggcaaggctatctcgcaggattaacaagatacaaatggcttaactttttggtcagtcttgtctttatggttggaggatattttattgttggtggattaatatatggctggggttcagccattgcgggactttgggtaaatattattcaagttgtggttggctttgctttagcaaaagtcttaagcccgctcattgaaaggacaggtattttaaatggatttagaaaagcttaaaaaagacacacaagtcattatcgatgatgtcatcaaacaaacagaaattaaagctggtcaagtctttgttcttggtttatcttcatcagaagtaaatggtggtttaattggccatgccagttctagtgaaatcggtcaggtcattgtttctgtcatacacaagaccttgtcagacaaaggaatttatctggcggtccaagcatgtgaacatcttaatcgtgccttactcattgaagaggaattagccgaaaaaaaagactgggaaattgtttctgtgattccgcaactccacgctggtggaagtggtcaagttgccgcctaccaactctttaaatctccagttgaggtagaacatattgttgcccaagccggtttagatattggtgatactagtattggaatgcacgtaaaacacgtccaaattcccgttcgtccaattttaagagaacttggtggcgctcatgtaacagctcttaaatcacgtcctaaactcattggtggagaacgtgcgaggtacaaataaatgaaagagatgttaatcatgaccccaggtccgactgaggtggctgaaaatgttcgattagcaagagcaaaggcaacaacgaatccagatattgatttagacttttatgacttttacaaaaaaacttgtagtaaacttgcccaatttttaaaaactaaaaacgatgtcagagtcttagctggtgagggaattttaggattagaagcggcttgtgcttcgttaaccgaaaaaggtgaccgcgtacttgtgcttgataatggtatttttggtcatggctttagtgatttcattaagctttacggaggtgaagcaattctactggaaagtgcagaaaaggaagcattttccctaggaattctagaaaaatttttagaaaaagaccatgactttaaatatgcaacagttgttcattgtgatacaccctcaggcgtcttaaatgacctctcaaggatttgtccgctattaaaaaaatatggcattctaaccgttgttgattcggttgcggcgatgggtggtgaagagttgcaagtcgatgagtggcaaattgatatcgctcttggtggctctcaaaaagtgatttcagctccaccaggcttaacaattgcatcgatttcaacagaagcttatcaagcgatgacagagagaaaaagtcctatcgcaagtttttattgtaatctccttacttttaaagattattatgaaaaaaagtggtttccatataccatgccaatttctgatatctatggattagaccaagcgatagataatcttcttgccgaccaagaaattttgaaacgtcatgcgataattggtcatgcgacaagacaagcaattgaaaattctcctttggaactttatttgcagaatggctattcaaacaccgtttctgttattaaagtgccagaaggtctgaatgatcaagaaatcttaaggaaaatgcgagagaactatcgagtgatgatcacaggatcatttgatcatctggcaggtaaagttttaagaattgggcacatgggagagaatgcgagaccaaataaagtggcttacagtctatatgcgcttcaaaaagtattagaagattttggtattgcatttaaaaataatttacaagaagattttttagaagctcttaattgaaaaagaagtgaagcttatagattctaatacaaataaaaagaaaaaatctgatattacaatggttcatgaaaaattaaaaaacagacttttgacaaaaaaggaaaaatcagatataattattttcgggcactggttttttattataaaaaatcagtaacggtaggctcccctctggggagctgtttttgtttttcccagttatttctgttttgtaaaaagattagaggagatttagatgtcaactaagtatattttcgtcactggtggtggtacttcgtcaatgggtaaagggatcgtagcggcatcgctcggtcgtttgcttaaaaatcgtgggcttaaagtcactgtccaaaaatttgacccataccttaacatcgacccagggacaatgagcccttatcaacatggtgaagtctttgttactgatgatggtgctgaaactgaccttgaccttggtcactatgaacgtttcattgacatcaatttaaataaatattcaaatgttacttccggtaaagtttacagtgagattcttcgtaaagaacgtaagggagaatatctcggagcaactgtccaaatggtaccgcatgtgactaacatgttgaaagaaaaaattaaacgtgcagcaacaacaactgatgcagatatcattatcacagaagttggtggaacagttggcgatatggaaagcttgccatttattgaagctttacgccaaatgaaagccgaagttggtgctgacaacgtcatgtacattcacactgttccaattcttcacttgcgtgctgctggagaattgaaaactaaaatcgcccaaaatgcgactaagacacttcgtgaatatggtatccaagctaacatgctcgtattacgtagtgaagttccaatcacgacagaaatgcgtgataaaattgcgatgttctgtgacgtagcaccagaagcagtcattcaatcgcttgatgttgaacacttataccaaattccattgaaccttcaagcacaaaatatggaccaaatcgtttgtgaccatttaaaacttgatgcaccaaaagcagatatgacagaatggtcagcaatggttgaccatgtcatgaacctcaagaaaaaagtaaaaattgctttggttggtaaatacgtagaattaccagatgcttatatttcagtgactgaagcgcttaaacatgcaggttattcatctgatgccgaagttgatattaactgggttaatgctaatgatgtaactgatgaaaatgttgctgatcttgttggtgatgctgcagggattattgttcctggaggatttggtcatcgtggaacagaaggtaagattgcagccattaaatatgcgcgtgaaaatgacgttccaatgcttggaatctgtcttggaatgcaattgacagcagttgaattcgctcgtaatgttcttggacttgaaggtgctcattcatttgaattagaccctgaaacaaaatatccagtcattgacattatgcgtgaccaagttgatgttgaagacatgggtggaacactacgtcttggactttacccagctaaattgaaaaatggctcacgcgctaaagcagcctacaatgatgctgaagtggttcaacgtcgccaccgtcaccgttatgaattcaataacaaattccgcgaagactttgaaaaagctggtttcgtattctcaggcgtttcaccagataaccgtttggttgaaatcgttgaactttctgataaaaaattctttgtggcatgtcaatatcacccagaattgcaatcacgtccaaaccgtccagaagaactctacacagaattcattcgtgtggcagttgaaaatagtaaataatatatgctaaaaaacctccgagattaggaggttttttatttgctttaaataatcagaatatttaaaatatatcttgttttcctatactttttgtattataatagattcaatttaaatctgaagaaaaaggggtgaaaagatgcgtaaagtaggtctaattggttgtggtcatgttggagcaacggtggctcttgatattgttcaaggaggtcttgtagatgaattggtcattatagacaaaaaaagagaaaaagctgaagcagaggttctagacctgctagatgccctttctcttttaccgttctatgtcaaaatttatgttggagaatatactgatttagtaaatgccgatatcattttatcgaccttaggccatattgaactaattaaacctggcggagaccgttttacagaattaaaagcaaatattccagaaattaaagaagtttctgagcaattaaataggattaatttcaaaggaattctgattgtaacaactaatccaaatgatgtgattgtcaatctctattctcaattactgaacctccctcaaagtcatattattggaacgggaacatatttagatactgcaagaatgaaagcacaagtaagtaaagcattaaagattgatgggcgagctattgaaggatatgtactcggagaacatgggaattcacaatttaccgcttggtcaacggtcagggttgggggacaatcttttttagagattgccaaagaaaaaaatctagatttagaagacctagaagaaaaagcgcgtcaaggaggctttgctgtctttaatacgaaaggttatactaatgttgccatagctgcagcaacagtatctctgatgaatatggtgcttgctgatgctaagagtattgctatctgttcgcattatgatgaaaagtttaaatcctatatttctacccctgctttgattggtaaagagggagtagaggcccttgtaaaacttcccttaacttttaaagaagaagtaaagctcaaacaatcagtctgtgaaattcaggaaaaaatagattattttagctaaaaaaagagcctgttcatttgaacagacttttttaatcagcattagccatgccttcttcctcatcgtcagtattttcttcaatactgtcaagagtttcttcaaaactatcaaaggtttcttcaaaatcatcaagttgatcttcgacatcatccaaacgctcacgaatatcttggttttgttgataaacttcattaagaagaatttgaatatctccaagcatttcggtttggattttttgaatttgcatatttgaagcttgatcatccatcatcaaatggtcaagtttttcatggagggcagctacccctttttctgatttaacattgacttggaagtcatttttagcagacaagcggtcatggtgtgcagcacgattttgactcatcataatcaaaggggcttgcattgcggccgtaatcgatagaaaaaggttgaggagaatgaatggatatttatcccactcgactccgaaaataccagagacattaacaaacatccaaacgactaaaattccaagataagttagaatgaaagcccacgaaccgacaaattcagtaactttatcagccacacgttcaccgatagtttcttgggtttgaagttgttcttccacgtcatgaatctcaaaatttgccttagttaattcttcatttagtaaatcattgacggtaaagtttttttgcaggtcaagatgaaaaagggtatctaagacctccaaacggaatttaacctgatgttcattacagatgaaatcatgactggttgcttctgggtaatcgcgcatgataacggtttgaaggctagggtcgagattctcaaggaaatctcctcctgaccggcgatgaacacgaccgttaacaagacagacgactttatttttattaattggagttggagccattttatagcatggttcaagcttgtaaaatctaatttcttattttgtgaaatgggtcaagttttttgaattaaaatcaaaaagttggcacaagaagagcgccaatctactcttggtcaatttgacagaataagtaatcataataattgcgggtttgggtcgacctttcaaagcttgagcgctctcctttcatttaggtttttaaaggacagtttaaatatgtccatattaaattataaggtattttaagaaatttgcaagcctcaggaccaaaataaaaactcctgcagagcaagagtttttattttcaaacgctttttagcgaaagaacctgataaaatatcagtaatttagtttgctttagcctctttttccacagctacagcttggaaaagatatacaaaaagaccaaagatgagcgagataatcgttgtccaaagttcagggtctggaacgccagcaagagcagttgcaacataacctacaacttgtccaagagcaagcgaccaaaaaagtgtgacaataagtttcatatttacgcttctttccattattttctatccgcctatagtatagtacaaattatgacaaatttcaaattttatatataaaggagcagataaaaataagcaggtacttatctctttactattggtattttccactataggggattagtttagactctaaaaaatcatattcttcaacttgttcaatctgggtgaagaaagctctatttcgctcagtgagcattatatttgctggaatagtatcttcaaaacgaataagataggttggtttttctaaagcaatggcgtagccaagctcccaagctgttccagaatcagtatcttgatgatcgaaatcaacaattgcaacgatgatatctgctttatttatctcatttacatcattttccattgtcgctttggcccattcaggggtaaaagcttcaacttcttgtggtaaagattcaggatgttgacatctcattgggctaaaaaagtttgctactgttttattttttgaaagtgcattttctaaaagttcaactttttttatttgactttcgctaaaaaatggtgcggcaaggtaaacgttaactgcttgattaaacaacttgttcaaggttcaaatctcctaataattctatggtttcttcggcggtatcaacaagagaaatggcatctatgacttctttagaaatcattccttccttaagttgcaagcgcagtaggtcaaaaagaggttgataaaattttcgaccaacaaaaatgactgggcggacagcggtttggttgatagacatctcagttaaaagttgaaaactttcttccattgtcccaaatccaccagctaaaatgacaaaagcttctcctaaatcaatgagtttacgtttgcgctcatccattccacttgttaaataaagttgactggcattttgacgaggtggttctaaagggagaattccatcaggataaacggcaataactttaccttgatgacgaatgactgcatctgagaccattcccatacacccttcttcggaaccaccatagacgagggtatggcctgatttagcaagtaatattcctaatttttcgcttgtatctttatagattggattttttccatctcttgaagaaagaaagacggtgacattcattaattattttctccttcaatttcttttaatttttctttgatttgttgcaaaacatgaatttttgattgttcgtcctccacaaaatcatatttatcgccatcaatttggattttgggacaaatatcaaaggcttcaaaccaagtatcatatctgctatttaattctttatagtagtcatataaacttggatcgtattccaattgttcaaattgacgtcctctttttttgattctttctagcattttatcaaaagaaactttgacatgaatgagtaaatcaggcctttttttgaaagataaactatcaatttcttccaacatattgttaagtaagtcatcataaacctcgacttccgtttcatctgctcgtcctaaatcggcgttcaaatgaaaaagcagactatcttcataaatcgagcggtctaatacattattattatcagacaaggctcttttgattgaatcaaatcgcttatttaaaaagtatatttgtaataagaaggcatatttttgagggttctcatagaataatggcaaaactttattatcgtcaacactctcataaaaagcttgtgttttcaattcctccgccaacatctcagttaaagagctttttcctgctccaattgttccagctaataccagcactgtcattacacctttcccattctatttttagttttagtgattgtttaattaaaaattagtaataaataaacaaggcttgctcattatagtgcaaaaaaaagttctcgtcaaattgctaatatataagctgtaaatgctgttgttaaaggattcttttaggttttataatttttttattacgattaataaaaagatgaaacatcttagctttttgtaataaaaacgaattaaaaataagaatgaaagcagtttttaaaatcaagaaatgtcaaaaatgttggacgttttcagccgttaaattgttttttgatatcgatttagttaaatttaattacttttgtttgcgtttaataactaaaatttgacgcttttttttgttcttagtttgtctaaacttatcccaagttcaagctaaaatatagtataataaaattaatatcttttaattaagaaataccagccgttttagcaagaaaggaggaaaatatgtttgcacccttgaatacaaaaactgaatatagttttttagatagtgtcgttaaagttgatgactatttggaaacggcgcaccgtttaggttatcaaacggttggaatttgcgatgttgggaatcttcatgctgcttttcgttttgtcagaaaagctcaaaaatttaatttgcaacccattattagtattgagctaaattttgaatggcggggtttaccaattgctttttcttttattgctaaagatactgaaggttataaaaacttacttcggatttcgacgcttcataactatggacgccgtcaattttctgatattcaaaatcatttatcaggaatcgccttgattattcctgaaacttacggaagtttgagcgagctgacagaactttcgtcagtagctgatgaagcttttattgggattgatcaactgacagataaaggggcaaaatttaatttaccaacacttccttttcctgctattcgctatttgaattttgctgataatgaaattttagcaattttgcatgcggtgcgtgatggagtttcttttgatgaaagtttaacaatcagttctaatgaacttcttcaaagaccagaagcttatgagacttacttccagaaatattttccacaggctttgaaaaatctgtcagcattaacagtaaagattgcttatcagttcgatgaaaaattggagcttcctagattcgataagaagagacaggcagttgaacatttacgagaagaagcgactttaggtttgtcagctcgacttgaagaaaaaaaattactgacagaagtctcgtcagtaaatttgcaagatttgtcagtttatcaagaacgtttagaaaaagagttgtcagtcattcatcaaatgggatttgatgactatttcttgattgtctcggatttgttgcgttatgcccgtgaacaaaaaatttattgtggaatggggcgtggttcagcggccggttccttagttgcctatgttttaggaattacacaagttgaccctattcaacataatctcttcttcgaacgttttttgaatccagaacgtgtcgccatgcccgatattgacattgacatgccagatgaccgtcgtgctgaattattggcctatatgaaaaacagatatggttcagatcatgtcgcacaaattgttactttttcaaccttgggtaaaagacaggcgcttagagatgttggtaaagcttttggaatgactgaagctgaattatccaatttgactcggatgcttgtgcgtcgttttggaactttggctgatgagtatgaaaataatcaacgttttaaagctgaagtgttaaaaaatggaaaattgaaaagaatttatgaagttgcaagacgaattgagggaatgccccgtcagacttcaacacacgcttcaggtgtcgttctttctgaagaatctttggtgaattatgtatcattaaaaccgtcagaagatttggctttgacgcaatatgaggcgccagatgttgaagcaattggactcttgaaaattgactttttgggattacgtaatttaacaataatttctagattacgtgatttggtgaaaagacgtcaaaaaattgatgttgatccactaaaaataaatttggaagatgaagacacattggccctttttcgggctggaaataccatgggaatttttcagtttgaaaatccacaaatgcgacgctttttaagaaatcttgccccaagtaaatttgatgatattgttgatgcaacttcaattttccgtcctggtccatcacagtttattccacaatttgttgctcgacgacatgggaaagaaattgtgcctaccgtggatgattctattagtgaaatcttaaagccgacatacggaattatgatttaccaggagcaaattatgcaggtggctcaagcttttgctggcttttctcttgggaaagctgaccttcttagacgagcaatttctaagaaaaaagggtctgagttagaaaagttgcgtgaagatttcttagattcagcaagccataatggccattctaaagaaaaagcagaagaaatctatgacttaattgaacgttttgctaattatggttttaaccgttcacatggttttgcttatggggcacttgcttttcaaattgcttattttaaggcacattttcctgatgaattttatgaaattcaattacgtgatcgcaaacgtgaagtaatgattttagatgcgttagaaaatgggtttgaaatagaaaaaccaagcatcaatctgatgaaaattggcgattttgtaaaaaataaaaagattcgtttaggattggctcacgttcaaggaatttctcgtgatttagcaaaatgggttgttgaaaatcaaccctataaagatttagcagactttgtcgaaaaattacctaataattttcataaaaaagaaaacattctcccattgattcagattggagcctttgattatgcagactcaaatcgagggaaattagcttataatttggctgaccatgctaatttattaaactattatagtgatgatatttttatggcaagttctggtgggggctttgcctatcatgaggcagaagattattcagaaaccgaaaaatacgattttgaaaaaaatttattaggaattggggtaacaccacatcctttgcaaaatctagctcgcagatttgaaggtaattttacacctcttgctcaacttgtgaaaaatagacgaatgactatcttggttgaaatcaactacattagaacgcatcggactaagacggggcaaacaatggcctttttaacagtatctgatagtcgtgaaaattttgatgtgacactttttccagagatttatcgtcaattttcaagtgagcttgaacaagaaaaattttgcctcatcagtggaaaagtaacagaacgtaatgatgaattacagctggttgctgaccgaataagtccagctttagaaacggatagaaaactttggctaaatttaagagatgagaagtataatcaaaaaatttcacaaattttgcgtgaatttccgggctctcatcaagtgattcttcactattcaaatttgaaaaaaacaatccaaacaaaaatttatgtggaagaatcggagattttacaaaaaaggcttgaggggtatgttatagctggtatttataaataaaaaaccgttcatccgaacggttttttatcttatcccacataaaggtaaacagagaagaacatgagcattgcagccagtaaaacaaagaggtgccacaccacatgggcaaaaggaaatttaaagtgatagatgagtgctccaacagaataaacaacgccaccagcgactaaaagccaaaaacctatagggtttaatgtgttccataaaggataaatgacgattaaaatcatccaaccgagaacgacgtataaaacggttgataattttggtgttttaccccattttggtaagtagattgatgttaaaacaatccctaaaatagaacatatccaaataactgctaggacaatccaacctaaccaattgtttaaagcaactaaacagtaaggggtataagttccagcaatcaaaaagaaaattccgttgtggtcaaaaactcgaaagacttttactgctttagtaaaatgtaaactgtgtgctaaagttgaacatagaaaaagaatgactaacgaagctccatagattgtaaaagcaaccacttcaagtgcagaaccagatgcggcacctttaatgacaagaagaactaatgctgcaattgctagaccagttcctgctccatgagtaactgcattgaaaatctcattgagaatctgataggtttttgaaccttgtgtttcttccatttggtctctccaatttattgatttattcagcttttgagcaatttttaatttgtttttggaatcaaaaaaataatattatcaaccttttttgctctttccaactgaaaatttgttataatatatgatagcacaaattgtatagaaaaggaattggactgccgactttctcttatgagaaaaatgggagttcagatagtaaatatgccaataaaaattgtgacagattcatccattacgattgagccaggaattgctcgtgaacttgacattactattgttccgttgtcagtaacgatcgatggaacaatgtattcagacgacgacttgaagtttgaagatttcatggtcaaaatggctgcatcaaaaaacttgcctaaaacaagtcagccaccagttggtgtttttgccgaggtttatgaaaaaattgctgctgaggatgatgagattatctccattcatttaacagaagcattgtcaggaacagtagaagcagcacgccaagggggaatgctttcaggtcgtaacgtaacggtcattgatagtgactttactgaccaagcacaaaaattccaagtggttgaagcggcgcgcctagcaaaagcaggagcatctaaagaagaaattttagaaaaaattaaatatattcgagaaaatacagagctttttatcggattttcaacattagaaaatttggttaaaggtggtcgtgtcagtcgaatgacaggactatttggaagtcttttacaagttcgcgtcattggaactttgaaagaccgcgaattgaatactcttttacgtggacgtggaagtaaaactttctataaatggcttgaagaactttcagattctattagtagttctggacgtaaaatccgtgaaattggaatttctcatgctcaaggtttagagttttcacaaaaagcgaaagaagttttgcaaaaatttgttgaaaaacctatttcaattttagataccaacacgacaattgctacacacacaggtcctggagcttgggcaattatgattgattatgaataataaatctaaaaatatgatgaaaaattttatacgtacatttgccggcttgttgctggcaattttgctaattttaggattctttttgcttgtttttccaaaggcaggggaccgattttcagctgacaaaaaagtttcaactctgtcagcaaaaaatctgacttatgcagctttaggagattcactgacagaaggagttggagatgccacaggacaaggtggttttgtccctttatttgccaaagatattgagaataagacagatagctctgtcagtagtcaaaattttgggaaagctggagatacaagtactcaaatctataatcgtatgatgaaaagtaaaaaaattactgacggcttaaaaaaggctgatatcattacgattaccattggaggaaatgacgtcttaaaagtcattcgtgataatgtcagcaaactctcatcaatgacagaaaaagattttactaagccagagaaactttatcaagcacgagtgaaaaaattattagataaaattcgcgaagacaatcccaaagcgcagatttatgttctcggaatttacaatcctttttatcttaattttcctgatcttacagtcatgcagaatgtgattgatagctggaatacagcgactgctggcgttgtaagtcaagaaaagaacacttattttattccaatcaatgacttactttataagggttcaggagataaacaagcggttgaatctggcagtacatccgatgcagtttccaataacttactttatacagaagaccatttccacccaaataacataggttatcaacttatggctgatgcagtatttgcaagttataaggaggtcaaccaaaaatgactaagcgcttaaagaaaaaagcaaaaccagttgtttttctaggtcttgttctaggttgtgcattgattttgtcaggagttcttggtttggcgggacatttaaacgaacaagaatcgtctaaaacaaaaaagaaaagtcaattgtcagaaacaaaaaggagttcaacttcctcaaaaaatatggataaaaatattgagcagatgactttggaacaaaaagttggtcagttatttatgacaggaatgccagcaaataactataatcaggcaacttttgatgcgattgaaaagtatcaagtaggtagtattattttgactggtcgctctaatctcagtgtcccagaaatgaaagatattactgacaaactacaaggcttagcaccggctaatcgcaaactcttgatatcctgtgaccaagagggaggaaatgttcaggttctccaaggtcagggtttttcacagattcctgatggattaactcaaggaagttggacagctgataaattacaaaaggaatcacaaacttggggaagtgaactttatgcagctggagttaattttgacttagcaccagttgctgaccatgttttatctgccaactttgctccacaaaatgctccaattggctattggagtcgccaatatgcttatgataaagcaagtattataagtcatgctcaagcatttacggaaggcatgaaagcagccaaggttttgacaactgctaaacattttccagggcttggagcggtgacaggcaatacagatatcagtgcaggtgttagagatgaccaaacgaattccaatagcgaatctgttcaaattttcaaagatttaatctcttctgggacaccttcgattatgaccgcaaccgctatttatgataaaattgaccctaatcttcccggtgctttttcgtccaaaatggttgatggtttactacggaaacaattaagctttgatggtttggttattacagatgatttatcaaatgctgtccaagtacagtcatggacgcctggtcaaagggcagttttagcattgtcagcaggaaatgaccttgttttagcaaatgagcctacacaaattccagaaatgatctcagaagttttgcaaaaggcaaaagcagacccagactttgctaaaaaaatcagtcaatcagccacaagagtgattaaagtaaaagaagaaatgaaacttgtagaatagagaagcaaaatggaaaataacgaaaatcaaacaagaaaatcaaaaacaaaaaattccactaagccaaaaactgaaaaagaagaagctcttaaaaaacgtcctatttggaaatggctctttattattcttttggctctgaatatagctggagttgtgtttattgccattcgcgtgactagcccaagagaccaaacggttctcaatcaaaaatcaactaatagttcagaccaaaaggttgctcaaattacgagcacgacttcgcagctcaatgaattgataaatagttatttagaaacctatcaaactaaagaaatgacttacaagttttatatttctaatcaacaagcagttcttgaagcatcttataaactttttggaaccaaaattccactttatatttattttgaacctctggcactctcagatggttcaattagtctatctgtccaaaatatttctgctggaagtttgagtttaccaacttcggatgttctgcaaattgttaaggcatacgacttgccagactttgttcaagttgaaagtaagaaaaatcaagtggtcattaatttgtccaaaataaatgtctcaggtaatctttatattaaagcgaatcaaattgatttagccaaagggaattttgtctttgatttcatgaaaaaagcctgaaaaacgcattaaaatggcattttgacttgcaaactaggctaagatttgctaaaatgaaaattgcctatgtttaaggtaaaaaacaaatggaggacatttctaaaatggctaacaaacaagatcttatcgctgaagttgcagcaaaaacaggattgactaaaaaagattcagaaaaagcagttaatgcttttggtgaagttgtaactgaattccttgcaaaaggtgaaaaagttcaattgatcggttttggtactttcgaaactcgcgaacgcgcagctcgtgaaggacgtaacccacaaactggtgaagcaatcaaaatcgctgctacagttgttcctgcattcaaagctggtaaagcattgaaagacgcagttaaataattatagctattaagcattaaacaccgtaattttacggtgtttttttcttgtctgtcattaaaataaaaaacatatcccgggatatgcttttttagatttcctttgtaaaaaagattcagtgataatttcccctaaattttcttccttaacaattcctgtgtcagaaaaaccaagtttcttgtaaaagtgaatggcattttcattgctacttagtacccacagaccaacttttggataattctttgttgaaagtttttctaaggcgaattcaagcatttttcgacctattttatgttttttataggagtcgagtaagtatattccatgaatttcaccaaagttttcttcaaaagaattattccgaagagggccccaaccgcaaaaaccaataattttgccttcaacaatggcaaccactgtatttgaacaaagattatttttaaaaatattaatgcttgattcaagcgttctgttttttaagaaactttctgggagaagtccagtgtatgtttctaaccaggctttatagtgaacaaaagcaatttgctcataatcatctgggagtgcttttcttagtattactttcattgtcagacccttaatctttttttatattatatcatttatcaagaatgatattcaaaaaaatgaaaaagccaaatagtgatgttttctgccttgtttttttgttatactattgaatataaaaaagtcggaacgagaggagggaaaaatgttaactaaaaaaaactatcagtcacctttaggagaaataacgcttttaagtgatgaaacttatttattaggattgtggtttaaagagcaaaaatactttgcggccaattatgatttaaatcaggcaaaagaggataagagtcttccaattattaatgctatagaatggttggacgcttattttaaaggagaaaaccctgattttaaaaaaataaaattgaaaccagaagtaacggaatttagaaaaaaagtactcaaaatattaagtgatctcccctatggtagtctaattacttataaagaaatatcaaatctccttcaggttaatgaagagaaaaaaagaaatatgtcacaggcggttggtggagcagttggacataatccactttcaatcattatcccttgtcaccgagttgtggggaccgatggttccatgacaggatacgctggtggactagagaagaaaaaagctcttttgacacttgagcaagcacatttaaaaaaataattggagttttcatttggaaattactgacgaaacttgggaaatcattaaaaataatgataaaaactttgataataagttatggtatggcgtagcaacgaccaaaatattttgtcgtccttcctgtgtctctagactaccaaaaagagagaatgtaagtatttttcaagcagccgagcaagccttagaagaaggttatcgtccttgcaaaagatgtcgaccaatggataaaattgtaccaaatcaggtttgggtagaagagattgatttacttttaaaaaatcattatgatgaggacttaaatcttgaggagcttggacaaagacttcatggttcttcgtcttatcttcgccatatttataaaaaaataaaagggctaactccacagcaagaactaacaagaataagacttgagcaagcaagaatacgattgcttaaaggaaatgaagcaatctctgaaattgcgcgtgccgttggaatgatgaatactccttattttataaaatcttttaaaaagcgctatggacttgctcccaatcaataccgtaaagcttataatataaattccaaaaaataggagaaaaaactcttattttttatccctaaaattgcttaatttatcccagacttttggtcagtacttttggtagattgagttaaaatagcaatatgaaaataaaaaatataaaaaaatcctatggtaacaatcaagtgctaaatgatatcagttttgaattaaaagctggcgataaggttgctttattaggtaataacggtgcgggaaaatcaacattaatgaatattattaatggaaatgtcaaggcttcttcaggaaaaattgaatatggcaaaatgaaaccgacttccaataatactggttatatcatgcaaaatatgaccttacctcctgatgctttagtcagtgaagttttagctttgttttcaaatgatgaacaatctaaagaatatggcctaaaactggtcaaagaatttaaaatggaatcctatttaaggcaaagattttcaaatttatctggtggtcaaaaacaaaaactctttttagtatctgcactacaaaatagtcctgaatatttctttttggatgaaattacaacgggtcttgacagtgagagcagaggagagctttttaaatttttatcttcaaatttgaaagtgaaaaattcaactttacttttggtaacccattatttagaagaagccttgcaattatgcgaccgatttatcattcttaaagatggaaaaattattgcagatttacaaaaatcagatttaattcaagaagaattttcttttgttgaatttttagtagaagttccagaatttgaagcctataaactaaaagaaaaacagtacaaattaccaaaggaattggctgaacaagccatcattaaattcaataaagaacttgttttatatcaaaagacttaccgtatcaacttggaggaactattatcatgaaatttctaaaatattttacatttgaactacgtttacgctatcggaatccttcacaaattttctttgtatttatctttcccttatttttaatgtttgctttttcatcaagttttggaaaaagcataccacattatattgaaaataatattgcatcaatattattatacagtgttctatcagctagtttgacttcactgtcagtacaaattgctgactatcagtctggaaaaatttatcaattatttgtccaaagaggaataaaaaaattattttatattattgcacaaattgttagttttatgattattatcttttgctcaacgcttgttattctagtagttgctcattatgcttatgattatgagtttcctaagttgagtttattaattcttttttatctaaaactttatttatattcaattccattttgtttattagcaatgattattggacttcttgctaaaaacacggcaacagcaagtgcgattgctatgcctctgatgtttctttccttcttcttttcaggaatgatgattccgttagcacaactttcaggaggaattcgtaagattgctgacaattttttcctcactcagttactttctgatttaaaccatacattaacttccaactatacagtcgttccaaattggtcaagaatatctttaagtgtcggattgatttgtctcttagccctattagtttatcgaagaaaggcctaaatactttagcttttgtcagttaaataattgtttaagtgagtatttatttatataatgaaaaagtgaaattaaaaaaacaaattgaccctaatatagaagaagcggaaattgtcattgttgctcgaaggcaagaagaattttcggctattgtaaaagaatatcatttagaagatttgtcctctatagataacgaaaaactctatttggcaacaaataaaggttttgagattgttaatatcagagaaattttatatttaaaatcagaaaaaaattatctagatttccatatgacggatggagtgataagagtaagatctcctctctatttttatgagaaaaaattggctttgaattttattaaaatatcaagaaatactctggttaattttgaagaaataaggcgcttggaaacagactttgtttacggagtattgctttatatcggagaagaaaagttgcctgtcagtcgtagatacttggcaaatatcaacaagaagttagaagaaggggctaaaaaatgaaatatgtaatttcgggactcaaaggtgccttcattgctatagtatgtggagtcttgcttactttgtattttggtggagaaattgattttgaatcaatgactctaattcttgtttatggttttgttcagggggccatgtctaaattgatagatgaatatgtcacaattgccttgcttgaatttgttagtcaagctttagcaagttatttgctggcttggggttacttattagttaatacttggctttttgatagctcgtggcaacatcatatttggagttttactattacttggttgctcatttttattttggtatatctttattcaatcgtcagaaatcggcaaattgtcaaaagatttaatagacagaaatagtgaatgtcaaaaattttttatggtaatttaatcatcattcttatattttagtcaaacttttcggtattttttgtgttaaaataagattgatttttaaatattaaggataaaaaatgatatattttgataattctgctacgacagcagttaatccaatggttttacgaacttatacagatgttgcaacaaaaattatgggaaatccgtcaagtctacatggtttggggacaacagcgacgagattattagaggcttctagacgacaaattgctgaactgttgggagtcgattcacaagaaatattttttacaagtggagggactgaaggagataattggattttaaagggggttgcttttgaaaagcgtccttatggtaatcacatcattgtttctaatgtagagcatccagctgtaaaaaatacagcagaatggttaaaaacgcaaggttttgaagttgattttgtacctgttgatggtgatggttttgttattgtttctgagcttgaaaaattgattagagatgaaacgattttagtttcaatcatggcagtcaataatgaggtcggaaccattcaaccgattggtgaaatttctgacctacttgctgataagccaacaatttcttttcatgtagatgcagtgcaggccattggtaaaattccattagaggcttggttgacagaacgggtagattttgcggttttatctgctcataaatttcatgggccacgtggtgtgggaattgttgttgcaaaaaaagggaaaagattgactccgcttttacatgggggaggtcaagagcataattggcgttcgactacagaaaatttagctggaattgctgcgacttctaaagctcttcgtttagctttagatgatgatgactttaaacgtcaaaaagtacaagcaatgaagcaggtgattttagaagagttagaaaagcaccgaaaagtacatgtttttagtaaagtggagaattttgctcctaacattttgacctttgggattcgtgggattcgaggtgaggtcgttgttcacgcttttgaacaacatgaaatctatatttcaacaacctcagcttgttcttcaaagaaaaatgcggcggctggaactttagttgcgatgaatgtcccttcaaaattagcaacaagtgcggtcagaatttctcttgattcaacaaataatatggctgaagttgaacaatttttgactgtttttcgacaaatttaccaagaattagaaaaagtaagtggttaaatattttagaaaagtgatttgaagataatttcaaatcacttttcttatccaaatcttaaattgttcttattaagttatcattaaacttgaagtggtataactagatatggaaaaaagaacaagagattataaaaaaaatggctctaaaaaaatgagtaaacaagggaaagtacttattctagctttattagcatttctaattttctttgttggctttaaaatatatcatagtaaagatgttcaggcttcaacgattaaattggttaataaatcaaatgagacttatgcttactctgggtcaaaaaaattaactggtcttcaaaaaattaatgggaataattattattttgattcaacaacaggtgtgatgaagacaggtttgatgactttggatggtggaacggtttatttcagtccacaaacggggaaaatggtttatggattacaaaaaattaatggttattattactatttcacaaaaaagacgggtaaagatgatgtgattaaagcttatgaagcggtggccagccaattgaaatctgataattcagtgattgaaaaaacaatttcatcaggaatgaaactggttgggaaaagcccatatgtttatggtggagggcgcaccgatgattcagtagctgccaatgaatttgattgttcgagttttattgctcaaatgttccggttaggcggtcaatctttggtttatcaatttgcggcttcaacctctttgctagctcaaactggtgaggctgaagattggtcagataaggcgcgtggtgatttattaattacggctgacgatgcaagtgaggatgagcaacatgcggctatctatcttggcggaggatttattctacatgactcaacaagtactgatggagtgagcattagtcgtttaaatcaggtcatcaataagaaagttttaggaacaatgacttggggacaactttttgagccaggacatgttcgtcgtgaagtttaaaatttactgacagaataaaaaaatttactgacaaaaatctgtcagtaaatttttttattatttagtgatttcagcatgacgtaaatcaaaaatcatggctgagttataagttgaaattcctttaagttttggatttaataataaagaaacagattcagtggctaagggattgacattagcggccttatatagtgcattctcagcatctttataatgagcataacgtttatcagctgacagaacgtcaggagctgtagtcgcagcttgataggctttatcaaagttagggtttttgactaatccatgattcattgtacttcctgatacaaaattcatcaagaaatcagagggttcattgtaatctgcaccccaacttgtcagcagaatttggaaattattattttgagcatctttttgacgttgagctgaagaaacgagtttctcattaatggttaaacctggtaaatctttttcgagattgcctttaagatagtcaaccgctgccttggcaaaggaattgtcatttgctccttcaagttcaagagtaattgatgtttttcctaattcttttagaccttctttgaaaagttcagcggcttttgtggcatcatatttataaggttgggcagcgtaagttgcgaaatcttctccatttggtgcttgatctaattttttaggagtcactgtattcgtaattgaaaaacttggcgccgcaatttctaacaagttttttctatttgtcgctaagtttaaagcttgacgaatttttaagtttgaaagttcgggaactttaccagattgattgtattctaaaacatcaattcttggtgaagttagtgctttgtaatctttatttttcttatttgcagaaactaattctggagtggccaaattagcgacatcaagttttccagatttgaaaagattaacagcggtgttaggattatttacaatttgataagttgctccagaaagttttacatttttggcgtcatagaattgatcattttttacaattgaaaaagtttcatttgaaccagtccaattattttttcctttgacaaatttgaaagcgccattatagagactagtgtctgaacttgttccatatttatttcccatttttttaacgaaagcttcatttacaggataataagctgggagtgtcagcaatttattgaagtaaggagtaggtgttgctaaagtgatgactaatttcgtatcagattcagctttaattccaagagtatcaactggttttttgccagtcattatttcgctggcattagcaacaggtgttaaggcatatgcgtattgtgaaccagtttttgggtcaacggttctttgccaaccataaacaaaatctgcagctcttaatttagcaccgtttgaccactttaaaccgtcacgcaaagttacattataagttttgccatcttttgaaatgtcaattgattttgccaaatcgttgacaacttgcgctttgggattccaacggacaagtccagcatcaacgttgagcaatacatcaatggaattgacgtcagcagccatgctagtgtcaagggttaaaatgttgcttgcaaagctgtatttggcttcttgagcagaattttcagatttactgacagaatttccacaggctgtcagtaaaagggcagcagaaagtgaaattgcagagaaagcaaaaatttttgatttattcatgaaattgttttttccttattaaaattttccaagagcaaagcgctcccaaaataactttaccctaaaatagtgaaatataaaaatatgttgtttggattttagataaaaaatactgacaggaaaatcagaaaattttgtcaacctttttagctgatttatcttctccaaatttctgtcagtaacttttttactttctgtcagtaaaaattatttatttttccgactcaaaatcataaagagccgttgataagtagcgttctccattatcaggagcaatcgctaacacttttttacccttacctaattttttagctacttcaagggcagcataaatggctgcgcccgaagaaattccaactaaaaatccttcttttcctccaagatgacgagccgttaaaatggcatcatctcctttgacccgaatgatttcatcataagatttagtgtcaagattcccaggaataaaaccagcagaaataccttggattttatgtgggccagcagcctcacccgagagaatagcagattcatcagcttcgacaacataagttttgatagttggatttgcttttttgagggcatgcgaaactcctgttatcgttccaccagtccctgcacctgccacaaaggcatcaagtccagttggcccaaaagcatcaataatctcagctcctgttgttttttcatgaatttcaggatttgcgggattttcaaattgcatggcaagaaaataaccttctgtttctgagagttcttttgccttagcaattgctgctttcattccaccgctagcgggtgttaaaactaattgagccccgtaagcttgaatcaatttgcgacgttcaagtgagaatgactctggcatgacaatgacaactttgtaacccaaagcagagccaacgaaggcgagtccaattcctgtatttccagaagtcggttcaacgattgttccaccaggttttaaacgtccgtcggcctcagccgcccgaatcattgcaagggcaatccggtctttcacagaaccaccaggattgaaagcttcaagtttgacataaacatcagcactctctgctggaacatgttgaagtttaacaattggagtttgtccgattaattcagtaatgttatcataaattttagtcattttttcgctccttttactttattatagctcaaataaaaaaatttgcctcctaatattataatcatggctctaaaaaaaatttatgatgtaaaatttaaaaaataataaagaaaagactttacaaatcgccagaaaatttttatactagtaagtaacaataaaaatacaattggcatattttagtcaaaaaattatctaatattaaagaggagactcgatgaaacagaaacataaattagcgcttggtgcgtcaattgttgctttggcaagtcttggtgggattaaagcacaagctgcatctgttcaagaaattattaacgctgcggtaccagtggcaaatgactacggactttatccatcagtaatgattgctcaagggattttagaatcaagtggtggacaaagtgccttagcaagcaattataataatatttttggagttaaatacacttctggtacacctgtttatctaccaacacaagagtatttgaatggaacaatgacaaatgttgttgaacccttccaagcttatagctcagtttatgacgcatgtgttgcccaagctaaaatgttacgtgcttcatcatattattctggggcttggcgcgaaaatacaagctcttacctagatgcgacagcttggcttgaaggacgttatgccacagatccaacatatgcttctaaattgaatagcgtgatttctgaacttggtttaactgtttatgatcaaggaggagaaatatcaggaggaactgctgttacaactagttcatcagcctcaacaaattcagctggcacatacaaagtacaagagggtgattcattatcagcaatcgctgcccaatatggtacaactgttgatgcacttgtgtcagcaaatagtttagaaaatgcgaacgatattcatgtaggagaagttttgcaagttgctggtgctagcgcaactacaacaagtaccaatacaacttccaatgtatcgtcaagttctacttataccgtcaaatcgggagatagtttatattcgattgcggaacaatatggaatgactgtttcatcactgatgtcagccaatggaatttatgatgttaattcaatgcttcaagtaggacaagtattgcaagtaactgtaagtactagtgcaacaacttcaaacacaacgacttcaaacagttatacaattcaaaatggggacagcatttattcaattgccacagcaaatggtatgacagctgaccaattagcagccctcaatggatttggaattaatgacatgattcatccaggacaaacaattagaatctaaataaaaaaagttactgacaaaagaatcagtaacttttttttattggaaaaaaggattattttgtttttcagtaccaatacttgttttgggaccatgaccaggaaaaacttgagtattttcatcaagtgtgaagagctgctcacgaattgattttaaaagttgcgcttgatttccagtaggtaaatcccagcgtcctattgcattcttgaaaagtgcatctccactaaatacaaaagactcattttctaatgtaaaaagcagacttactccaccaatagaatgtcccggcgtttcgagcacttgaaacttgaaagcatcaatatcgtaaaattgattaatttcataaaaataatcagcttcagggccagtcacagcagttcctaggaaaaagagtgatgcatttaatttaggatttttcatccattctttttcatctgaatgaaggtagataggaacatcaggaaaatgtttccttagttcattcagtcccataatgtggtcgaaatgagcgtgtgtcagtaaaatagcggagattgttttgtcagtaattttaagacgttcaagaagtgctgacgaatcacttccaggatcaataatgagatgtgaagtagaattgctcaggagatatgtattctcctgagcaattctattaacaattttttcaattttcatttagttaccattagcggaggattgacttattgtttgaccagaactatttgttttgacaagagcagttccttcttgactaacaccctcaggcattgtccatgtcgcaacagatgaaggatcaggagtaagttgggtcatcatagctgagaagactttagtagcaatccgagtacttgtaccataaattggagtcattcgatttgaataaccggtccaaacagccattgaatactgaggagtataaccaacaaagttttcatcaggagaaaccattgagccagcaaaacctggaacagaaccatatttttcattaatttgagtcatttcactatctgtatagttggatgtaccagttttcccagcagccgctaagccaggaacagctgcataagaacctacagattgagaaagtggtaaagttaaaacactttggagaatattggtcatgatgtaggctgttgaagcttgcattgctcgtgagcggactggtttgtattcaactgtacgaccatcgggaaagacaactttggaaacatagtaaggtttagtgtaaatcccaccatttgagaaggcggcataagcagcagccatttgttcggaacttgctccaccgtttttcgtgctagtattactagaaatagcattagaatattgcataggatccaaattaatccctaaaccgttaacaaatttactagaattatctagtccaacattgattaaagtttttacagcagggatgttacgtgaaagtgctaaagcacttttgacagtcattgaaccaaaataagtattatcccagttttttaaaggcgttccatttggataagtagttggggaatcggaaacataattattagttgaagtataaatattattttcaaaagctggaccgtagtcaacaattggcttcatggtagaaccccaatctcggtctgtttgcacggcttggttaaagccaaaagtaacattgcttggttgattacgaccaccaatttgtgcaattacagcaccagttttgacatcagtaacagttgaagcaacttgcattgtatcatctggataagtgatatagttgccagtgttaacgatattatatagattttgttgggctgttgtatcaagagtagtataaattttagctccctcagtcaaaatatcgtctccagccaaagttttagcttgagcaattgcctgtttgaggaaattatcagcataacttggaatagttacactttgttttaaaggttgaagtccatcatcgattggggtagccagtgctttcttttcttcttccgctgtaattttatcatagcgacgcattgcacggataaccatatcacgacgccatttagcagaagtagggttagtatatggattataagtattaggggcttgaggcattccagcaagtagggcaagttgagcgattgaaagctcagttaaatctttaccataataggcttgggaagcagttcccattccataataaccatttgccatattaaccttattaacataagctgtaaaaatttgctccttagtccatttttggtctaattttaaggccatccaagcttcttgaattttaacactcaaagtttggtctgattcatcggttgagaagaatgaaagcttaatgagctgcatatcaagtgtagaaccaccgtttaaagaaccaccttttaaattattaacaaaagccccagcaatccgaatggggtcaattccacgagtattgaagaaacgatggtcttcaatagaagtaaccgcattaaccaacattactggaatattatcagttttaaccagatttctttgttcagctcctaaagttgccactactttttcgctagagtcataaactttagtagaaggtttagattcaagtttgtccaaagtgagtgcaggtgcatccttagcataataaacgaaaacggcgcccccagcggctaaggctaggataattaaagaaaagaaagcaattaaaaataattttactgccgtccacattttagatttggcggaaccgcgttttgtacgttttttttgtttatttttcttagatttagtagaaattttactgtacctcacaaagtttattcacaatttctaaataaggaattctaggaatgtgattcgtttcaattttatagccattttcgcgaatatgagaaagcggaattgactttaaaccgcctttttcgtaataaaaagtaatcaaacacgaagatggaagaagatatgtttcatttagccttgcaaagtgcaagaggacaaaagcaattcccccttgagcgagaacattactcatgtgaacaatttgatgctcatggaaattttttagagggaaaacagttttttgctgtgtttcttttgcttcaaagtcgatgtagtgacctttatagactccagagtagtcagtagtagatgcttgcctgaagtaagcttctgtaatttttgcacgactcctttgtggataatctactttaacgatttgaattggtgttggctttttgtgaataactgcaagtccacgagaaagataatactcatttgttgcattaatttcagcttcaaaattcattccccgcttcccgaaggcaaccatccctttggtttttgaggtgctttttttagttactgacagctctgtcagtgatttttttttcttaggaacagtgctgtaagctcgcgaccttccattaggataattaaccattctgtcttctacctttataaaattctcagttagttatataatgtctattataacataaattttacaaggggaaaatatttatgaattcactactaatcatgggttatacaagttttgacctaggtattttcaatgaaaaagacataaaagtatcaataataaaaaaaacaataagaagaaaattaattaactttttggaggaaggccttcgttggattatttttacaggtaatttgggttttgaatactgggcgttggaagtagcaaaggaacttcagacagattatgactttcaaattgggacaattttttcttttgaaacacatggccaaaattggaacgaaagtaatcaagttaagttggcagctttcaagcaagtagattttgtgaaatatgcttttgaaacttatgaaagcccaagccaattccgtcagtacaatgattttatactggaaaataccgaaggagcttttgttttttacgatgaagaaaatgagacaaaattaaaatatatggttgaaaaaatgaaacaaaacactaattatgaagtttatttgcttgattttgaagatttacaagaaacttttgaagaaatgaatgagtgatttcgtaatttttagaagaaaataattgctaaaaaccataacgtcactttttttgcgatattaattttgatataatacttagcagatgtaaattagtttttatccaatgaggagaaaaataaacttactgataattttaaaaggatgggaaataggactgtgattgatttatatttgtcgccatcatgtaccagttgccgtaaagcgcgcgcttggttgcaaagccataaggttccctttgtagagcacaacattttgacacaaccgatgacaacaaacgatttgcgtcatatcttgacgaaaacggaaaatggaacagaagatattatttcgacacggtcaaaagtttttcaaaaattggctgtggatgttgataatttgactattaatgaattattagacttggtaacagaatttccaaatctattaagacgtccaattattactgactcaaaacacctacaaattggctttaacgaggatgaaatacgtgcatttttgccacgtgaatatcgtcgagcagaaatgttaagtacaatagattaagatttaggcagcaaaatttactgacaacaattctgtcagtaaatttttgctgaattttatagattttttagcctgaacgggcaggagaaacatgaaagaaaattataattatcctcttgatttaagttggaatactactgaaatgacagaagtgctctcttttttcaatcaagttgaaaaattttatgaaagcaaagttgaaaaagaagtttttttagaatcctataatgctttcaaaaagattgttccctcaaaaatgcaagaaaaacagcttgggcgtgattttgaactaagcagtggttactcactttatcatgcagtcaaggaggtaaaagctagtggaaaacgatttgtcagtgctgacaaggcttgaattagctaaagattgggtaagagatgctggaaatttcttaaaagaaaatatagctgctccgttggaaattactgaaaagactcgctatgatgacttagtgacaaattttgacaaagaagtccaagagcaaatagtagccaatattctccatcatttcccggaagataaaattttagccgaagaagacgaagaaaaaataaagttcgattcagaaattccgcatctttgggtcttagacccaattgatggaacaacaaattttattgttcaaaaagataattttgccgtgatgcttgcttattatgagtatggtgttggtaaatttggtctaatactagatgtaatgaaggataaactttattggtgtgatagccacaaagccttttgtaatcaaaaagaattggaactcaaagaaagacctttggctcaaagtttgcttggagtgaatagttttatgtataggtctaatagtggaggcttgttagatttaagccatcaaactttaggggttcgtatcattggtagtgcaggtatcagctatggtcagcttctggaaggaaagataattggttatttcagtagtcttcaaccttgggattatgcagctggaagtattattgctgaaagaattggctatgttacattgaccatatcgggtgaaagtccccattttaactgtagagagcgagtattcactgctccctcatacttaatttctgaaatacaaaaatacatcaaaaaataaatagagtgaaatatttcagaaaaatggaaggtacttttgtgttataatctaaaaatataaaataaaatttagaggaaaaataggatttaaatgatggataaaataattgtaaaaggtgggcaaacaaaacttcaaggtgaagttgaaattgaaggagcaaagaacgccgttcttcctcttcttgcagcaacattactcgctagtgagggtgaagttgtccttactaatgtccctattttaagcgacgtttttatgatgaataatttggtaaatcatcttggaactgcgattagctttgaccaagaagcaaagaaaattattgctaaatcaaattcagaaataaaaacaactgcaccatatgagtatgtcagcaaaatgcgtgcctcaatcgttgttatgggaccaatcttagcccgcaacggacaagcacgtgtatcaatgccaggtggatgttctattggatctcgaccaattgatttacatttacgcggttttgaacaaatgggagcaacaatcactcaaaatgctggttatattgaagctaaggctgataaattaaaaggagctcatatttatcttgattttccatcagtaggagctactcaaaatcttattcttgctgcgacactagctgacggaacaacaacacttgaaaatgcagcacgtgaaccagaaattgttgacttagcaaacctcctaaataaaatgggagcaaatgttaagggtgccggaacagatacaattattattaaaggtgttgaaaaaatgcatggggcaaaccattcagttgttcaagaccgaattgaagcaggaactttcatggttgcggccgcaatgacacaaggtgatgttttaatcaaagatgcgattgctgaacataaccgtccattgatttcaaaacttagcgaaatgggtgttaattttacccaagaagaatctggacttcgagttgttgggcctgaaaaactaaaagcaacaagcgttaagactttaccacacccaggatttcctacagatatgcaatcacaaatgacagctgctcaggccgttgccgtgggagaatcagtgatggtagagacagtatttgaaaatcgtttccaacatttggaagaaatgcgtcgtatgggattggaagttgacattactagaaatacagcgcttattcaaggaaattcaaatttacaaggtgctgcggtaaaatcaacagatttacgtgcaagtgccgcattgattcttttgggattggttgccaaagggcaaacaactgttagaagattaagtcatttagaccgaggctactataaattccatgaaaaattaaaagctctgggagctgatattattcgtgtagaagacgaagacggagaaggctaatgtttaagaaaaccataaaatttttaggactaagactctctattattatttttgttatagttctactagttcttgccgccgttttaggacttatggttggttatggttttctaggtggaggaaatccttccaacgttttcaaccataatttatggaaagaagttatggataaacttagccctgcaaaataataaaagacttgattcggaagaatcaggccttttattttgttaaaaaattacgatttataagtcaaaaaagctagtcattcttgaaatatagcggattttatgctattcttgaagggtatgaatttctgagctcaggctcaaaataaggagaaaaaaatgactgtaagttttgaaaaaactagtgatactaaaggtacactctcattttcaattgaccaagaaacaattaaaactgggcttgacaaagcctttaataaagtaaaagctaacattagcgttcctggtttccgtaaaggtaaaatcagccgtcaaatgtttaataaaatgtacggtgaagaagcgctttttgaagaagctttaaacgctgttcttccaactgcttatgatgcagctgtaaaagaagctggtatcgaaccagttgcacaaccaaaaattgatgttgcaaaaatggaaaaaggttctgactgggaattgactgcagaagttgttgtaaaaccaacagtttcacttggtgactacaaagaccttacagttgaagtagaagcaacaaaagaagtttctgacgaagaagttgaaacacgcttgactaactctcaaaacaatttagctgaacttgtagtaaaagaaactgctgctgaaaatggtgatactgttgttattgacttcgttggttcagttgatggtgttgaatttgaaggtggaaaaggttctaaccacagccttgaacttggttcaggtcaattcattccaggatttgaagaacaacttgttggaactaaagctggtgaaactgtagaagttaaagttacattcccagaaaactatcaagctgaagaccttgctggtaaagaagcactctttgttacaactgttaatgaagtaaaagcaaaagaattaccagaacttgatgatgaacttgctaaagatattgacgaagaagttgaaactttggatgagcttaaagctaaattccgtaaagaacttgaagaatcaaaagcagaagcttatgatgatgctgtagaaactgctgcaatcgaagctgctgttgccaatgctgaaatcaaagaaattccagaagaaatgattcacgaagaagttcatcgcgctatgaacgaatttcttggtggaatgcaacaacaaggaatctctccagaaatgtacttccaaattactggaacttctgaagatgatcttcataaacaatatgaagcagacgctgacaaacgcgtgcgtacaaacttggtaatcgaagcaattgctgctgctgaaaactttacaacttcagatgaagaagttaaagcagaaattgaagatcttgctggtcaatacaacatgcctgttgaacaagttgaaaaacttcttccagttgatatgcttaaacatgatattgcaatgaaaaaagcagtagaagttattgcaacaacagcaaaagtaaaataatttcatataataatgaaaaaaaataagtgtcagtaactactggtacttatttttttatcattaattcaaattttgagtgagatttagttcatgtatttatcataatatgtaaaaaatcgatccaattatgagtataagttgcttggtaaactttaatcatcgcagtgaccatccgtttgacatcggccttagcagcttcaccaaaatattttttaccatagaataaaccaatcacttggctaaaataagactcagtcaaatcaagttgatgtttttcttgacttcttgcttcttgaacatttgaaaggaaacgtccataagctccaccaagaattctaaggtcttcattgaagaaagaagtagcgccacgtgcaatttttgtcagcatccaagctttaatgagtgaccaattttcttcattgataagtaaatcaaatgattcataaaaacgatcttcgtaaacaatgactttatcaggttcagtttttactaaatctttaattaaagattttaaatccagatttttaactttactgacaaagctgtcagtagaaattggatgataaagttcagcgtattttgcccactcttcagaagtatttgctgacggaactaaaagagcatcgaatttaagggcagactttgcaatctcttctgcattttcaacatcaaatgtctttaaaatttcgcttgtgtttttagcccaaaaatcaagtaattctttttttctagggtgttcatcattataataagtggtatcaggtaaaatcaaacccgggccagaaaatccaagagaatagtgaatagcatctttcatatcaggttcaacactaaaagaaaatggaagaggtgcctgtgaatggaaaacgagttgagtcaaattatttttaaaatcttcaaaagtatttaaagtttcaactttagcaagttcattttttacggctgaaaagtctgctttttctcttgcgtgccaatctcctgctttattataaaatttgattgcttcaagcaattctggattatcagtaggtaggttttgtgataatccagctaaatctttaaccaaatttttctcattttttagtactaattcatcaaaagctgaaattcttggtttgtcagcaggaatttctgcattttctaaccattcagcattaacagtagcgaataaatcatcttgaatccttgtcatatcgacctcctattatggatattttttatattatatcacacttacaaaaaagcgctgacgaattccatcagcactttttaacagcaatttgaaaattaatgtaaactcgtaattaaatagttctgaaacgataaattttagcaattttgccaaaaagttcagggacttcggcaaggcttccagcatcacggcttagacaagtaagcttttcatcttttactgaaagcttggcaaaatggtcatgttgcaacaagaaattatggatcagctctgcaaaatttgcgtcagtaaattttacaaaaagtaaatctccattaccaggagcttccgcatctaaaggacccccaacgagttcaaaaactgcatcgtaatcatcaggaagttgctttgtgagcagtttgattgttttgcggctttcttgtagcgcccaagtattatcaccacaaaatacaaattgttcagtactcaaagaaatgggctctctttcaagaagttcaagctcatcaattcgattttgaatataatttagcaagttttgtttattatctaatgtaagatattcaaacaaaagctttgccttattataactgtacttgtcatctttaccaagaaggtattcagttgtgacattaaaataatcagcaatttctgtcaatcttttggcagaaggttcttttcccaagcgataattagcaagggcgtttctgggatatctcaactctctttcgacctggttgaaagatttctgagaatcaataactaaagtttttagacggtcatagaacattaaaatcacctcaacatgtattgaataaatatttttaatatttgtaacaaatatattatatcatatagttattagatataaaatacctaaaacttaaaaaaatagcaatatttaagttaaaaaattaattgttgcaaatactttaacaaaattgacatctataacgtcgtgtggtattataaaagtaatcataggaatactcaatatgctttttgagaagagaaagggaaaaattgaaagaaatttatgacaaaatccaagacataaatattattttgaaaagatcatttattgaccttggaaaaccactagcttatcaagaggtggtagagaaaagtgccaaagttttagagtctagcctttttatcatagataccaaacgaaattgtttaggttatggttttactgattctgataattcttatcaggatgatataagcctccaaaatttttttatctatcaaaaaatatcaaaagatatctctagtcaactattaaatcactacgaaatgagcgcaagcctaccaatggcccaatcaattttagaaccagtgaaagaaatttcgagcaaatttccaaataaatttctcagctttctacctatagaaggaaatcatttgagattgggaaccctttttctactgacagattctcctctggaagaagaaaagagaatattggtagattttttatcaacatttatagggaatcaaatgtcttatatcatgttggcagaactggaagggcaaagacgaaatgaaacctttgtttctttagttcaatcattatctcgttcagaattagaagcatttaaaagcatcattgaaaaaatagaccgttaaactagaaaaagcttgaaaattttcatataaaatagtataatagaaataatggtttgtcagcaaaatctgtgggatatattgtccccataggctttgtaagcaacgaaacactactgttttcgttgcttttttggcgtcttttatattgaataaaccagaaaagttataaaaaagacaaactacagacttttcggtttttttaattaaaaattcatcaaaaacacagacttttttaatcaaatctaaaaaatagaggagaaaacacttggcaggacatgacgtaaaatacggtaaacaccgtacaagacgcagtttttcacgtattaaagaagtaatcggtttgccaaacctcatcgaagttcaaacattaagttataaaaacttcctcgatgaaggtcttgcaaatgtcttcaaagaaatgtttccaatcgacaactttgcgggtacaatggaactcgaatttgttggttatgaaatgaaaaccccaaaatatactgttgaagaagctcgcgcacatgacgcaaactattcagcacctatctatgtaaccttccgtcttgtaaataaagaaactggtgaattaaaaacacaagaagtcttttttggtgacttcccactcatgactgaaatggggacatttatcaataacggttcagaacgtttgatcgttagccaattggtacgtagtcctggttcatacttccatcttaaagctgataaaaacggtcttgaaagttttggacatacaacaattcctaaccgtggagcttggtttgagttagatacagatgctaaaggcattggttatgttcgtattgaccgtacacgtaaattaacttttacaactatgcttcgtgcgcttggatttggttcagatgaagaaatccttgaattgttgggagaaactcaacttttaacagacactattgcaaaagatgttcataaaaacccagctgacacgcgtgtagaagaagcgctcaaagacatctatgaccgcttgcgtccaggagaacctaaaacagcagatagctcacgtggcttgcttgttgctcgtttcttcgatccaaaacgttatgacttcgcacctgttggacgttacaaatttaacaagaaattagcgcttaaaaatcgtttgcttggtttgactttggctgaaccgattgttgacccagaaactggtgaaattcttgttaatacagatactcttgttactcgtgatgtgcttgatttaatcgaaccattgcttgataacggtcttggaaactttgttgttgaaccatctgacgacgctgtaattccagaaccaattactttgcaaagtatcaaagtttattcacctaaagatccagaacgtgttgttacattactctcaaatggtaatcctgatgcagaatgccgtgtcttgacaccagccgatgtgatttcaaatatcagctactggcttggtcttgctgaaggaattggtaaagtagacgatattgaccacttaggtaaccgtcgtatccgttcagtaggtgaattgcttcaaaatcaagtacgtatcggtctttcacgtatggaacgtgttattcgcgaacgtatgtcatcttcagaaaatgaaaatatcacaccacaaggtttgattaacattcgtcctgtaacagcttcaattaaagaattctttggttcatcacaattgtcacaatttatggaccaacacaatcctttatctgagctttcacacaaacgtcgtttttctgccttaggacctggtggtatctcacgtgaccgtgcttcatatgaagtacgtgacgttcactatactcactatggccgtatgtgtcctattgaaacacctgaaggaccaaacatcggtttgattaacaacttatcatcatatgccaaagtaaacgaatatggtttcatcatgtcaccataccgtcgtgttgaccgtgtgaacggtgtggttactgacgaagttgaatatttaactgccgatgaagaagacaactatactgttgcccaagccaactcaccattgactgaagatagccgctttgctaacgaaacagttatggctcgtcatactggtaacaatattgaagttgaagcttcaacagcagactatatggatgtttcacctaaacaggttatcgccgttgctgctgcatgtattccattcttggaaaacgatgactccaaccgtgccctcatgggtgccaacatgcaacgtcaagcggttccattgattgacccacatgcaccttggattggtactggtatggaacatcaaactgctcgtgactcaggtgctgcgcttattgcaaaacatgctggtgttgttgagtatgttgatggtaatgaaattcgtgttcgtcgtacttctggtgaacttgatatttacaatattacaaaatatcgtcgttcaaactcaggaacttcttataaccaacgtccattggctcgacttggagaaaaagttgagaaaggggacatcattgctgatggaccttctatggaaaatggagaaatggcccttggtcaaaatccacttgttgcttatatgacttgggaaggttataacttcgaggatgcggtaatcatgtcagaacgtttgattaaagacgacgtttatacatcaattgccatcgaagaatatgaatcagaaacacgcgatacaaaacttggccctgaagaaattactcgtgaaattccaaacgttggggatgaagcactcaaaaaccttgatgaatcaggaattatccgtattggtgctgaagttaaagatggtgacttgcttgttggtaaagtaactcctaaaggtgaaactgatccaacaccagaagaacgtttgcttcgtgcaatcttcggtgaaaaagctcgtgaagttcgtgatacatcacttcgtgttcctcacggaggtggcggtattgttcatgacgttcgtgtatttacacgcgaaaatggtgatgaattgccatcaggcgtgaataaacttgttcgtgtcttcatcgctcaaaaacgtaagattcacgttggggataaaatggccggacgtcatggtaataaaggggttgtttcaaatatcgttccaatggaagatatgccttacttaccagatggaacacctattgatatcatgttgaacccacttggggtaccatcacgtatgaatatcggacaagttatggagctccatttaggtatggctgctcgtacacttggaattcacattgcaactccagtgtttgatggagcatctgatgaagatatctgggataccgttaaagaagctggaatggccgatgatgcgaaaacggtcctttatgacggacgtactggtgaaccatttgataaccgaatttcagtcggtgtcatgtatatgattaaacttcaccacatggttgatgataaactccatgctcgttcagttggtccttactcactcgttacacaacaaccgctcggtggtaaagcgcagttcggtggacaacgttttggggaaatggaagtttgggcacttgaagcctatggtgctgccaatgttcttcaagaaatcttgacttacaaatcagatgacgtgattggacgtacgcgcgcttatgaagctattgttaaaggagaacgtattcctaaaccaggtcttcctgaatcattccgcgtattggttaaagagttacaatcacttggtcttgatatgaaagtccttgatgctgaccgtaatgttcttgacttacgtgaattggatgaagatgaagtaatgactcgtccagataatacagaaattactcctgaaatgcttgaagcacaggaagctattgttgcacaagcagaagctgaagaagaagctttgattaacgctgatactgaaaaataagattttgtaattaatattttgagatagatttactgacaaaaatttctgtcagtaaatctctaatctcataatcgtctagcgttaaatttattagaagtggagaaagaattggttgatgtaaataaatttgagagtatgcgtattggtatcgcatctccacaaaaaattcgttactggtcattcggtgaagttaaaaaaccagaaacaattaactatcgtacacaaaaacctgaacgtgaaggactctttgatgaacgtattttcggtcctcaaaaagactgggaatgtgcttgtggaaaacttaaaggtgttttctacaaaaatcaagtctgcgaactttgtggtgttcaagtaacaactgcaaaatcacgtcgtgaacgtatgggacatattgagcttgctgctccaatttcacacatttggtacttcaaaggaattccatcacgtatgggacttgctcttgatatgagtccacgtgcacttgaagaagtgatttactttgcaagttatgttgtgattgatcctaaagaaactgatcttgagaagaaacaactcttgactgaacgtgaatatcgtgaacaacttttgaaaaatggttttggttcattcgttgcaaaaatgggtgctgaagcgattcaagatttgttgaacgatgttgatattgataaagaagtttctgaactcaaagaagagctcaaaacagttactggacaacgtcgtgtaaaaattattcgtcgtttggacgttttgtcagctttcagaaaatcaggaaatgctttatcttggatggtcttaaacgtattaccagttattccaccagatttgcgtccaatggttcaattagatggtggacgttttgccacatctgacttgaatgacttataccgtcgtgttattaaccgtaataaccgtttgaaacgtttgatggaacttaatgctccaaatattatcgttcaaaatgaaaaacggatgcttcaagaagctgttgatactttgattgacaatggtcgtcgtggtcgtccaatcactggtgctggtaaccgcccattgaaatctctttcacacatgttgaaagggaaacaaggacgtttccgtcaaaacttgcttggtaaacgtgttgactattctggacgttcagttatcgctgtaggtccaacactcaaaatgtaccaatgtggtgttccgcgtgaaatggcgattgagttgttcaaaccattcgtaatggctcaacttgttaagaaagaattggctgctaatattcgtgcggctaaacgtaaagttgaacgtcaagattctgatgtttgggatgtacttgaaacagttgttaaagaacaccctgttcttcttaaccgcgcacctacgcttcaccgtttaggtattcaagcttttgaaccagtcttaattgatggtaaagccatccgtcttcacccacttgcttgtgaagcctacaacgccgactttgacggtgaccaaatggccattcacttgccattgtctgaagaagcacaagctgaagcacgtcttttgatgcttgctgctgaacatatcttgaaccctaaagatggtaaaccagttgttacaccatctcaagatatggtccttggtaactactaccttacgatggaagaaaaaggtcgtgaaggcgaaggaatgatttttgcaactcctgaagaagttgaaattgcaatgcgtaatggttatgtacatttacatactcgtatcggtatcgcaacaaaatcactcaacaaaccttggacagaaaaccaaaaagataaaatcttggtaactactgttggtaaagttattttcaactcaatcattcctgaaggaatgccttacttgaacgaaccaactgatgttaacttgacaacttcaactgatgaccgcttctttatggatgctggtcaagatatcaaagaagttttggctggaattgatactgttcgtccattcaaaaaaggatatcttggaaatatcatcgctgaagtcttcaaacgttaccgtacaacagctacatctgagtaccttgaccgcttgaaagaccttggttaccaccaatctactttagctggtttgactgtgggtatcgccgatatccctgttgttgaagataaacatgaaatcattgatgctgcccacaaacgtgtggaacaaatcactaaacaattccgtcgtggtttgattactgatgatgaacgttataacgctgttacaggcgtttggcgtgatgcaaaagaagcccttgaaaaacgattgattgatgaacaagatttgacaaacccaatcgttatgatgatggactctggagcccgtggtaacatctctaacttctctcaacttgctggtatgcgtggtttgatggccgctcctaatggtaaaatcatggaattgcctatcatctcaaacttccgtgaaggtctttctgtcttggaaatgttcttctcaactcacggtgcccgtaaagggatgaccgatacggcccttaagacagccgactctggttatcttactcgtcgtttggttgacgttgcccaagatgttatcattcgtgaagacgactgtggaactgaccgtggacttgtaatttctgatattgctactggtaaagaaatggttgaaccactctttgaacgtttggtaggtcgttatactcgtaaatcagtgcttcatccagaaactggtgaaatgattattgctgacgacactttgatttctgaagatgttgcccgtaaaattattgatgctggtgttaaagaagtaactatccgttcagtatttacatgtaaaactccacatggtgtatgtaaacattgttatggtatcaatttggcaacaggtgatgctgttgaagttggtgaagctgttggtacaatcgccgctcaatcaatcggtgaacctggtactcagttgacaatgcgtacattccatacgggtggtgttgcgtcaagttcagatatcactcaaggtttgcctcgtgttcaagaaatctttgaagcacgtaaccctaaaggggaagcaatcatcactgaagtaactggtacagttgaatcaatcgttgaagatcctgctacacgtactcgtgaaattactgttaaaggtaaaacagacactcgtagctacactgtaggtatggctgatgtcttgatggttgaagaaggtgaatttattcaccgtggtgcacctttgattcaaggttctatcgaacctaaacacttgcttcaagttcgtgatgccttgtcagttgaaacttacttgctcggtgaagtacaaaaaacttaccgttcacaaggggttgaaattggtgacaaacacatcgaggtaatggttcgccaaatgcttcgtaaagttcgtgtcatggataatggttcaactgatatccttccaggtactttgatggatatttctgactttgaagctttgaatgaaactgcactcttgaatggtgaaatgcctgcaactggtcgtccagtcttgatgggtattactaaagcctctcttgaaacaaattcattcttgtcagctgcatcattccaagaaacaactcgtgtccttactgatgccgcaattcgtggtaaagaagatcacttgcttggtttgaaagaaaatgttattatcggtaagattattcctgctggtacaggtatgttccgttaccgtaacattgaacctttagctgatttaacaaatgctccggaagtagaagaagttgaaacagaaactgtggaaaactaattttaaatctagaaaataaataaaaattactgacagaatttctgtcagtgatttttttatttttgtcagtaaccttttttattaaatttactgacaaaatcattaaaaacataaaatctctgtcatttttggtaaaataattctatgacttattatctccttgcaaatcccaattctggtgcaggtaaaggtgctcggactttggagactttgattccatatttggaaaaaaataattatgaatatcgactttttaaaactaaagctgctggcgaagaaggcgctttggtcagacaaatattagaccttaaaaatccggatgaccacttagttattattggtggggatggtaccatttcacttgtcattaatgaacttccagaagaagaggccttttcttatattccttcaggttctggcaatgatttcgccagaagcttaaagttgaaacttgacccaattgaatcttttgaagctgctcgtagaggaattaatcatgagatttttatcatgaattatcaatctaaaggattgagtggctatgctctaaataatattggaattggtttagatgcaactatcgtgaaatctgccaatgaaggaaagcttaaacaagtgcttaacaaattgaaattgggaagtttttcatatattttgactgccttgcacgttttgataactaaaaaaccatttccagctttaattgaagtagaaaatcaagaaatttcactagaaaatgcctttctgatgacttttaccaaacatccatactttggaggtggagtaaaaatttctcctgaggccaccaatgaaaatgcagatattcaccttgttgaatataataaacatcacttattacggactttttcattaattccaagtgttcttcgcggaatgcatttaaaacatcccttatttttacaccgagtgagtcctcagttttctgtagaattagcagaaagtcaaccagtccaaattgatggagaaattcatgagttagttgctgctgacagactttcaatcagtactgaaagaagaatgattatttactgacagaataaaaaaactccaattatggagtttttatttattttcaattaattattatacaataattgttgtatttttatactttttatattataattatgctattgtttttttataaaaatagaaattataaaacagaaaagagaaaatatgaactttgattttttaccgaaatatctgccctattttaatgatgggatgattgtcacaattttgatttcagctttcgtggttttgattggaacactcttagggattgtcacagcccttgccaagatttctaaaattgctccattgcgctggttggcaaatatctatattgaaattttccgtggaacaccaatgctcgttcaaattatgcttggttttggcttaatgggaagtctatctttaccaacctttcaagttgggattttacaacaagatttggggcgcttgattccagggattattgtaatctcattgaattcgggggcttatatggcggaaattgttcgggctggaattgaagctgttcctcttggacaaaaagaagcagcctattcattaggaattcgcccaagacaagcgatggcaaccgttattttacctcaggctttgagaaacattctaccagccgtcggcaatgaatttgtgacaattatcaaggacagctcgcttctttatacaattggagtaatggaagttttcaatggtgcacaaacagtagcaaatttgacttatcaaaccattagcccgatgttatttgtagctctctactattttgtagtcacttttgttgtcagtcgcttacttgttttatttgaaaagaaactcgggaaaggatatgcaaaataatgaatgaatatttaatcgaaataaaaaatctgcataaatattttggaaaaaatgaagtcttaaaaggacttgatatccaaataaaaaaaggtgaagttgttgtgatgattggcccctctggctctgggaaatcaacttttttaagaacgatgaacttattagaaaagccaacagatggtcaagtctattttgaaggagttaatattgctgataaatcagtggatgtcttcaaacaccgagaaaaaatggggatggtttttcaacaatttaatctatttcctaatatgacagtccttgaaaatctatgtttggctccagttaaaacgggtaaaatgaccaaagaagaagctaaaaaaacggcggaagatttacttcaaagagttggactctcagataaagcagaggcttatccacaagcattgtcaggtgggcaacaacaaagggtagctattgctcgtgctttagctatgaacccagatgtgatgctttttgatgaaccaacgtcagcacttgaccctgaaatggttggtgaagttttagccgtgatgcaagaacttgccaaagaaggcatgacaatggtcgttgtaacccatgaaatgggatttgctaaaacagttgctgacagagttttgtttatggctgatggaacaattgttgagcaaggaaaaccggcacaagtttttgattctccaaaagaaaaaagaacacaagactttttagcaaaagtcctataatttaaaagcttatagttaaagagaatatcaaaaaaacggcatgtctgctgttttttttctggtctgtggtataatactaataagactggtaaagtgatagaagacaaattatagaaaagagaaaacaaaatgaaatatgaggatataaacgaaaatactataaaaatcaccttgtcttttgatgatttgacagattatgatatcaaattatcagactttttcggaaatcaagaagtcattgaacaatttttctatgaattggttgatgagcttggtttagaaaatcgctttggaaatgtgggaatgttaacttttcaaatccaaccttttcctcaaggtgttcatatgattgttcatgaagaagcgatgctaggtgaaggtggagaaattccagatgacccagaagagtttgaagaattgatgactggtttttataataaattaaatgaaataggggcagatatggcgcgcgagcgaggaattactgattttaaacctgggcttggtttaccaggaacaaaaaaagacgaagctgaacaagagccagattttatttattactctattcgttatgaagatattatgtctgtcttaacaggaataaaaaatgtgaagtttgctgatgaagaatcagagttttatcgttatgatggcaatttttatcttgttgttttggataatcaaaaagaaaaaggcaagatgcatgttgaaagtacccgttcacgaatgatggaatatggggaagcaacaaaaatgagtcgagaatttttgcaggagtatggtgaatgtcttattgcgacacgtgctttagatgttcttagaaaaatctaaatatggttgatacattaaaagaaatcccctttgcacttaagttcctaattgttattattatcacttttggtatctctgtgattttaacgccaattatgacttttgtgtccaaagcaattggtgcggtggacaagcctaacgagcgtcgtgtgaataaaaaaccaatgccctctgctggaggtttggtcattttcattgcttttgcgattgcgaccttgtttattctgccacatattgttcataatcagcctcccattcattcgcaacctccagtacatggcgcaagtcatcagccaattcagctagtcagctattttagctacatttggccctttattgttggtgctggaattgttgttttgactggtttgattgatgatataaaagaaatttcacctaaaatgaaacttttaggattgacagttgcggcgagttttatctggttctttaccaatgcccgctttgataatttaaaaattcctttcggggggcctttactaatctttcctgcttggttatcctttatttttaccgttttttggatacttgcgattactaatgcaataaatttaattgacggattggacggactagcaagtggagtatcaattatttcactgacaacaatgggaattgtttcttactttttcttacctaatccaaatgtatttttaccgattaccatttttataatggtggctgcaattatgggattctttccttataattatcatccagcgattatttatctgggagatacgggagctctgttccttggttttatcatctcggttgcttctttgcaaggattgaaaaatgcaacggctgtagccgttttgactcctttattaattttaggagtaccaattacggatacaattatggcaatgattcgtcgtaaacttaatcgtcaatcaattgcaacggctgataaacgacatcttcaccatcgcctaatggcacttggttttactcatcgtggagctgttctagtcatttatggaattgcatcgatatttgcatttatatccattcttttgcaattttcaagtcgtatcggtgggattctcttagtgattgcttgtctctttggattggaaatatttattgaacttgttggaattttaggcgaaaatcggcagccagtcttaaaagcactgaaatttgttggaaattctagttatcgtgataaagttctccattctgatgaagatgcagatacagatgaaaatgaagaagatattgaaaatcattcaatgataaatgaggaaattgatgaaccaacacaagaattcccaattcaaaattatcgtagaagtcgaaataaaaaataagaaaaacctctaattttagaggtttttttgatatctaaaaatgcctgtagtcatttattatttatattgcgattaataaaaataatgtatgcgaaaataacaaattttgtcaattttttgttagaatagagactataaatgtcaaatacaattgacaattcaaaggagcgaaaaaatggctacacttgaaattaaaaatcttcatgtggcgattgaagataaagagattctcaaaggagtcaatctagtcatcaacaccaatgaaatccatgcgattatgggacctaatgggactggtaaatcaacattatctgctgcaattatgggaaatcctaattatagcgtgacacaaggagaagttctttttgacggtcaaaacgttttagaaatgagcgttgatgaaagagctcgtcttggacttttccttgccatgcaatatccatctgaaattccaggaattacgaatgcagaatttttgcgagcagcaatgaatgctaaacgtgctgaggatgacaaagtttctgttatggaatttatcaaaaaattggataaaaatatggaagttttgagcatgaaagaagaaatggctgagcgctatctcaatgaaggcttttctggtggtgaaaagaaacgtaatgaaatccttcaacttttgatgttagaaccaacttttgccattcttgatgaaattgactcaggacttgatattgatgctttaaaagttgttgctaaaggtgttaattcaatgcgtggtgagaaatttggggcattgattattactcactatcaacgtttgcttgattatattacaccagatgttgtccacattatgatggatggtcgtgtggtgaaaacaggtggcgcagaactagctaaacgtctagaaactgaaggatatgtcaatatcgctgaggaacttggattagaatataaagaagaagtttaaggaaaggagatagtaagttatttttgcttactgacagagctgtcagtaagtctaaagttcattaatttactgacagaatgttttgtcagcaaattaatgaattcagttaagaaaatgcaaacttgctaatattaattatgaatcaagaaatcttaaacttttcacaaatgcatgctgaaccagcttggttatcagatttacgtcaaaaagctgcacttgaatttgaaaatctagaattacctaatattgaacgagtaaaaattaatcgttggggcttagaccatttaacaatttctgaaaacgaagaaattggatctgttcctacttttacggaaattccaaatcatcctttgcttgttcaagtcggaagtcaaacagttatggaacaaatgacaccaaatttggctgaacaaggcgtaattttcacagatttcaattcagctttaaccgaaattcctgaactacttgaggaaaattttggttctgtggttccatttaatgaaagtcgtttaacagcagcaaatactgcgacatttaattctggattagttctttatgttccagatggtgtggaagttcttgaacccattgaatcaattttgatgcaagagggttcatcagaagttccttttaataaacgaatattaattattgttgggaaaaatgccaaagttgactaccttgaacgtttggaaacaagtggagagcaaagctcaaaagcaaaagcaaatattgtcgttgaagtaattgcaaaagcaggagctcaagtcaaatttgcagccattgaccgtttaggagaaaatgttacagcttcagttgttcgtcgcggattgattggtgataatgcaacagttgactggtctgttggtgtcatgaatgacggaaatgttgttgctgactttgatagtgacctcaaagggaatggttctcattcacaaattaaagtggttgggatttcaacaggtcatcaaacgcaaggaattgatacaagagtgactaattttggtctaaattcggttggtcatatcttgcaaaatggtgtaattcttgataaaggaactttgacatttaatgccattggtcatattatcaaaggggcgaaaaatgcggatgcccaacaatcttctcatgttttaatgctttctgataaaggacgaggagatgcaaatccaattctcttgattgatgaaaatgaagtaactgcgggtcacgcagcttctgttggtcaggtagatgaggaagatttattctatcttcaatctcgtggacttgatgaagaaactgctaaacgacttgttattcgaggatttctcggttcagttgtcagtgaaattcctgtcaaatcagtccaagcagaatttattgaaactattgaaagaaagctgggcatgtaatgcttgaaggcatcaaaaaagattttccagtattgaatcaaattgttaatgatgaacctttggtctatttggacaatgcggcaacgactcaaaaacctttgaaggttttggctgcgataaaagattattatgaaaatgataatgctaatgtccaccgtggtgttcatactttggcagagcgagcaactgaaaaatacgaagcggcgcgtgaaaaagtccgtcattttatcaatgctaaatcaacaaaagaggttttgtttactagaggaacaacgacttcaatcaactgggttgctcaatttgctgggcaaatcttaaaagcaggtgatgaaattgtcatttcgattatggaacaccattctaatattgttccctggcaagaagttgctaagaaaactggagcaatcttaaagtttgtctatcttaaagatggtcagctagatatggctgatttacgtaaaaaaatcactaatcaaactaaatttgtatcgattgctcatgtttctaatgtattagggacaattaatccagtagaagaaattaccaaaattgctcatgaacacggtgcttacatggtggttgatggtgcacaatctacaccacatatggcgattgaccttcaaaaaatggatgtcgatttctttgctttctcaggtcataaaatgatgggaccaaccggaattggcgttctttacggcaaagaagaacttctaaatcaatttgaacctgtcgaatttgggggagaaatgattgattttgtttatgaaagtcattcaacatggacagaacttccttggaaatttgaagctggcacacctaatattgcgggtgctattgctttaggagctgcgattgattatattcaagagcttggaattgaccaaattcatcaacatgaaattgaattgattgattacctcatgcctaaacttcaagaaattgaaggcttaaccatttatggaccgaaagataatgtaaaaagaggcggtctaattacttttaatattgaaggacttcatccgcatgatgtcgcaactgcccttgatatggagggagtagctgtaagagctggtcaccattgtgctcaacctttattgaattatctcgaaactccggcaactgctagagcaagcttttatctttataatacaaaagctgattgtgataaattagttgaagcacttaaaaaaacaaaggagtttttcaaccttgattaatatgcttaattgggtcgcctccctcccactttggttggcaaccacatttctatttgttgttgttttctttagagctcaatgtactttttggttaggaaaattgagttatcatggaattttgaaaacgaagtggggcaaaaaacttgagaaaaattcagagacttccgctggaattttagccattcaaaaaatgggttggccaattattcctctgtcttttttaacagtcggttttcaaactgctgttcaatttggcgctggtctaacaaattggtcttggtataaatacacattggctgcgattccaggttacttagcttggggatttatctatgcctcaggaggactaagcctatttcgttcactcgttcagggttcgattggcttactcattctatttatcatcatcattttagctgtggtaattgcagcaaatctcgtccttcgttatattcgtaaaaatggaataaaaacggatgattagagaacaagaataatcaaaaagttactgacagaaattttataagtcattaaagaaggctgtcagtaacttttagaatttatttttatcaatattaaaataaagaaagtgtgaaaatgtggctttatctaaattagataatctatatcgtgcagtaattcttgaccactcatcaaatccacgtcatgctggagaattacagacaggatgtatggttgacctcaacaatccaacctgtggtgatgtgattcgcctgactgttgaatttgaaaatgatgtcatttcaaacattgcttttagcggtcatggctgcacaatctcaacagcttcagcttcaatgatgaccgttgctgttcttggaaaaacaaaagaagaagcaaaagagctggcaactattttttcagcaatggtgactggtggaactgacgaacgacaagaagaacttggggatgctcagtttcttgcaggggttagtaaatttccagctcgagtaaaatgttccactctggcttggaatgccctaaaaaaagccattgatgttggtgaagcacaagaaacagtaattcatggcgaatagctaaaagttactgacagattttttatcagtaaataaaaactcgtcagtaaaactgaggagcctgtcagtagcgactgaaaagagttttttgccaatgaatgaaggacttgtcagcaaagctggaaagtctgtcagtaaaaagcgattgaattgagctttttatcaatggataaaggatttgtcagcaaagctgacaagtctgtcagtaataaatatgccaaagaggaagaaaaatgacagaaaatagtacacaagaagtcgtcaaagacctcgaagaatataaatttggatttcacgataatgcagaacttgaattcacaacaggtttaggtttgaccgaagaagtcattcgcgaaatttctgaaacaaaaaatgaacctgagtggatgttagagtttcgtctgaaatcttttgaagcttttaaaaaattggacatgccaaaatggggcccagatctttctggtattgattttaatgatattgtttattatcaaaaaccatcagcaaaagctgcgcgttcttgggaagacgttcctcaagaaatcaaagacacttttgaaaaaattggtattccagaagctgaacgttcatatttggcaggagcttctgctcaatatgaatcagaagttgtttaccataatatgaaagatgaatttgaaaaattaggaattattttcactgacactgattcaggattacgtgactatccagaaattttcaaaaaatatttcagtaaactggtgccaccaacggataacaaattggcggccttaaattctgccgtttggtctggtgggtcatttgtctatgttcctaaaggagtcaaatgtgagattccgattcaagcctatttccgtattaacaacgaaaaatcaggacagtttgagcggacattgattattgttgaagaaggggcgtctattcagtacgttgaaggatgtactgcaccaacttactctgcaagttcacttcatgcagcagtggttgaaatctttgttgaagagggtggttatatgcgctactctactattcaaaactggtcagataacgtctataatctggttaccaaacgtgctgctgcagaaaaaaatgcgacggttgaatggattgacggaaacttaggttcaaaagtatccatgaaatacccagccgttcatttgaatggaccaggagcgcggggaacaatgctttcaatcgcttttgctggagcaaaccaaaatcaagacacaggtgctaaaatgattcataacgcaccaaatacttcaagttcaatcatttctaagtctattgccaaaaatggtggagcagtcaattaccgtggacaagttacttttggaaaaaattctaaaaaatccgcttctcatattgaatgtgacacaattttgatggatgatttatcaaaatcagataccgtaccattcaatgagattcataattcacaagttgccttggaacacgaggcgaaagtgtcaaaaatttcagaagaacaactctattatttgatgagtcgtggacttacagaaaaagaagcaactgacatgattgtcatgggctttattgaaccctttaccaaagaattgccaatggaatacgctgttgaattaaatcgtttgatttcttattcaatggagggttctattgggtaaaataaaaaatctgctcccttgattttggggagtatttttttatgatttatatcttacttagtttgtgatattagagaaaataggtacaatgaaaactctgatagaatcactttaaataataaagaggattaatctaaattttattttttcataattcgttgaataatagtttcaacaggctcaattttttcaagataagcagaagagctaccagccataaatgcaccattgattaaatcacctttttctactgcggctttcaatgatttatttaaaggatattctgatgagatatttaatagtctggtcagatggccattcttatctgagattaaacttgttccattttcttcacttttgcagattaattcttggtaaattggtgaaatttgacattcttttgccaataaaaaggcggtgccaacttgtactccatttgcacctaaaatattagccaaagaagcagtatggtgatcataaattccaccagcagcgatgagcggtaagggacagattggagcaatttctttgagaagtgaggccaagttttggctacccacgtgacctcctgcttcatttccttctacgatgattccggagataggaagatttaacatttttagagcaatttctttattgggaaccacagggaaaagtttgatattattagcaattatagtatcaataatttctttaggactccctgcaccagttgtcactactgatattttttcttcacaaatcacttctaaaagttgcttgatatttttatcgagtaacattaaattaacaccaaaaggctgagaagtgagactttttgtttttcttatcattcttctcagctcatttgctgtccgtccgccactaccaataattcccaaagctccattgtttgaaacagcagctactaattcagcattagaagccaagccattccaccttgaaaaagaggatattttattcctaattcgcgataccaagtcatttcattctctttctatattttattaaagtttatgaaatgtaggttcctgccaatagccaatctcagagccattaacggaaaaaattttgcctgtcatttcgctttcaattaaatcattaataataaaattagcgacatcagagcttgaacccattttccattcatcagggatattctgaccataagtttcttttaaactttttaatactggtagagtcatatcagttacggcggcaggggaaacagaatttactcgtatcatactttttttcaattctttagctagtgttttcgtaaaagcaatgatgccggctttggacgccgcgtagtttgcttgcccaaagttaccaaataaagctgattttgaagttagtgtaatgatttgtccgccttgattgattttatcaagcaaagcgtgagtactattaaatacaccagtcaaattgacagaaatgacttcatcccaaatttctgggctcattttcttaaaagtactatcagcagtaattccagcattattaattagaatatcaatatcctttattaatttggctgcattagcaacgctagagcgattagaaacatctagtggaaaagcttggatttctgttttgggaaattttttttcaattcttcagctctactttttaaactaagtgggtcacggccagttaaaatgactttgtgattggcttgagcagctttctgagcaattgcccagccgattccccttgttgcaccagtaatcaaaattgttcgtttgttcattgcttccattctccttttaggattaatgtttgatttctgtcagtaatttgaaaagcgttttgattaaatataaaacaaaagcgttcattcaaataagctggtgagcagaaatttgcttttaagtatgataaaggcacagaatagaactcttgatacatctcttctaaaataaataataaaaaatttccaggtataatgggatttttaccgtagtgtaaagaattggtatctttaactgattgaagataatcaattaaatcagcctcattgatttttttgtataatttcattccaggaatcctcagataatagacttaggttaatttgtgccaataactttgtattgctagttatttcaagacttagattgattatatatttttttgaatgacgagtgatgtgttcacttagtaaataaagtttcagtttatcaaatgaataattagaagatggataacgaataatttcttcggatagtaaccaattttctccatttttaagactgtggggaattccttctaattcttgccacaattgtggaagtaaggagagaaaatttttttggccctctaatttaaaatgtcttggaagacttttttgagcgattaaaatcatttttgataccagtgattacctatcagtatactgattcccatacctccagctacgcacaaagttgcgatgccaagacatggtttttgcacttggtttaggcgatttaagagtcgagaaattagaatgccaccagttgcaccgtaaggatgaccaaatgcaagggcaccaccataagcatttaattttatatcatcaagcttaaaataattttggaataaaatggcctgactggcaaaggcttcatttaattcgatagcctcaatatcattaagtttaaggttaaatttctgtaaaagtttttcagttgcttttattgggcctaataagaaatctgatggagataaagcaatagttgtttgtcctaaataatagccttgaaaatcaaaaggattattagtggatgacaatatgattgaagaagcaccatcgtttattgggcaagagtttccagcagtggctgttccgttagtggtaaaagcaggggttaatttgctcaaagcttccattgaggatttaggacgaacagtttgatcgctacttattgtaaatccttcatcttgatagggaaaaacttcattttctaaaagttttccttcaatagcttgagtcgcttttttatgactatttagagcgtaaaggtcttgaacactacgaggaatattgtattttagggctgtcatatcggcaattgttcccatgtcgaaatcttcatagggttcaggagccattttaaatcgtttaatcggctgataactctctgaatcaagcataatattggcttgagatgtgctttctacccctcctgtacaaataatggaagcttcaccagaaataatgtagtttgcagagctaatcatagctgtcagtccagaaccgcactgctggtcaattgtaaaagctgggacctggctagaaaatcctgcttttaaggcacaacgtcgagctaaatttcctccttgattagtcacatttcccaaaataatatagtcaatatcagcttttttgagaagtggatttttattaaactgttgtttaattagactttgatataaagtttcaggagaaatttttttataaaaaccattgatttttcctataggtaaacggtttgctgctatgataccgacgggatttttaaagctcatgatagacacctctaaaatattctttttctaattcttttctggatattttttgatttttagtaaaattaagagtaggagtttctaaatatatctgaggaagtttgtatttaggaagtctttgagctagtattttgattaatttctctttctcgatagggtttaagagtagtagagcaattttttgactatatctttcatcaaaaactccaaaagcgatgcagtcttcacataaatcttttgccatacgctcaatttcttctggaaaaattttatttgcaccatgttcgataatgtcagaccgacgtccaaataaataaagatgattattttttaaggttcctaaatcatcagttgtccatgattgtggataaggttgattaagatagccagaaaataaataaggacttttaactgtaagacgatattttggtcctaaagtgagctctacgtgtggaaagagttttcctacagatgatgtttttttaccatcattaactacttgccatgaaataaaacttgtttcagagcttccataaaactcaatcatttgagtttgcggaagtttttttcttactttattaatcgcctctgggctcagtgttcctccacctaaaaaaataatctctggagaagttaaagcaaataattcattgaggttatttaagaggtaggttgggacggtaaagagaacatagctttccttaatatttataaattgtgaaggatttgtaattgctaggaaggtttttcctaaatataaagcacacatgagtgtgtgaagtcctaatgaagtagtgagtgggctagtagttgcaagagcttgtgatttgctcaaatgaaataaatcatcacaaacttcaaaacccattttccaagattcccagttacgataatagattttgggctgtccagttgtcccagatgtgcttgctaagaacaaagtatcctcagggataagtccgaattcaaaagactttttcttaaaagatttatccacgacaagtgggtaatttccactttcgataattgcgagaaaatcaataataaaattcaagggactatcatttattagagtaataacagttttagaggagtggctataatctgttaattttctttgtattaaatcattgatttgttggtagctataggaagtttcgtctattttaagagctggataatcagtaaaaagtgcggtcagttttgaaaaattaaatttatttttttccatctaaaattttcctttgtgtgaataaaaagcaaacaataaaattaatagttaacctaaatttgattttagggttactatttgatatgatatcagtataataaaaaattcttttattgtaaaatataaaatcaggagtagcaaatatgactaagaatcaaaaagtcaaaacattaacgtattcagcctttatgactgcatttattattattctaggatttttaccaggaataccaattggttttattcctgtcccaattatcttgcaaaatatgggaataatgatggctgggggacttcttggccccaaatatggtacaatttcggtaggagcatttcttattttagctttaattggcttacctgttttaacgggtggaaatggcggagcagcgagctttttagggccttcgggaggctaccgaatggcttggctttttacaccatttttaataggttttttccttaagaaattgcaaattacagcttcaaagaattggattggagaattaatcattgttttagtgtttggagttatttttgttgatctagtcggagcaatctggctatctattcaatctaatattccattaattacttcgttgatttctaatttagtttttattcctggtgattgtatcaaagccattttgactgttcttatcgtgcgacgtcttagaaaagaaggaggctttgaaatgtattttagaaagtgataattatgcgaacaacaaaacaatttgtcttgttaaaacttcttcaacaaaaaggaaactgggtttcgggtgatgaattaggtgaggagctaaaacttagtcgagaaagtatctggaaagcaattaatactttaaagcgcaagggcaatcaaatcgaaagtcgtaaaaatttgggctataagtatgttggaaatgattcattagatgaagatacgataaatttttatagtggaatgaaatttgaagataaaatttttgtttttgatgaggtgacttctacgcaagagttagcgaagcaatatttgtcttcacatgaggtcaaacaacctcttatttttgttgcaaataatcaaacggagggacacggtcggcgtggccgaaatttctattctccaagtgatactggattatattttagtcttattttacccaaccccagtcatgatattttgaaaataggattattgacgacaagtacggcagtggccgttgtcaaggtccttgaacaattttataaagataaaaactttcaactcaaatgggttaatgatatttatttgggaacctataaagttggcggaattatcactgaagctgctttagatttagaatcaagctctgctggaaatttcattatgggaattggcttaaatctgtcaacaaaagattttccagcagatttatccgaaaaggctcagggaataaatcctgagtttaagatagacagaaatcagcttttagcagaaatggctaaagaagtgataaataatttcgcaaattatagacagccagatttaattgatgagtatcgcaagaggtcattgttgtttggtaaaaatgtgactttaaaattgggaacaaaagctgttaatggacaagtagaaggaatttctgatgacggaagcttgattttaaaagcaaaatcaggagaattacaaacttttaaaagtggcgaagttgtgaaagttgattggtaatgaaaggtgaattttattgcgagaaaaaatctgggggaaagtgatagatgaagaaggcaggtgtactcattatcaccaagaaaatgatattgtcgccctaaaatgttcagattgtgaaaagtatttttcttgttatcattgtcacgatgaattagagaatcatttatttagggctactgataaagaagactttccagtactttgtggccattgtggaacaaaattaaattttaatgattattcgcgaggagagtgtatcaagtgcagctccgcttttaatccaaattgccatcgacattggcaagtttattttaaagaataggcatatgcttttaatattatgaaggaagaaatgaaatgttatttactgaattagcaagagaaaaatcatcaatattttgggaaagaagttttgagcatccttttattcaaggattagtgagtggagaattagctcctgaggtttttcgctattatttgttgcaagaccgctattatctcgaacattttagtaagttatattttcttattgccgagaaatctgatagtgaagagattcaagcacatttaagattaaatgccgaagaactaaaaaatggagagatttttgttcgcgagggattttttaaagaattagagattggtgaacgagaaattttagaaacgccggttgctcccactgcttatcattatgtttctcatatgtatcgtcagcttattgatggcactgttaatagtgcaattgcgggaatgttgccttgtgcttggctttatcatgaaattggtttacgattaattgaagtggggtcgcccaatcctttgtatcaaaaatggattgaaacctatgcgagtgaagaagctaccgtccaaatcgcaaaagagtgtgatattattaatcggctttatcaagaaagtgatgaacaagagcaagaacagatgattgaggcttttctgattagtagtaaaatggaggctgatttttgggaaatggctttggtcttagaaaaatggtagttgaaatttttctgtaaaagtaaaaaagtcttatatgacttctaatataaaaaaagattaaatctatttcagttaattcttgcaaacggatacacaaaatgataaaatatatttatccttataggaaagcgtttacctaaaagtcatggttacgtaaataagctatagcgagtagcttaatttctttcaaatccctcctagtcagggggatttttttgatgaaattttatatggaatctatagataataaatgtattttctacttgaaaaagtccctttgaaattaatttacttttatatgagaaaaagcttgtcactgtcatctttagatgttataatttattgtggtgcaaaattctatatgctagttaggagaagtagtggaacattcagctactcagcgcgaatcccaaaaagtatggacggctattaaaaattggtttctagtggacaaagtttttctgatttcgtttattattgcaattattgccattagtttgggtggagtgacaacgcgtttctttaattatcacgtcatcgttacggtttcaggtttgatgcttgtaattggtggttttaaagaaacaggtttgttacagtatttgggacaatccttagtcaaaagaagtacaacaacgcgtcagctcgttcgatttacgacgctacttaccttctttttagccgttttttttacaaatgatttaacaattttgacggttttaccgctctatttagcgattactaaagaaattaaaaaccgaaagtcagtttatattggagcagcattgattgttccggcctgtcacattggttctgccttacttccgcaaggtaatccgcataatctttatttgtattctttttataaagtagcagcacatcatggtggtgtcgctttaactaatttggacttttttaaaggaacaggcgctttatggattttgggtttattgattttgatgattgcttgtcaattcattgataatgagcctttggtgattgaaactaaagtgacgcaatttaataaagttgaaacttctatttttgttgttttgatgttgttgatggcagcttctgtttttggctatgtgaatttttatcttgctggagcaattgttgctttagttgtgttaatttatcgtccgagactttttaaaggaattgattatcatcttttatttacatttatctttttctttttgattgtaggaaatattgctaatatcagtgtgttgactgattttatcagtaatactttagttggaccgcaggcttcttttttaggaactgtgattatgagtcaatttatctctaatatcgcggccccaattttgatttctccgttcactcctcatgctgcttctttggtgcttggagctgatattgggggaattggtacaattgtttcgtcaatggcaacgctgattgcttacaaagttattagaatgaatgcgcgtggtgaaacgcgaggatttgtaaaatattttacaattgtaaatgcaggatttgttgtgattctaactttgattggtttagttattgtgacaattgttggttaagatgtaaaagttggagcatccagcttttttattatggaaaatttttactgacagggctgtcagtaattttttatttatctctgataaaaaaatgttaaataaaaatgtgtagaaatttctgtcagtaattaataaatggtgtataatagttaaaaatgtaaaggagaaggaaatggagtttagattagcgaaaaagtctgatgctaaaagacttttagaaatttataaaccttatgttgaaaaaactgccattacttttgagtatgaagtcccaacgattgcagaatttgaaaagcgaattgaaaaaataggaagtcgctatccttatattgtggcgattgaaaatgacaaaatcattggttatgcttatgctggcgcttatcgagaacgggcagcttatgattgggtggttgaattatcaatttatttagatgaaaatgaacggcaacatggcgctggtagtgccctttatcaaaagttactgacagctttatcggcatttaattatcagcgtgcttatgcttgtattacctatccaaatccggcaagtgttgcatttcataaaaaatttggttttgaacaaattggactttttccaaaagcgggttataagtttgaacaatggtatggtattgtttggttagaacgctctctccaaactactgataaagtttctgcgataaaattactgacagatttgtcagagaatgaactagaaaaaatcttggctaattagtcaagattttttattattttattgaaaaagtaaaacattttgtgtttggtaagaaaaatattaaaataaaattaaataaattaaaagtagaaaggaagaaaaaatgaacaaatttatctggtccatttttatccccgtcctgatttttgcaggactattgacagttattggttttacccttgagagtcggcatttttactggcttcaatccgtcgagctcatttatctttttggaagtttaatctttacttttgctgctttttggatttggcatctggggataaaatctcgaaaaatgaaaactctaaaagttttatggctcattctgagtttagtttttctaattgacctaatcaacacaggagtttatttagctcagggtcaaggatggctgtggggtatgagtagttttagttctgctggacctgctttttttgcaagcatgctccttttgagcctaagttttttaggatttagaggtcaaatgaagaaagaaaattaaaatgacaaaattaagacattttttgtcatacctaagagggaaaaggaggttaaaagtgaaaataaaatgatataattagaaaaaaaggaagagtaaggaaaattatgacattaaagattgacaaagttcgaaaaagctttggtgataaaatcgctgttgataatctcaatatggttgttaaaccaggtgaagttatgggcttaattggtcaaaatggtgctgggaaaacaacgacttttcggatgattcttaattttatatcagctgaccaaggaaaaattacttggcaagatggaccgattacgcaagaaatcaagcaaaaaattggtttcttacctgaagaacgtggtctttatcaaaagatgacagttgaagaccaaattctttattttgcggaactccatggaatgaaacgagcagatgcccggataaagctacaagactggatgaaacgtttagaggtcgttggtaaaccaactgacaaagttcaaaccctctctaaagggaatgcccaaaaaattcaattcattgccactttgattcatgagcctgaatttttaattttggatgagccatttacagggcttgacccagtgaatacagaactcttgcgaaatgagattaaacggagtcgtgataagggagcggcggttattttctccaaccataatatgagtgatgttgagcttttatctgaccatttgttaatgctaaaaggcggtcaaacaattttaaatggaacggttgaagccattcgagattcttatgggcgtacccgtatttatttggagtctgatctgcccaatgaagagctctctgtaattacaggagttgaatcaattgaaaaaagaggaagtggtcgttcaataaaaatatctgaggcagaagttggacgtgaaattttccaaaaagtggctaaagatggctatgttcaagcatttgttcagtctccaccgtcactagatgaaattttccgaatggaagcagctgagaacaatcaagaaaatttaagtgcaagaagtgaggaaataaaatgaaaaatcaaacttggcttgttgcaaaaaatatttaccgaagtcgtgtcaaaggagtgggcttttgggcacttgtcctttcaccatttttgctaggagcgatttatttaattatcggtttagtcatcagtagcggggctaatcaaagtccaaaaatggctgtagtcgataatcctgctctaactcagattctttctaaaaatgacactttaaaagcagatattcgtaacgggttttctttagatgacgctaaaaaagacctttcttccggaaaaattgatggatttttaaccgaagataatggagcttataccattgtcactgataataaatcgagtgtcaaatttgaccaatcaagttttcaaactgcgctgactcaagtgaatatttcaaaaatagcacaacgtctcaatctgtcagccgccgatgttaaagaacttcttagtccagctaagtttacaatgaaaacacaaacaagttctggacaaaagtcaacaggtgatggacagactggcgcgaatatcgcaattggctccattgcctcgattttaattttcacattgatgatgatgtatgtgggaattatcggacaggaaattggtaacgaaaaatctagtcgaattatggagacgttactcgcggccactagctcaaacgtacagtattatgggaaaattattggtgtaattctactattagcgactcagcttggaatttatgtgcttggttttgggattgcttatccttttatcaaaaatttagatcagattaaagcaattggtgccatgctttcagggattactttcggtttcggaatttatttggtagccatgtctttaattgggattttaggttatttaattctcgcgtcaattgtggcatctctggttaatgaacaagctcaggtgcaacaagctactcagccaattgcctttttagcgatgattggttatattgggggaattgctggctcgactgttccggggaatattgttttgaaagttcttagttttattccatttatcagtccaacattgatgactagccgactggctattcaatattcaacaacgacagaagcctggattgctcttggattacaacttttagcaacacttgccatagcaaaagcgggtgagaaaatttatgcgcgaaatgttctttcttacagcgacgaaaaaattatgagtcaactttttaaaggactgacaggtcgaaattcaaagaaaaaaacaactgacagactggtcagtgaaaatggtgaaaagaaaaatccatggcggagaaattctccattgcgtctggctcttgtcatcattatcattctaataattttggcttatcgattcatctttaaataaaaaatattttataattcaactcttggaaactttccaagagttttttcgtatataaaagtatggataagattttagaaaaagtaaaagaatattggaaaatgattgttttagttgtttgtgggctcattgctggtgggattttttacgttttaaccaacggtcaaaagccaactacaaatctgtcagtagaaaatttaagttctgtcagcaggcaaagctctgtcagtaaatttagtgaacctaatgaaaaatctgtcagtaaaattatggttgatttaaaaggtgcggtggcaaaacctaatgtctatcaaatttcgtcagatgaacgtctagttgatctaattaaagaagctggtggttttactgaccaagctgaccagaaatcaattaatctgtcagcaaaattaaaagatgaagaagtaatttatgtcccaaaaattggtgaaaattcaagcacagaaaatactgacagctctgctaattcggtcactagtcaagtctcaacaaccactgaaaaaataaatatcaatcaagcagatttgactgaactacaaaaattaacaggtgttggtcagaaaaaagctcaagacatcatcgattttcggacgaaaaatggtgatttcaaatcgcttgaagacttgggaaaagtttctggttttggagataaaacactagaaaaattgaaagatgagttgtgttttgaataaaattcctttgatatttttagcttatctttctgtcatcttgttttttttaatcttcaattttaatttactttgtctcattttgttcattttttcaagtttacttgccttatatagaaaatattatttagtcatcccacttttattagctatgggaagttttttcttagtagtaaaaatggatacgattaagaatagtgaaaatcagccaaccactctttccaaaattacaatgatccccgacactatccaagttaatggtgatttattaagctttcaaggaaaagaaagaggccaaaattatcaagtttacgagactctaaaaagtaaaaaagaacaaaaattttatcaaaatctaagtcaaaattgtcagctgagtttcacaggaaaccttcaaattccagaaaaacaaagaaattttaatggattcgataatcaaaagtatttagcgagccagaatatttatcagcaaattacgattgataaaattaataaaatagttttaaacgacacttttgacctccatgttttaagacgaaaagcaattgtctggtcacaaactcattttccaaagccaatgaatgattatatgactggcttactttttgggtttttaagtaaagattttaatcaaatgggagacatttacagttcattaggaattattcatctttttgccttatcgggaatgcaagttaattttttcattgattggtttcgtagaattattcttcgactaggaataacgagagaaaaattaaatatttggcaaattcccttttcaattttttatgcatttatgacaggattttcggtttcagtattacgagcattatttcaaaaaaatattcgtctaaatcctttagataacctagcagtgacaacctttcttatgatgattgtcagtcctaaatttttactgacaacaggaggacaactaactttattttatgcttttgttatttcaaagattagtcataaattttcagaactaaaaggaataagaaaattactgacagaatcatcagtgatttctttgagtgttttacctttactcattttggattttcatatctttcaacctttttcaattttactgacgattggctttggctttttatttgatgtaatcttattgcctttactattaggaacttttctcttgtctctaattggctataattttaatataaatcatatttttcaaattctagaatggctaattcatgaggttgatttacccttacattatcctttggttttaggaaatcctaggccaattgaattattaatcttgtttttcctaatcggattattaattgataatctctttaagaaaagaagacaaataatttttgctggcctaattgtttgtagtttttttatttgtaaaaatccaatttaccccagtatcacagcagttgatattggccaaggagatagtatttttttgcaagataaatttaataaagaaacaattttgattgatacaggcggacgattagcccttccgcaagaaaggtggcaaaaacctcaaagtcaaacaaatgctgaaaaaacactcattccatatcttgaatctgttggagtgagtcaaatcgaccagctcattttgacgcatacggacgctgaccatgttggagattttttgaatttagatgataaaataaaaataaaagaaatttgggttagccccggtgaattgacaaataatcattttgtagaaaaattgaagaaagcaaatgttactattcacatcagcaaagttggagataaaattccaatatttgatagtgcattacaagttttatcaaatggttatacaggaaaaggggataataatgattctatcgtgacttatggaaatttttatcatacaaaatttctatttacaggggatttagaacaagaaggagaaaaagaactgctcaagaattatcctaaattgaaagttgatgtcttaaaagtaggtcatcatggcagtaaaacaagttcaaaccctgactttattaaagaaattaatcccaaacttgccctcatttcggttggcaaggaaaatcgatatgggcatcccaatcaagaaacgctagaaacattaaaaaaataccaaatcaaaatacttagaaccgatcaaaggggagcgcttaaattaatgcaaatcaatcaacagtggcgaatccaaacagttagataaatgaaaggaaaaagtgagcaaaagacatctataaaatgttacaataaagaagacgttgaaggcctgtagaaacgtaaaaatactaccattatttgatttctaatgtaccccaaaaataaaatggagtaatgacttcacagcgcacactttgaaaaaagtgaaagaaggtcagaataaaagagaaaggaaatttcaaaaattaagggattgaagaaaatccacttttaataggtagaaagttgtcaacaaatgataacaacataaatttattaaggagatattttatggcaataattaatatcgaatactactcagaagttcttgggatgaatcgaaaagttaatgttatttatcctgaatcaagtaaagtggaagattttacccaaacagatattccggtgctttatcttttgcatggaatgagcggaaacgagaattcttggataattcgttcaggaattgaacgattgattcggcatactaatttggctattgtcatgccctcaacggatcttggtttttatgtgaacaccacgtatggtatgaattattttgatgcgattgctcatgaacttccaaaagtaattaacaattttttcccaaatctatccacaaaaagagaaaaaaattttatcgctggtttatcaatgggaggatatggagcttatcgtctcgcattaggaactgaccattttagttatgcggctagtttgtctggcgttttaacttttgatggaatggaagaaaatttcaaagaaaatccagcttattggggaggaatttttggaaattgggaaacttttaaagggtcagataatgaaattttatctttggcagatagaaaacaagaaaacaaacccaaactttacgcttggtgtggtaaacaagattttctttttcagggaaatgaatacgcgacagccgagttgaaaaagttaggtttcgatattacttatgaaacctcagacggcgttcatgaatggtattattggactaaaaaaattgaatctgtattaaaatggctcccaataaattataaacaagaagaacgcttgagctaatctaaaaaattttctctgtttattcagtacaaaatttaaaaattttgtctatcaaacgcttacaaagacaaaaatgagagaaatgatgaaattctcatgcttctctttgacaaaaactacgaatagtagtagaatttcttagtaaaataaatttgcgaaatcgcaatatagaaagaggtctataatgacaattacacttgccgctcttggagcaattgctatcggtcttgcagcactcggagccgctatcggtgatggacttatcgtttcaaacttcctccaagccgttgcacgccaaccagaacttgaaggaaaacttcgtggttcaatgttcatgggtatcgccttcgtcgaaggtacattcttcatcgcccttgctatggcattccttttccgttaaaatttttctcaacaaaattttaaaaacagaaaggaagaacaggtatggaatcaacatggacctttaatattgggccaattccatttgatggaacaatcacagtaatgacttttgtgactgtcctcattgtgttcggtctggtattctgggcgagccgcaatatgcagctcaaacccaaaggtaaacaaaatgttcttgagtgggttgttgattttgtcaatggagtttccaaagataacgtcggccctcatgaagcaccacgctttgcgctcatgaactttaccctcttttctttccttcttattgccaactgcattgggctagtaactaaaattagtacgccaggtgatgtttccctttggaaatcaccaactgcaaatccaacagtcgatttgacacttgcactacttgttgttgtaatgtcaaatacactgggtgtacaaaaattcggttttaaaggttacctcaaagttgccttctggaaagatccgaaaggtcttcttccaatgaatattctggaagaatttacaaatgcactttcacttggtttacggctttatgggaatatcttcgcgggtgaaatcatgcttggtcttatcgccggtatgattcaatcaaccatgtggatgcttccagttgcgtggattcttgaagttgcatggattggcttttcacttttcatttcagccctccaagcttatgtctttgtccttttgacaaacttgtacattagccacaaaattatagcagaacattaagaaaggagtagaaattgtcaacattattattagaagctgctccgaataccgttctcggtaacatcatcgttgtatctggtgcatttattatcttattggtattgttgcgcctctttgcatggaatgcaattactagtgtttttgcaagtcgtgcgaaaaaaatatctgatgatatcgatgcagcagaagcgaacaacaaacaagctgctgacttggttaaacaacgtcaagcagaacttgcaggttcaaaagaagaagctgctaaaatcattcaagttgcaaacgatactgcctcacaaaaccgtgcgaaagtacttgcaacagcaaatgaagaagcaactagtttgaaaaaacgtgcgcaagaagatatcgagcaagaacgcaaagaagctcttaacacaattaaaggcgatgttgtggacatctcagttcaaattgctgaaaagcttattggacaatcattagatgcttctgcacaacaggaattaatcgactcttatctcgctaagttaggagaataagatgacaaaagtaaattcacaaaaatacagtaaagctttactagaagttgcccaagaaaaaggacaacttgaagcaattcttgctgaagttagcgaaatgattcaacttttcaaagaagataacttggctgcttttttaagtagcgaagtttattcattctctgcaaaatctgaattgattgatactttacttcaaacttcttcagaagtaatgtcaaatttccttaataccgttcgttcaaatggtcgtttaggagatttgggtgaaatacttgatgaaactaaaaatgcagcagatgatatgtttaagattgctgacgttgaggtggtttcaagcattgctttgacaaatgctcagattgaaaaatttacagctatggcgaaagcaaaatttgacctaaatgaagtaacagtaattaacacagtcaatgaaaaaattatcggtggattcattgtgaattctcgtggaaaaattattgacgcctcactaaaaacacaattggctaaaatcgccgctgaaatcctctaatcaggataggaaaattttctttctctgctcaaaactcagtggaaaatttttcaaactcatactgttaaacttttgagaacatgtaaaggtgatttcaaatcttacctatcatgcttaaacggtataactgcagtttaaagctaaatagccttgaactagtaaaaatttctagaagggagcatatttttggcaattaaagctaatgaaatcagctcactgattaaaaaacaaattgaaaatttcacaccagattttgaagttgctgaaactggtgtcgttacctatgttggtgacggtatcgcccgtgcctatggccttgaaaatgcgatgagcggtgagcttgttgagttttcaaatggtgtccttggtatggcgcaaaacttggatgcgacagacgttggtattatcgtacttggtgatttcctctcaattcgtgaaggtgacactgtaaaacgtacaggtaaaatcatggaaatccaagttggtgaagaactcatcggacgtgttgtaaatccacttggacaacctgttgatggacttggagaacttaatactggtaaaactcgtcctgttgaagcaaaagctcctggtgttatgcaacgtaaatcagtctctgaaccattgcaaactggtcttaaagcgattgatgccctcgttccaattgggcgcggacaacgtgaattgattatcggagaccgtcaaacaggtaaaacatcagtcgctattgatgcaatcttgaaccaaaagggtcaagatatgatctgtatctatgttgcgattggacaaaaagaatcaactgttcgtacacaagttgaaacgctccgcaaactcggtgcgatggattatacaatcgtcgtaactgcgtcagcttctcaaccttcaccacttctttacatcgctccttatgctggagctgcaatgggtgaagaattcatgtacaacggtaaacacgtcttagttgtttatgatgatttatcaaaacaagcggttgcttatcgtgaactttcactcttgctccgccgtccaccaggtcgtgaagcatacccaggtgacgtattctacttacattcacgtcttttggaacgtgctgccaaattatctgacgatcttggtggtggttcaatgactgcattgccattcattgaaacacaagccggagatatctcagcttatattgcaacaaacgttatctctattactgacggtcaaattttccttgaaaatgacttattctattcaggtgtacgtcctgccatcgatgctggttcttcagtttctcgggttggtggtgctgcacaaatcaaagccatgaagaaagttgctggtactttgcgtcttgaccttgcgtcattccgtgaacttgaagcctttactcaatttggttccgatcttgatgaagcgactcaagcaaaattgaatcgtggtcgtcgtaccgttgaagttttgaaacaaccattgcacaaaccattggctgttgaaaaacaagttttaattctttatgcattgactcatggtcatcttgatgatgttccagttgatgatgttcttgattttgaaacaaaaatgttcgatttcttcgatgcaaattatgcagaactcttgaacgtgattactgaaactaaagatttgccagaagaagcaaaactcgacgaagcaattaaagcattcaaaaatacaacgaattattaataaggaggctaactaatgggagcttcacttaatgaaataaaaactaagattgcctcaacgaagaaaacaagtcaaataactggagccatgcaaatggtttccgctgcgaaacttcaaaaagctgaatctcatgccaaagcatttcaaatttatgctgagaaagttcgtaaaattacaactgatttagtttcctcagacaaagagccagcaaagaatccaatgatgataaaaagagaagtcaaaaaaactggctatcttgtaattacttcggatcgtggacttgtcggtggctataattcaaatattttgaaatctgtcatgaatactatccgtaaacgtcatgctaacgaaagtgaatacactattcttgcacttggcggtactggagcagatttcttcaaagcacgcaatgttaaagtttcttatgcccttcgtggtctttcagaccaaccaacttttgaagaagttagagcgattgttacagaagcggtaactgaatatcaagcagaacaattcgatgaactctatgtttgctataatcaccatgtgaactcattggtaagtgatgcacgtatggaaaaaatgctgcctatttcttttgaagaatcaggtcaacaaaaaccatctcttgaaacatttgaattagaaccagatcgtgaaacaatcttaaaccaattgttgccacaatacgctgaaagtatgatttatggttcaatcgttgatgctaagacagcagaacatgctgcaggtatgacagcaatgcgtactgcaactgataatgctcactctgttatcaatgatttgactattcaatacaaccgtgctcgtcaagcatcgattacgcaagaaattacggaaatcgttgcaggagcctcagcgctttaatttactgatagaaattgtgtcagtgatggctttgaatcttaattgtttttgtcagtaaaatttttactgacaaacataaaaatgaatagaaattctgttctttgacagaaaataaaaacaggaggaaaaacattgagttctggtaaaattactcaggttatcggtcccgtcgttgacgtggaatttggttctgatgccaaattgcctgagattaacaatgccttgattgtctacaaagatgtcaatggcctaaaaacaaaaattactcttgaagttgctttggaacttggtgatggtgcagttcgtacaatcgctatggaatctactgatggcttgactcgtggacttgaagtccttgatacaggtaaagcagtcagcgttcctgttggggaagctactcttggtcgtgtttttaacgtccttggtgatgttattgacggtggggaagaatttgctgctgatgcagaacgtaatcctatccataaaaaagctccaacatttgacgaattgtcaactgcaaatgaagttcttgtaactgggattaaagttgtcgatttgcttgcaccttaccttaaaggtggtaaagttggacttttcggtggtgccggagttggtaaaaccgtccttattcaagaattgattcacaacatcgcccaagaacacggaggtatttctgtgtttactggtgttggggaacgtactcgtgaagggaatgacctttactgggaaatgaaagaatcaggcgttattgaaaaaactgccatggtctttggtcaaatgaatgaaccaccaggagcacgtatgcgtgttgcccttactggtttgacaattgcggaatatttccgtgatgttcaaggtcaagacgtattgcttttcattgacaacatcttccgtttcacacaagctggttcagaagtttctgcccttttgggacgtatgccttctgccgttggttaccaaccaacacttgctactgaaatggggcaattgcaagaacgtatcacttctactaagaagggttctgttacatctatccaagcgatttatgtccctgccgatgactatactgacccagcgccagctacagccttcgctcacttggatgcaacaactaacttggaacgtcgtttgacacaaatgggtatttatccagccgttgacccacttgcttcatcatcacgtgcgcttacacctgaaattgttggtgaagaacactatgaagtggcaatggaagttcaacgtgtcctccaacgttataaagaattgcaagatattattgccattcttggtatggatgaattgtctgacgatgaaaaaattctcgttggacgtgcacgtcgtatccaattcttcctttcacaaaacttccacgttgcggaacaatttactggtcaacctggttcatatgtaccaattgacaaaactgtccatgacttcaaagaaattttggaaggtaaatatgacgaaatccctgaagatgctttccgtggtgtaggtccaattgaagatgtactcgaaaaagcaaaatcaatgggttattaattcgatttctgatgaattgagaaagtgaaaatactctattgcctaaaaaaattactgacaataaattttgtcagtaaaagttgattgaattgtaaaatttgagtgactgttagagttttgtttttagaaaagtattttttatctttgtaatttaaattttcatagaaaaaattggaggaatcgaatgtctgaaaacgtcatgacacttcaagtaattacccctgctggtatgatttacgatcaccatgcaaattacattactgctcgaactacgaatggtgaaattggtattttgccaaatatgatttcaactattgctggacttgaaattgatgaacttaaagttcgtcgtccagatgatgaaacacacgtggattatattgcagttaatggtggaattatcgaaattagagatagtcttgtaacaattgttgcggactccgctgaacgtaatcgcgatattgatgtttcgcgtgcggaacgtgcaaaaattcgagctgaaaaagcacttgaagttgctaaagctgagaagaaatcagatgaaataaatagagcggaagtagcactccaccgagcgcttaaccggttgaatgtttcgtctcatagataaaaagcacctacgggtgtttttttatctcagattaaaatattgcaaaaaaaagacattaatgttaaaattataaacagtaatgatttgagaatctaagaaataagtgagggagaatgtgattcttgattattgtcgagatctgtttgatatcctagaaaatttagaaggacttttaaaaagttcagaagaattaagagaggattatcggcaaaaaataacagaccagatagcgcgtcaggcatagattttagatattttagtttcaattggaatgattgtttatttcatgccagacaagacagtattttttagtaatctgattccagcgacagggcctgttgacctgttttttagaatgtctgcaattacttttctctctttagttttgggttatggtgccagattaggattgacttggctttggcaacgaaattttttaccggctggaagaaaagatattgcacggttatttaaaaagaaatatttaagaaaacaaaaagagatagttgatcagattcaaagagttttggacagtgaaatgataaaagattcaaaactgccgagcgattatatgaatacaaaaagtcttaattacattatagattgtttggaagcaggggaagtcagtaccttaaaagaagccattgatttattagaattagaatcgcgtgattcacatgtccattctttaattaagactgaaaataatactatcacaagagcatggaccttgattagaaatgacaaagaagaaaggagttaaatgaaaaaaattaaattaataattagagaaaaaatgtaatttttggactacttttagtaatttttgttgttggattttttccgaatataaaatttaactctgactctctaagtcatggaaatgtaaaaattgaaaatagagttgctgcggatacgataactgatgttgctgaaaaagaaacagtaacaattaatttttatgattcggtgaatcgcaactctaaagtccaaagttcagaaacaatgaccgttaatgttggtgagtatgtttggcccgttaatttgggtgatacggcagatcaatcattaaaaaatgtctatcatatgtaccaaattcctcaaattgctaattatacttatcagtctagtaatcaatcatcacccttacttgtcactgataatccagcaaataatgttataaatctttattataagaatgataaacaacagagtcaggtaacgattaatttctttaattcagaaaatcagtcctctaaagttcaagattcagaaacaatgaccgttaatgttggtgaatatgtatgggcagttgattttggtgcaatggcgaatcagtcgttaagtaatgtctaccatatgtaccaaattccccaaattgctaattatacttatcagtccagtagtcaatcatcacccttacttgtcactgataatccagcaaataatgtcataaatctttattataaaagggataagagtcaagtaacaataaattaccttgattctgatagcggtgaatcgattagtccttctaaaaatgtagacgtcaatgttggcgattatgtttggattatttcttttgctaataaaagtacaaaacagttcaaaatgggaatttattggtgtgttgctcccccgattacaggttattcctttgaccatggaacaccaattaaagtaaaagaaaatccagaagagaatgtggttaatctctactataatgctgaccctcttcctgccaaatatacttttaattatgaatatgcaaaagatacaccagatcaatctgaggcgcttcctccgtcgcaaatagttgaaaaaggggattcagtttcatctaagcttccctacggttattcaatttcagaagttatagatgagaatggtaaagtttattcaagcccaacagaagcacttgaaaagcaatccggaagtaacccaaaaacttttagaataattgtttcagcaaataaaagcagtttaaaattaactgttcatgagccaaatggcgaaattaaaatagaggatttctctggactttatggggcaacttatcagcttccaattgagaaaaaattgatttttaatggaaaaatttatcatgctatcatcacaattactaaaagagattggcggatggacactagtatcagtcttgcccaaagtcctgatgaaattgcttctttattaaaagataatattttagttggaaaatatgacagttcagtcatttcaatcgatgtctcttataaggaagaaggaatagtaccaattcctccttctgatggtggagataatagtagctcgtcaactcaatcttcagaaaaaactgcggacaaaacggataatgaaaaaaataatgaagataaaatagtttcttcaactaccactcctccaccagcaagtaaagaaaaagaaagctcagtagagaagaaaaaagaagtcgaacaagctcattcagaaaataaagtcatacctaaaaaagaaataaaagttcccttagcaccaccaactccatcattttctacggcggaaaaagtgatagctagcccatcagttacaagtgaaatcaaccaagaagcacacattcttaaaatgagaattgcaggtgcagctggacttgctactggtactgtctcagcttatgggattttacgagctttaaaaatgatgattcaacattttggtaagctaggtaaattttagataagtgagtaaatttcatcttactaaactaaattgaatataaaaaaagcaccctgaggtgcttttttattttatttatgcattcaaaacttttgataagaagtcttgtaaacggggatgttttgggctatcaaagagttcttctggtgtaccatcttccaagataactccaccatccgtaaagattacgcggttagcaactttacgtgcaaagcccatttcgtgagtaacaataagcattgtcattccttcttcggccaatttttgcataacggctagaacgtcaccaaccatttcagggtcaagtgctgaggttggctcgtcaaagagcataacgtcaggattcattgcgagggcacgggcaatagcaacacgttgtttttgacctcctgaaagcatttcaggcattgcatcttttttatctaacaagccaactgtttcaagaagttgaattgcttttttatctgcatcatcttttgacatctttttcagttcaactggagcataagtaatattttgcatcacagtcatatttgggaaaagattgaaatgttggaaaaccattccaacgttttgacgaacaaggttaagatttgtatttttatcagtaaggttaaatccgtcaataataatatcgccagaagtagctgtttcaagcccatttaaagctctaagaaaagttgattttccagaacctgaagggccaatgatgcagactacatcacctttttcaaattttgttgtaattccttttagaacttcgttttttccaaaagatttgtgaagatcagtgacttcgatttgagtattgattcccatattagtatgttctccttatttcattcttttttctacacgacgtccaatccacatcaagaagaggaggacaatcatgtaaactaaaccaattaatccataaacacggaaggcttggaagttacgtgctacaataatttgacctgtttggagcaattcaacaagtccgataactgaaactaatgttgtatctttcaatgtgatgatgaattggttaatcaaactagggattgtaattttaatggcttgaggtaagataactttgcgcattgatgtcaggtaagtcacaccgagtgaacgactggcttccatttgtccagaaggtacagcttgaacaccagaacgaacgatttctgcaatataagcagaagagttcaaagtaagggcgataacacccgctgtaaattcattaagtggtgattgatggcccgtaatgatttgtaacaaattaggaattccgtagaagataaagattgttaacactaaaagcggaattgaacggttaaggtcaacataaatgcgtgcaattgtacgaagaatcttgcttggagctactgagaagagtccaaagataattccgacgatcattgctaagataaatgagagaatggcaagttcaagtgtaacgagtaaaccacggccaatttgttcccagttattttgtaaaataccaaagaaagtattttcttttgcacttgattggattgttttagcatcactagctaaatatttatcaatgattttatcatattcaccattggcacggagatttgctaaaccattgttaaacatttcaatcaactctggattgcttccttttttaacagcgaatccatattgcccgtcaggaattggcttaattggtgtggcaaatttttgcccttgtttaatggcgtatttaatgacgggttcgtcatccattagagcattgatagaaccgttattcaatgatgaatacatggttgttgcatcagtgaaagtttttacagtgtagccatattcttttgcatgggcattaagataatcaaaagaagcagttccgtttttagcaccaagtgttttacctttaaggtctttccatgacttgatagagtcatctgtacttgatgtggcaatagttaagtttgaagaatagtaaggactaccataatcgaaaacttgtttacgagcatcagtgattgacattcctgacatcattccgtcagcatgtccagattgaacagagtcaacagctgcttggaaaccaatgaaattccattttagtttgaaaccttggtttttagcaatagcgttaagcaagtcaacgtcgataccagtgaattgtttattatcattttggaattcaaatggagcgaagctattatctgaagcaatggtgtaaacatcttttttaggtgttgcttttttagtggcagtaatcccatattttttgaggattttatcataatctccgtttgatttcatttcagcgagtgctttattgaaaccatcaacgagtgttgaatttttgcctttcattacggcaaaaccataacctcctggaagggagattgatgggaagttcattgctaaatcttgcccttgtttcatagcgtaagaaataactggaacttcgtccattgctccagcaatattaccagagcttagagcggcaaacatatgaacaccgtcagaataggttttgattgtgtaaccgtatttcttttgattttcttgaagccatgtctgtgcagcagtcccattttttgctccaactgctttacctttaagatcactgtaatcagaaagtttagagtctttagttgtagcaatggttaatgctgatgtatagtaaggatttgaaaaatcaaaagtttctttacgttcgtcagtgattgtcattcctgcaattacaccatctacttgtccagctttaaggttttggagagctgcatcaaaaccaggatatgacatttctaatttccagtcattgattttagcaacttcttgcatgatatcaacatcaatccctacccattttttctgaccattttgaaattcaaatggagcgtatgagctatcggatgcaatttttacagttgtctcggccttaaccgaaggtgcaactaggaaagctgtaacagtggcaatcatcattgccagagcgaaaaataatttcttcattttgtctcctcgaatatgagatttgagcttgtcttcttttaaatataaaaaaatgaaaattaaaaaaatgttcttctaaataagtgttggaataacattcttttagtttcctatatttattaggagctaagctcagtttattttattctggaaaaattataccacaaaacttgtttataagcaagctgatgttaggttttctgacattgtgtaactgttgaatttgagatttctctgataaattataagaaagttgttattgtcaaaaagggctttttgttgtaaaattgaacgagtgcttgaatgaattccttatgtatgtattctatttaagtaaacagaactattgtaagaatttttaacttttgaaaaggaatattatgtttgtacaactttcgatttttggtttctttaatgattggatggctaattttgcccagatgcctaatggtcatatttggatatatgttgttttaggggcgattatatttattgaaacaggattagtgattttccccttcttgcctggggattcaattttattttttgttggttctttggcagcaatgtcaaacggaaaattatccattggcttattgattttggtgatggggattattgccttcattgctaatctgttaaattatgaaattggtcgaagatttggggatgtcattccaaaacataaatggctttctcgcttcttgaaaccagaatacatggaagaagctcatcaattttttgaaaaatggggttcttgggccattttcttagggcgattcatgccaatcattcggacgattgttccatttacagctggtgctggtaaaatgccacataaaaagtttattttctttaacttcatcggtggttttgcttgggttattgttgccttaggtgcaggctatttatttggtggaattccttttgttaaaaaacattttgaaatcatcatgattgccattgtctttgtgtcactactaccggcaattattggcattttgaaacgcgttcttggaagtcgcaaggaagcttaactttatgataaaataggacttacaaaactgtcagtcctttttttatcgattgatatgtcaatgacaatagaatttactgacaaagacgctagtatagctgagccttttgcgtcttgcgcaaatatggatatattagtagtttcatcagtaattttggagaatttttatgaacattaacggctacactcgtatggctgctgttgtagcaaacccaattaaacacagcttgtcaccttttattcataatctggcttttgatttaacgaatgaaaatggtgtttatttagcatgggaagttgaggcggaaaaattgccagctattgtggaaaatgttcgtactttggacatgtatggacttaatatttcaatgccttataaaggcgaaatcatcaaattcatggatgaattgagtccggcagctgaattaattggagctgttaatacggtagttaatcaatcagggaaattaattggacataacacagatggtataggatttttcaatagtttagaaaaatatcatttcaatatccaaaataaacaaatgcttattcttggtggagggggtgcagcaattgcaattattgctcaggcggctttgtctggagctaaaaaaattgtggtcgcagcaagaaaatcggcctcatatattccgctaaaagagaaattggaaaagctgtcagtaaaaacagggattgaaattttactgacagacttatctgaagctgatagattacaaaaagagttgaaacagaccgatttatttgtaaatgcaacctcagtcggaatggatggagaatctttgccgctggaaaagaacttagttcttcctgaaaaacttttggtggtagatgctatttataaagtaagagaaacaccatttttacgttgggcaaaagagcaaggagctcaaactgaaaatggacttggcatgctcattggacaggcggcggaaagcttttatttatggacaggtaaaaaaatgcctgttgcagaaattacattagaaatggagaaagaagcatgaaattaaatgtgaatttaccagaacatccctatgatgtcatcatcgaaaatggggccttggctaatattggaacttgggtttcttcattgtggaagaagcagaaaattgttttgatttctgataatcatgtcaatggactttatggtcaaaaagttgttgaccaacttgaaaaagtaggttttgaagtggcaacttttgaatttccggaaggagaagccagtaaaaatttactgacagccgaaaatgcttggaacttttgtgccgaatttggattgactcgttctgacggaattattgcacttggtggtggagtaacaggtgatttagctggttttgtagcctctacttacatgcgtggtatccatttcttacaaattccaacaagtttgaccgcccaagtggatagttctattggtggaaaaacaggaattaattccaaaatggctaaaaatatgattgggacttttacacaacctgacggggttttaattgacccagaagttctgcaaacgctcggtcaaagagaatttcgtgaaggactgggggaggtcatcaagtgcgccctaattgctgacaaagacctctggaatttactgacagacttgtcagcggataatttggtagaaaagcttgataagattgaagaaattatctatcggtcttgtgaagtaaaacgaaaagtggttgttgatgatgaattagacaatggtgtacggctctatttgaactttggtcatacaattggacatgctgttgaaaatactgcaggctatggcaaagtgatgcatggtgaagcagttgctattggaatggttcaaatcagtaaaattgccgaactcaaaggtcttatgcccaaagggattactgaccagatccgaaagatggtcaaaaaatttggtttacctgacgaatatcaaccttgggatgaagagcttttatttaaagccttaactcatgataaaaaagcacgaggaagaatcatcaaaaccgttattgttcctgaaattggcaccgctaaaattaatgaagtgacttttgaagaaatgaaagattatctccaaaaataacttgagttattctaagagaaaccctatctaaaaattacaaaaatgtggtagcattaaaaaactcccagcttttataaaagctgtaaaaacacttatttaaaggagaaacgatgtatatttacctagcttttgctttagttggcggttttttacttgctaatcaaaatccaatcaatgcggatttacgaaaaatagttggctcaccatttttggcctctggaatttccaactttgttggttcgatttttttaggaattatcactttagtgacaagtcaaacactttttcctagttttcaatttgttggctcacacccagcatggatatggattggtggggttcttggtgggattttcctaacatctaatgttttactttttccaagattaggagctgtccaaacagtgattttacctattttgggtcaaatattgatggggacacttattgattcatttggctggtttcatgccatgcaacttccgatgactctgatgcgctttttgggaattatcattactttagctggggttattgtcgcggttgttcttcctaatttaaaagaaaaagaagcagaaacgcaccaaactaacttactaggctggcgaatttgggcggtcatcgttggggcaatgtcagctgctcaacaagcaattaatggccgattgggagttttacttgaaaacactgcacaagcagcctttgtttcgttcttcattggatttttagctatttttatcgtgtcgctttttattgaccgccgtttgccaaaaatttcagaattaaaaaaagcaaaaccttggaatggaattggtggatttttaggagcctcattcgtttttgcaacagtcgttgctgttccgcaaattggtgcagggttgacaattatgatgggcttgattggacaaattttaggcagtatgttggttcaacaatttggttggtggcgctcaagtaaatatggcattcaaatttggcaaattgttgggattataattatgctgaccggaataatattcattaaatttttataaagtagctagtaatatggaacagggcttcacgctcactaccttccgtctgcgtgttcactaagcagtaatacctataaaagaacttagaaattgaggataatcactctaaaatgtttactcaaaaatcatttgaaatttttaaaatagaaggtttagaaccaagaatgactaagattcgttctgaaattcaacctgttttttctgaaattggtcaaaagttactgacagagctgtcagtaaaaattccaaatcaagaattttactttcacatcgctcaacatcgcagaagaacagcaaatgcgcctgaaaatacttggtcagcaatttccacaaaagcccgtggttataaaatggaagcccattttcaattaggaatttgggaagattacgtttttatttatttatcaatgatagatcagcctaaaaagcaaaaagaatacgccaacttactgacaaatctgtcagtagaaaagttactgacagaagattacgtaatctcaaaggaccatacaaaagcagaaacttatcccctgtcagcatttagagaagctgctgaacgcttaggaaaagtaaaaaaatctgaattggaaattggacggctttggcctaaagaaagatttaacggcaaagaggactcaataattctagcggaaatgatagaaacaattgaccaactcctaccgatttatcaaaaattaatggaggcctaatctaatgacaacatttatttgggatttagatggaacactaattgatagctatgaggtgtttttagaagccttgtccgaatcatttgcaaactttaacctaccatttgaccgagaaacagtatataattttataaaaggtcagtcagtcaatgctttactaaaagaacaacccgttccttttcaagaaataaaagaagatttcacgacaaattcaacagctaaaaatgacaaaattaaattaatggttggtgcaaaagccgttttagattggactcaaaaagaaaagattcaaaatttcatttatactcacaaagggaaaaatgcttatgatttgcttaatcagctggaaatttccccctattttttagaaatagtcacttctgaaaatggatttaaaagaaaacctcatcctgaagcaatcaattatttacttgagaagtataaattaaagcctgaagaaacctattatattggtgaccgaatccttgatattgaagctgcccataatagtggtattcattcaatcaattttctgtcagcaaaaaattcacagcaaatcaataaattaacagatattattcaaatttttgaaatgaaataagtaaaaagttactaaaaatggaggtataaaatgcgttattttacagcgggagaatcccacggtccaagacttacagcaattattgaaggagtgccagctggtctctcattgtcagcagaagatattaatattgaacttaaacgtcgtcaaggtggctatggccgtggcggacggatgaaaattgagtctgaccaagttgaaattacttcaggcgttcgacacggaaaaacaattggtagcccgattacacttaatgttacaaaccgtgatttcaagaattgggaacagattatggcagcccaagatgttgaagataaaattaaaaaacaacgtcgcttgaccaaaccacgcccaggacatgctgatttagttggcggaatgaaatatgaatttaaagatttacgaaatgttttagaacgttcgtcagcgcgtgaaacaacaatgcgtgttgcggttggagctgtggcaaaaaaactacttcacgaattagagattgaaatagctaatcatgtcgtaaattttggcggacgagaaattacaagtccagaaaatttaagtgttcaagagattcgtcagacagctggccttagcgatttatctatttttgatgagagtcaagcagaagaattacgcaattacatcgaccaaataaaaaaagctggagatacaattggtggaataattgaaaccagagtagaaggagttccggctggtcttggttcttatgtccaatatgacagaaagttggatgcaaaaattgctgctgcggttgtttctatcaatgcctttaaaggagttgaatttggacttggatttgaagcaggaaaacgaccaggaagtcaagtgatggatgaaatcatctggtctgaggataaaggctacactcgttcaagtaatcagttaggcggttttgagggaggaatgacaaatggtgaacaagtcatcgtccgtggagtcatgaaacctattccaacattgtataaacccttgatgtctattgataccgaaagccatgaaccctacaaagcaagtgtagaacgttctgacccaaccgctcttccagcagcaggagttgtgatggaaaatgtagtagcaacggtagtcgctcaagaaatctgtgataaatttaattcagatacaatgaatgaactgaaaattgctgtggataactacaaaaaacgtttatcagaatactaaaaaaaaaagccagtctctggctttttttttatataataaataacttacgaatttgtaagttttcagacgaatatttcttgttacaatgaacttatcaagaaaagttaaggagaacaaaatgaaaaaaatactttttggaataatagcacttatcatcctcatcggtggatcgggatttgcatggtacaaagtaacttatggtggaggaacttactacattcaaatcactaaagacggaaaagaaaaagaagtcagtgacgattcaggaaaaaaattcaaagaatatgattatgatataaaatcatatcaaaaaaatgggaaagaaaagagagttacatttatggcagaccacaatctccgtaaagaagcttacctgaaattaacagttaattccgttaaaggcgtaacctcttgggaagaagtaaaaaaatcagaggttcctaaagaagctcttaagaaattaaataataactcataaaaacagtctcagaaagaaagaggaaagaacatgacatttttgcaaattaatattatgctaatgaccattacagttattttggcttcactaatgggcgcttgcctcctttattccatgaagacaatgcgaacacgcttagctaaaataaataaaaagaacgaaatcgaaagataagataggagaaaaacatgttactcgaagtaaaacatctcaagaaaatttttaaaacaagattttcaaaagaagaaaccacagccctagttgacattgattttggtgtagaagaaggcgaatatattgccattatgggggaatctggttcaggaaaaacaaccttgttgaatatcctatcaactcttgaaaaaccaacttctggacaagtactcttaaataaagaagacatcacagctattaaagataaagaaatttctgcatttagacgtgatcatcttggttttgtcttccaagatttcaatttacttgatacccttaatgtcagagacaatatttatcttccactcgttttatcaaaatcaagcgtagaattaatgaaaagtagactaaaaattctcgcacctaaactaaacattgaaaatctcttagaaaaacaaccttttgaactttcaggaggacaaaaacagcgggttgctgtagcccgtgccttgattagccaacctgatttagttcttgccgatgaacctacagctgctttggactttaaaaactcagaagacttactcaatctttttgaagaaattaatgatagtggtcaaactattatcatggttactcactcaagtttagctgcaagccatgcgaaacgtgttctttttataaaagacggtgtcctttaccaccaactttatcgtggagaaaaaagctcaactgaatttgcaaaagaaatcactctttcaatgactgcttttttgggagcagcagaggatgaggaggtgcccttgaatgcttagtctaaagcttgcggccaataatattaaaaaaggttttaaaagttttgctccttttttaatggcctctattacgatgttcgtaatgattttcgttaccgcgtcaatcgctttatctccctcaattagtaaattaaaaggagggagttctctttcacaagtgatgggatttgcattaattgttttatctatttttgcagttcttatcttagtttacagttatcgctttttacaaacccaacgttctaaagaatttggactctatgatattcttgggtttggtaaaacaagaatcgtaggagtagcatttttagaattactcttaagctatatcattacggttattgttggaacgatttgtgggattgctttttcaaaattcctcttcttagtgtttgtaaatatgattggaggaaattattttaatctagtcattagtcccacagcgattttattacttgccattctcttctttgttttctttttagttttgatgatgatcggagtttggattatctggcgttcttcaagtcttgatcttctaagagaagaatcaaaaggtgaaaaagaaccaaaatcaaatttatttttcgccattgctgcagtcattcttttaggagctggttactatatcgctttaacggttgaagacccaatggcagcaataatgaaattctttattgccgttttacttgttatctttggtacttatcttttctatattagttttaccgtttggtaccttaaattgaaaaagaaacgtccaagttactataaaccaaataatttcattacaacaagttctatgctttatcgaatgaaagcaaatgctgttggtctagggaatatcactattttgttatctatgacaatcgtgaccgtagttgtcagtttaggagtttttcttggaactgagaactcagtaaaaacttactataccagagaagcaaagactttttctgttgcaaataatacagatacaaaacaagatattgaacgaattaaaagtgccgcagctagcaaaaatatagatatcaaaaatatatctgatatgtactttgctcaagatctacaagccgatagagtcaagtcgtctaaagatcaatttattactgcaaataagcaaggagcaatgtttgataaaaattcatattttgcaaccttaacaaccgctcaaacacttaaatcattaggaaataaagatattccttctttaaaagataacgaagtcttacttgtagatatatcgaaaaataaaacttcatttgatagtaagattaaatcaattcaatggtatggagaaacttatcaagttgcagacacgcttaaatcagtcaaagattttccagcaagtggtgtaacaacaatttcttctaaagttatgatgattgtgtttgctaacaatcaagcttttgataaaggactagctaatttcaataaaacaattagtggtaatcaaggattttcaaatcttgcatcaacatcaatcatctttgatatcaaacctgttgatgaaaaacgatttactaaagctttcaaggaagagtttaaagataataaagatttatcgatttcatatagaagtgaagctttgcaagatcaacgcgctcaaattggaggatttgtctttgttggatttgttttaggaattagtttcattcttggagctgcattaattatctactacaagcaactctcggaaggggcacaagataaacgctcattcaaaattctacaggaagtgggactttcaaaagaagaagttcaaaaaacaatcaaatcacaagttcgtttgatattcttcctaccattagttatcactatcgcccattttgctggtgcatatcttatgattgaaaaaatagtaatgttgtttgatattaaagaccgttcagttatctttactatttctttagcaacaattgcaattcttgcccttatttattatctcatttataaggcaacgagtcgtgtttactacaaaattgttgaaagataaaaaagaaggcataaatatgcctctttttttgtttaaatccatatagaagaaacaagggaaggaaaaagctacaaaagagagctacttttgatataataaaaggaacaaaaacaatggttttctcggcactaaatgtatcttttgttagagaaaaatagttacctttagggaaaggaaaatatgacgatctatcttcattcaattcaaattggagttcttctcttttttatatttttatttatatcattaattccatatttgattgtacaatatcgtcggtatggtcggattaatttttggcgcttttttgtcaatttttcatttattctttatctcatttgtgcttatgccatgacaattttccctcttcctcctgtgagtgaggtagcaaaaatgacaggtccaaagcaaaacttagttccatttgagtttgttcgtcaatttattttatatagtccttttaatataaatgagccttcaacttggcttgcagctctaaaagattcaacatttatccaaccattttttaatctacttttaaccttgcctcttggcctttatttaagatatttatttaaacgctcatttaaacaaacttttattttaagttttttattaactttatcatttgaacttatccaaaggtcagccctttttggactatatcctcgaccttatcgtttgtttgatgttgatgatttaatgattaatacacttggaagtttaattggatttggaattgcggttatttttagtcgatttttaccagatttggatgcaactaaggttgaaagttcaagagttagtctttcaagacgtttcattgcctttttagttgatttggttcttatttttatcattggaagtctttttctaccaataggctattattcagaattaataattttaggacttgtcccgctagttcttaaagcaacaccagggcaattattattgagaattgaaataaaagctaaaaatcgtttcagaattgctttgcgccaatttttatcttttggaaactttgctttgattatcgcagcagaatattttcttcaacgttcagctaccatagctcaggatcaattgggacaaaactttttacttattttactctttttaggattgagtcttttacctctactagatgttttaattgcttttctctcgaaaacaagaaaactttggtatgaaagagtgagtgatacagaaataatagcaaaattgaaaacaaatgaggagtgaatatgactaaaatatttattgtagaagatgatgaaattattgtgaaagcaattaagattgccttagaaaaagaatttcaagtcagaagtgtttccaattttcgagcagtaaaacaagaaattatggaatttgaagcagatttagtattaatggatattgggctaccattttatagtggtttttattggacaaatgaattaagaaagctttcccaaattcctattatctttatttcttcggcgtcggatgacatgaatcaagtaaccgccatgaatcaaggagctgatgattttgtaaccaagccattttcattagaaattttaaatgcaaaaataaaagctttactgcgcagaagttattctttttcagggattgaaaagttagaatttgctggttatgttttatctgaaaatactttgatttcaactcaagaaggtgaacgcgaagaaattgagctaacaagttctgaaaataaaattttaactcttctttttcgtggaaatggtgaagtggtgaccaaggaaaaaattttacaagagttgtggcaaacagatgaatttattgatgcaaatactttaaatgtaaaaatgactcgtttacgcaaaaaacttggtgaaattggctttgataagcatattatgacaaaaagaggaagtggttatgctctggtttaaattttttaagtctaaaattccacaaattggtgtctttttgcttatgtcagctatttatattgtgacattttggctttggcatctaccaatgatggcatttgttaacagtactttatttgctgtcattatttttattatttaccttatctcatcctattttcgctggaaagcaaactgtgaagctattgagagagtagtgaaagacaacgaagagttgcaaaaaaagttagaacaacaaaatcttgctgagcgtgaaatggaagatattatcagagtctggtcgcaccagatgaaggtccctttggcagctattgatttaatgactcaaactcaagttaatagtgaggagctgaagaatcaggttttttctttagaaaattatctaaaaattcttctggaatatcaaagaatcaataatttagctactgatttcagatttgaaaaagtgagtatggcttcacttgtgaaagaattagtcaaaaaatatagtagcttttttattcagaaaaacctttcaatccaaattgaaggagaatggttagtcaatagtgaccaaagatggttgagtctggctgttgagcaattactgaataatgctgtaaagtataccaaagaaggtgggattctaattaaaattaaaactggtgaattaatcattcaagatagtgggattgggatattaaaagaagaccttcctcgcctttttgaacatggatttactggatataatggtcggattcaacaaaagtcaacaggtcttggactttatttatctaaattaattttagataaattagaatttgaaatttcaattaactctgaaattggaaatgggacgtctgtgacaataacgaaagaataaaaatgaaaaaaatattaatcattggacttggtctcattggaagttcaattgccttagggataaaaagagctcatcctgattttgaaattcttggctctgatcgtcaggaaattcaagaaattgctcaaaagcgtggaattattgattctaaagttagcttagttgaaggagctcaaaaagcagatattattattttggctgttccaattataaccactttggagcttttgaaaaagctagcaactttgaatttaaaaaaaggtcttttgattacagatacgggttcaaccaagagtgaaattgttgaactggcaaatcaactttttgatgaagacaaagtacgatttatcggtggacatccgatggctggctctcataaatcaggagtaatggcggcagatattaatttatttgaaaatgcttattatgttttgacccaagaaaaccaagaattacgtgatttacttaaaggacttcatgccaaatttattattttagatgcaaaagagcacgaccgtgtcactgggcaggtttctcatttcccgcatattttggcttcggcccttgtttggcagtcagatgatttttcaaaagaacatcctttagtgaaacatttagcggctggtggttttagagatttaactagaattgcagaggctgacagtttgatgtggacaagtgtcttattatcaaatccagaaattacgattgatagaatagaaaatttcaaaaaacaattagatgaaattgctttaaaaattgctaataaagattctgcagctatagaacacttttttgaacaaggtaaaaaaattcgtcaagccatggaaattcataaaggggctttgccaaacttttatgatttatttatttcggttcccgatgaaaaaggagttgttttaaaggttttaggcttactagaagatttctcaataacaaatgtaaaaattaatgaagaaaatcgcgaagatattcatggtcaacttcaaatttcatttaagagagcggaagatttaaaagaagcacgagaaattattgaaaaagcaactgattttacagttgtttgataaagattaaagataggactttcttagtcttaaaatcttaggaaaaattgttgaaaataaaagggctctgagcgcccttttatgctataataaatactaaaaaatgtttaggataatataatataatgaaattaaagataaattcgcaaggtttaaaaggacgtttaaaagttccaggagataaatcaatctcacatcgtagtattatgtttggctctattgctaaaggaaaaactgttatttatgatattttacgtggagaagatgtcttatctactattgaagctttccgtgcgatgggagttgaaattgaagataagggtgaggtgattactgtccacggtaaaggaatttcagaacttaaggctcctgaaaaagcactggatatgggaaattccggaacttcaactcgtcttttatcgggaattttagcaggccttccttttgaaactactttgtttggtgatgacagtttatcaaaaagaccaatggatcgtgtagcaactcctttacaattgatgggggcagaaattactggtcaaaccgataaggttaaattaccgatgacaattaaaggaagcacgcatttgaaggcaattgaatatgtccttccggtggcttcggctcaggtaaaatcagctgtaatttttgctgctttgcaggcagaagggctgacgaaagttgttgaaaaggaaaaaacacgctcacatacggaagaaatgttagttcaatttggtggagaactaaaggtttctgataaaacaatccttgtacctggtggacaaaaacttgtgggtcaaaaagtagtagttcctggagatattagttcggcagctttttggttggttgcggccttggttgttgaaaattcagaacttattttagaaaacgttggagttaatgaaacaagaactggaattatcgaagtcattcaagcaatgggtggacagttggaaattttagagcaagatgatgtggcaaaggctgcaactctaaaagtaaaagctagtcaattgaaaggaactgaaatttcaggtgatttaattcctagattaattgatgaattgccaatcattgctctcttagccacgcaagctcaaggcgaaacaattattcgagatgcggctgagcttaaagtaaaagaaactgaccgaattgctgttgtcgcgaatgctcttaatagtatgggggccaaaattcaaccaacagatgatggaatgattattcaaggtggaacgaaactccatgctccagaaaattcaattaatactttaggggaccatagaattggaatgatggctgcaattgcagcacttttggttgaaaatggggaaattgagcttgaacgtgccgaagcaattcaaacaagttatccaagtttctttgacgatttagaacaattgtcggaaaatatttgaacttaagtgattggaaataaaaaatgagtatcattttaattggatttatgggtgcgggaaagtccacagtagcaaaacttttaacagaaaattttactgatttggatcaattaattgaagaagaaattgagatgccaattgctgaattttttgaattatttggggaagctgattttcgtaaaattgaaaatgaggtttttgagcttgcgcttcaaaagaatataattattgcaacgggcggtggaataattgaaaatccaaagaatttagaggcccttgatagagaaactggagttgtctttttgaccgctgattttgaaacgctttgggaacgaatttcgatggatttgcagaatgttcgtcctctagcgcaggataaaaaggccgctcaacttttatttgaaaaaagaaaaaatgactatgcaaaagtggccgatttaacgattgatgttactgataaaagtcctgagcaaattgtagaagagattcgtgaaaaatgggggataaattaagatgaaaattgcgtatttaggacctcgtggctctttttgttcggtggtggctgagacagcatttgtatcagaagaattatttgcttatgatagtattctggatgttatcgaagcttatgatgaaggaaaatgtgattttgctcttgttcctattgaaaattcgactgaaggaactgtgaatatgagtattgataaaatttttcatgattctaaggcgacagttgtggctgaatttgttttgccaatttcacaaaatttgctggctctttcaaaagaggggaaaattgaacatatttattcccaccctcaagcgcttgcacaaacacgaaattatttacgagagcattatccacaggcaaaggttgaaattactgattctacttcagcagcagctgaatttgtgaaaaatcatccagatttgccaattgcagctgttgctaattcttacgcggctaaaatgtatgatttagagattgtagctaaaaatattcaggatttagcaggaaattctactcggttttggttattgggaaaagagaaaaaatcatttgatttactaaaaacaggtgagaaggtgagtttggctttgactctacctgataacctgccaggagcgcttcataaagcgatttctgtttttgcttggcgtgatattgatatgacaaaaattgaatcacgtcctttaagaacaaggctaggtcagtacttttttaatattgatttagtaaataatgaaaaaaataatttaaaaattccttatgctcttgaagaactatcaggtttgggagtaaaggttcgtttattaggaaattatgcagtctattcattgggagaggtgtaaaggtgagaatttattttgtacgacatggtaagacggagtggaacttggcgcgacgtttgcaaggacaaaaaggagattcacctttattaccagaatcttatgaagcgattgaacgagttcataagtttttagaaccaattgaatttgacaaagttttgtcgagtccacaaaaaagagctttgattacggcagatttactgacaaatcaaagtgtgagtactgacaaacgattgtcagaatggaattttggggaattagagggttggttcattagcgatgcaattgctaaatatcctaaagaaatgcatgattcacgctttgagttggatcaatttgatggaagtgcttttggagctgaatctgtgagttctgtcttgaatcgctttgattctttggctcaggatttgttgaattctaaaatagacaatgtacttttggttggtcacggggcttctggaacggctggaatgcgtcatttagctggctttccaattgctgaattacgttcagttggtggtttagctaataatacggtcactgttttagaatcaaatgctggccattttgacttaaaaatttgggataaacagctatgattgaaaaaacttattttactggttcgattgaggcaatatttttctccaatcccagtaatttttataaagttctactcattgaaattgatgaaactaatgctgaatatgatgattttgaaattgtagttaacgggacaattggggatgtggttgaaggagattcttatactttttatggtcaattgacgcagcatcctaagtatggggaacaattacaggtcagtcaatatgaaaaagcagtgccgacttctggtgctggtttagttaaatatttttcttcagataaatttcctggaattggtaagaaaacggcagaaaaaattgttgaaacttttcctgaaaatacggtagattcaattttagaagcgccggaaaaattggatggcctattgaccctagccagaaaaaattcatttatcaaacgattacgtgagaatcatggaatggaaaaagtgctgaccaagcttgcagaatatggcttaccaagcaaaatcacttttcaaatttatgaactttataaagaagaaacgattgaaaaaattgaggaaaatccttatcagcttgtggaagatgttaagggagttggttttaaaacagctgataagattgcaagtagtttaggaattgaagcggatagccctaatcgatttcgagcggcattgatgcatgaggtcaacacgcattcgcaatcaacaggtgatacttacattgaagccaaaaatttacttgagatgacgatagatttacttgaagaagctcgtaatgtcgaggtcaatccgtctgctgttgcggaggaaattaatggtttaattgttgatggaaaagtgcaacaagaaggaacaaaaatatttgagaattctttgtactttgctgaggacgggattcggaaatcactgacagcattaactaatcgttctggtaaagattttgctgatgaaaagttactgacagtattggctgaagttgaaaaagatttagaaattacttatgatgatttgcaaaagcaagccattattggtgcaatgaatcagcaatttttcattttgactggtggaccaggaactggtaaaacaacaattattaatggttttattgaaacttatgcccgtcttcatcagctaaatttggacccagaccattataatgatgacgtctttcctatattactggcagcaccgactggtcgagcttcaagacggatgaatgagttgactggtcttccagcagcgacgattcaccgccatttgggtttgggacaagatgaagcagaagatgctcttggaaatgaattgtctggtgctcttttgattgttgacgaattttctatggttgatacttggttagctaataaactttttcaagcgattcctggttcaatgaaagttctccttgttggagatgctgaccagcttccttctgtggggccaggacaaatttttgcggatttactaaaaattccagaaattccgtcagtaaaattggataagatttttcgtcaaggggatgattctaccattactgatttagctcaccatatcaaagatgggcaattgccaagtgatttcacggcgaaaaaacctgaccgttcttattttgaggtcagtgctaattttgttcctcagatggttgaacaaatcgcaagtgcatggcaaaaaagagggaataatccttttgaattacaaatcttagcgcctatgtataaaggaatggccggaattaatgcaatgaatgttcttttgcaaaatctctttaatccgcttaatgatcgacttgaattcgctttgggtgatatgaaatttcgtgaaggagataaagttcttcatttagtaaatgatgctgaggccaatgtatttaacggagatttgggacaaatcgtagaattgattgcagcaaaatatactgacagtaaacaagatgagttggtgatggattttgatggtcaagaattgacttatccaagagcggagtggtataaaattactctggcttatgctatgtccattcataaatctcaaggttcggagttttccacagttattgtgccaatggtttcttcgtattcacgcatgttagagcgaaatttgctttatacggcaattacaagggctaaacaaagtctgattttacttggtgaagaacgagcttttgcacaagcggtggcgcgtgaaggggcgaatcgaaagacctatttgattgagcgatttatgggagaaaatccagcggctaaaaatctgtcagtagaaattgtgagtgaaaaagttactgacaaaaaagaaagatctgacaaagagaagaagcctgcagcgccagtagaattacaagggcaaattcgttctgtcagtaaaaaaatgccagcacaagtagaagaaatttctttatttgaagatgaagaaattgcaacactggatcagggaagcttgacagaagcacttattttgtcaggaaattttgaccctttaattggtttaactcaacaagacttttcaatctttaataaataaaaaatactgacagaaattgctgtcagtatttttttgtttctatcagtactttttgatataaaaaaatctgccaaagagacagacatttttaattagccaagtttagcagcaagacgtgctttatcacgtgatgctttgttagcatggataaggccttttgaagcagctttatcaattgatgaagaagcagctctgtaaagttcttcagtaggtgcagcttcaaattttttgataagagtacgcattgcagatttttgttgtgcgttgcgttcgtttgctactttattcaattcagcacgtttgattgcagatttaatgtttgccattttttgtctccttttattacttttcatagaaaagcggttgatgtgatgtcccaggtgggcacactacaccctccaagatttttctaatacctatcaattatacaggaaatttgagtttttgtaaactatcggccttacttttttagaaaaaatagaaaaaatattttttactaaaataataaataaataaaaatggaaatcaagtaaaatagcaaattttcaaaattttacaagcattaaaaataaatttctaagcatttaaaaagaaaaatttaatctaaaaactaagtaaatcgtattgacaaagagaattatcgtgttataatcaagtcatgaatttagaagaaaagccgtggtttaacgacgcagaatatatgagttatgtcggtcatctattagaaatggatgagcttaaaaagcttgatgggattacacatcactatacttcaacacgcttgcaacattgcttaagagtaagttatgtcagctatctcattgcgaaaaaacgtggcctcaatgctaaagctacagctagagctggacttttgcatgaccttttctattatgattggcgcaatacaaaatttgctaagagccatgcctatgtgcatcctcatatcgcctaccgtaatgcgcgcaaactgacaaccttgtcagctcttgaaaaagacataatcatcaaacatatgttcggtgcgacaatcaatccgccacgctataaagaaagttggattgttactgctgttgataaatatgtagctacccttgaagggtcagttaacctcaagtacaaatggaatcgccgtaagcattttaaacgtttaccttatttcagtattgattaaaaaagtaaaaaataaaacctatccattgataggtttttttatttagaaataagtctgtcagtaaaataaagcaagtcttgtcagagatttttcataatatgataaaattagtatgtaagcaataaattccattgcactaaaataaggaggtattttatgaaaaatgtaaaagtattttataatgaaaaatctggtaataatgatgaagacaaagttttgaaaacaattaaggacttttttgcaagaccagaaaattcagcctctaaacttgaatttatcaatccagaaagcccagaggatgcaatccgtcttgctaaaaaagccagtcaagaccaaacagaccttgtggttgctttaggtggcgatggaaccattaataaaatttgcggaggagtatttgaaggaggagcaaaaccgattctaggcattgttcctaatggtacggttaataatttatcaaaatcacttcatattccgcaaaaattagaagatgcacttaataatttaaggcaaggcgaaattcaaaaatttgatattgccaaagtcaataatgattatatgacatcaagtttaacattagggattttagcagatattgcccaaaatgtcagcggctctgagaagaaaaaatttggacctttagcttatctaaaagatgcttataaagttatccgctataataaaacctatcgaattaaagtaaaatataatggtaaaaccaagtcattaagaacaaaattattattgattacaatgacagatacaattggtggaatgcaagctttggcccccacagctaaagttgatgacggacttatccgtgtttattcattaaaagaaatcaatttatttaatatcctttttcatttgaacaaacttcgccgaggaaaatttgatgattttcttgaaatgactcattttgatactgaccatttagagattctcacacattcaaagaaaaagaaagataatccatattcaagaattgatggggataaaagtgatccgcttccattagacatcaaggtttatcgaaaagcactgacaacccttgttcctaaaagtgaataaaaggctgtcagtaaataatagaaataaaaaatcagacctaagactgatgacaaaaagcccaatttttggtaaaatagtcttagaattaaattaaaaagggaggccaaatataatgaaaaatatgaatgataatgatgttatctttgaccaaagaagcgatggattgaatgcatttttcagtaaaatttatgcgttgatgggagcaggagtattagtttctgcactcgtttcttggataatgattacatttttcttagataacatgacagcaattctccaaagtggaagtttattcttccttgtactctggattattcctttagtgatggtagtatcacttcaagggttagcaatgaaaaactcaaaaatggcactaccgatttttatcggttatgcggcatttatgggattcttgattagcttcactcttttgatgtataccgccactgatattactttagcctttgttacggcagcagcaatgttctttggtttatctgtttatggacgatttactaaacgtaatttatcggcaatgggtaaagcatttggtgttgcagtctggggcttgattattgcaatgcttcttaatctcttctttgcaagttcaggacttacaatccttattagcctagtaggtgttgtgattttcgcagggctaatcgcttgggataatcaaaaaattacacaggtttataatgcaaacaatggacaagtaagtgatggttgggcaatttcaatggcactttcactctatcttgacttcatcaacatgttcctcttcctgctccgtcttttcggtatcgcaggtggaaatcgcgattaagcgaaaattactgacaacacatctgtcagtaaaataataataaaaactctgctgtcagcagagttttttcctttcataaatctttgacaatcacataattaatttccaaaggaccatgaagtccaaccacaagttgcatttcaatatcaccagaatttgaggggccagaaataaaatgaagggttgacccaggcttcttatgttcatcaaaccaagccgcagcttgggtagaacgaggaaccatacgacttagtggaattacagaaatataatgagtgggtaagaagtgtagagaacgaccttggccggcttctgattcgactacaatcgttgctgattcagcgaggaaaaatttaggaacagccacgacgacattagaattttgagcggcattaatattttcatcacgattttctttaccaattttccacttcaccaattggtctgaaataacattcactcctaatttttcaaattcatctgttgaaggaatcatgacttgtccaccaccagatttttcaattaattggcgaatcacttcattcatttcaaaagaagaggtttcgattaaattagcagaaactcgactggcttgctccttggcaatatccaataattcctcagtagttaaatgagccaaatgtgtctcaggcaaatctgaaattggaacataaggttcaaaaggaagttctacacccccacgtttttcaaataaagtttctaaaaatttacttcgattttcaatagttcctgtcatgtttatttacctgccttatgttttttataccactgacgaaattgttctttatgtggcggagcaattggtaaatctcggacatctgtccaacctttagctagagcaggagcttttctaacggcgccatagttaaataaagaaccctcaacgctgacttccttagctttgggtaacatattaagaccagtgtgagccatatttattgccatcccaaatagtgctgggctacttgttcctttcccaatcgtattcatttcaaaattgacaaaagagccatcatgatgcattgaaagatcatcttccatcactttgcgatgttcaattaaaagttcatgcaaaggaatttttaccggacaagtttcagtacatgcaccacataaggttgaagcataaggtaaatcaccatattgttcataacctcctaaaacgggagagagaactgaaccgattggtccaggataaatcgaaccataagcatgtccaccaatttgacgataaactgggcaaacattcagacaagcaccacaacgaatacattgtaaaacagcttcaaaagcagttccaatcgcatttgagcgtccattatcaacaatgacaacatgaaaatcctcaggaccatcggattcgtcgtcggcctgctgaccggcaaaagtgacataagttgtcagtttttgaccaacggccgaacgagcgagcatattatctaaaatttcagcttctttgattgatggaacaattcgttccattcccatcagaacaatttgtgtcttaggaattgaaattgttaaatcagcatttccttcattggtagataaattaatgtcaccagtgttggcaatggcaaagttacaaccggtaattccgacttcagattttaagaaaagcttacgcatggtatccctagcacagcgagccaaattaactggatcattatcaccttcatagcctaattttttagcaaatatttcacgaatttgatcacgatttttgtgtaaagctggaaaaacaatatgtgaaggctcatcccaatcagcaacttgcaaaataaattcagccaagtctgtttccaaaatatccatatcatcagaaagcgaaacgagcattgggtcaatgtcaacttccgtggtcaccattgattttgatttgacaatctttttcgcgtttttttcaagaacaatccgtttaacataatcattggcttctttagcatcagccgcaaagaagacatgaccgccacgagccgcaacattatctgaaaactctgtcagataatggggtaaatattttaaagtatgttggcgaatggattcagcaatatcacgccattcttgccaatttccaagctcatcacgcgcagattctcttttctcccattgagcatcctgcgctttggctaccgcagctttagcaaactggtcttttttactctcttctaaacgttcagcgaaagtttttgtacttgtagaaagtcccattttctccccctatgctttgataaatgctgggtttttcacagcatctattctttctaaatcgacattcgtgtttaaaatttcagcaatatgcatcactcttatttttttaccttcgcgattcaattttccaccaatattcatcaagcagcctaagtcagcagaaattaagatttcagcaccagttgatagaatatcgtttgttttttcagtgaccatcatctctgaaatctcaggagatttaactgaaaaagttccgccaaagccacaacaattttccaaatgaggaagaggaagaacttcaagccctttgactttatccaataaaatgaatggagcttctcgttcacccaaaattctagtcatgtggcaagaacgatgataagttgctttttcgccattaaatgtggcaccaagatcttcaagacctaaaacccgataaagaaattgggtgaattcataggatttattcgctaaatcaattgctttttgcttataagggtcaccttcatcgaacatatggggatattctgtaaacatccctgagcaagaaccagcaatcccaacgacataatcagaagattcaaaagcatcaatctgatttttgattgttggcatggattctttaactaaccctgaattataagtaggttgtccacaacaaatttgttcttctggcaaatctgtttcaatccccaaacgttcaaggacttcaaccatggcaattccaacttgtggaaacatcaggtccatcacacaagtggagaatattgaaactttcataagcactccttagtattttgaaatctttgttaaaaactagacatctcctagagatgtatgctctttcattataagccgatttatttacattttcaaaaaaaggagctgtcaaaagaatttgacagactgtcgtttaaaaattattttgtaaaaataaaaataccaatcatcgattggtatttatttattcggggttaaaaaaagtttttcaagctgtctagctacaccatcctcatcatttgtccaaggaagaatttcactggcgtaaggtgtgagtctagcagaggcatttttcatagcataagcattgggagctaatttaaacatctcaatatcattatgttcatctccaaaagcaataagattctctaaaggaatatcaagaactttaagcagatgattaagtccagaggctttggaaattcctttaggaacaacttctaatatgccgttcggtccaccccaaacgccgacatctatcttgccattataatgacgtttcatttcctctgccaatgctaatttatctttttggcgagtggaaaggagtactgcatgaggattttcagtaactcggtctgcacgaagtcgattatagggttgaaatttttctacaccaaagagcttgggctcgacattacggaaagtgtttagaaagaattttcgacgatattcaacggcaaagaaatggagattaaagttttgttggtgcctcaaaaggtcaaaaatgaaggaacgatcaatataataagattttgtatgttcccagtttttatcattaggcattgaaatcaaagccccattaaaattaatgactggacttgtcaactcaagctcacgatagacatctaaagacattctaaaagggcgtccggttgtgatacagataatatgtccgagtgattctacctgtttaaaaatatatttggtataacggctgattgaacgtccatcagactgcaaagtagtaccatctaaatcaattgcaatcagtttacgttctctgtagttctccattcaaactccccttattctaaaatttatttgtcaattcattcattatatcatagttagaagcaggagcggaactctaccatgttctacgaacaagaaattactttttgaaaaacttgttcgtcattaccgaacaattaatggatttagagtagtttttatgctaaatttcttgtttccttaactaaaactgattagaataataatataatgttttttattttatgacgtgtttgcttaaaaagcaaagacaactttttatcaaagggttgaaattttaatcacagaccctaaaaggagaaattattcgtgaacaagttctttaaacttgaagaaaacggcacaacagttggccgtgaaataatggctggtttgactacattctttgctatgagttatatcctctttgttaacccacaagttttgggtacaacaggaatgcctgtccaagcagttttcttagcaactattttggcctctattgttgggacacttgcaattgccttaatcgctaatgttccctacgctttggcacctggaatgggcctaaatgcattctttgcttacactgttgtattatcgcttggttatacttggcaagaagctttggcaatggtcttcatttgtgggattatcaatattattattacttttacttccattcgtaaagcaatcattcttggaattcctgaaagtttacaacacgcaattggtggtggtatcggtattttcattgcttatattgggattaaaaatgcaggaattttgcgttttatcgctgacccaggaacttatgtgaacaaccatggaactattacagcaaattcatcaattgttccagaacttgtaacttttaataacccaggtgtattagtcgcacttgttgggattgtagtgacaatgttctttgttattcgtaaatggcgtgcaggaattttactttcaatcttagtaacaactatcttggcccttttgactggtgtagttaaagttgatgtgaatactttatttgctgaaaacaacttaggaacagctatcaatcaaatgagaacaacctttggtgctgcttttggtccaaaaggttttggctctttattctcagactcatcacgttatattgaagttttgatgacagtccttgctttctcattgacatctatctttgacccaattggtacctttatcggaacaggtcgcgcaacaggaatctttacagatgaagatttgaaagatatggaaacaagtcatggtttctcttctaaaatggataaagccttgtttgctgacatgattgccactccaatcggagcaattttcggaacatcaaatacaactgtttatgtggaatctgctgccggaattggtgcaggaggacgtactggtcttgcatctgttgtaacagcaattatgtttgctatctcaagtttattcttgccacttcttgcaattgttccaacacaagcaactgcgccaatcttgattattgttgggatgatgatgcttggttcatttaaagaaattaaatggggtgatttgactgaagcaattcctgctttctttgcctcagtatttatgggacttgcttactcaatctcttatgggattgcagctggtttcatcacttacattctggtcaaactgttcacaggaaaagtgaaagaagtaaaacctgtcatttgggttgttgcacttttattcttgattaacttcgctgttttggcagtgctataaacattgaaaactcatcaaaaatttttgatgagttttctttttagaatttctggattataatgctagaagtataatcattctttcaaataaaacaaacttactagttattggaatctgataaaattgaaatggaaagaaaagacaaataggatattcaaaataaaagtaataaattacgaatatttaataaattgtgttaaaatctaatcatgaaaaaaattatttctcttatcgtgagtttttttgcagtctttgttatcggtatattcataggccattctattcttccaccacacccccttgtagcagcaaaagaccgtcctatttatccgacgatttatattactggctcaagtggttatgcgtcaacgatggatacaatgattaatagcgttactgcagacaaagacacccgtgctaaaaaagggctgacaattgtcgttgatacagagcataattattcgcttaaagtgactggaacaattgacaaacgtaattcctatccgacaattgaggtcggaatggtcaaaggaactaataattccaataaatatgaaaaatcattaatggctatcatgtcttatctgggtaagcagtataatgttgcttatgccaatgttttgggttactcagctggtggcggtggtgtttaccattatttaattgaccatggttatgaccggagccttccgccaattaaaaaatttgtttctcttgatggtcagtacaatgcttgtacaacacaacctgaccaaacgctggcacaagttcttgctgatggaccaaaaataaaaacaaaatactatgatttttggttacaaaattatgaacgtgtggataaaaatatccaagttgttctactagaaggagcttatgatactaagaaagaaactgacggtacagttccttgggctgacggcttctcaatttatcctttattgataaaaaatggaaattctgctactcattatctaattgaaggaccgaacactaaccatactgcaatgccagataatcaaaaggcaataggctatgtcaaaaccttcttttatgaataagcctgatttaaaaatgctaaattgtccctatttggggacaatttttttataatatatttactataaaatgtcaggtagtcagcaaatagtttatttaaagcatagagcctgatgtattgacagttggctttaagtaacggtataataaaattatggatttggaaaatggaatatttatttttggaacagttctaacaatattttttgcaggattgaccttgattttttggtggaaaatcagaaaactgaaagatttaagaactttacgattagggcgtttatctttttttgctttactttttttgtgggtgactattaatggaattattggttcaggattagtattaaccgaattgcatcaaaatgtacttttattattactcattgctgaagcagttgtgatgttcttaatcataccaatgataatcggtattattgtacctataagtatcgttgtgttaacaataaagatgtggcgcagagaatcaaaatcgatagggaatcttttattgcctattgttgtgttgacctttttagtagttgactggattcatctttcaatggggagattaccggatagttggatttggttaaaaatattaggaatggtttatcccgttctttcaatttatcttgcttggcaatttggaattttctttttatcaagttgggtctatggtcggcgtgttcgaaaacaaagagcaaattactatgttgtcctaggcgcagggttaattcagggagaacatgtgggtaaattgttaggaaatcgaattttggcagcggtcaaagctgtccgcgataatgaaacaattttagttttttcaggtggacaaggtcctgatgagaaagtttctgaagctagagctatgcaacggtatgcggttgaagttcttggttttccgattgagcggacaatgcttgaagatcaatcaagaacaacatatgaaaatttagttttttcttctcaattgattaaggaaaaatttattttcttcacttctgattaccatgtttttcgagcagctctttttgcagcaatgttaaaacttgaagctcaaggtgggaagggtggaaagacagctatgtattatcgtgttccagcttttattcgtgaatttattgctgttttaaattatgaaaagaaaaaacatatgatacgagtaggaatcattgtggctatctttttgagtattgctattgtttcacaaattggctatttttggaatcaaagataataaaaagttactgacaactttctgtcagtaacttttttggttacaaataaatacttttttcgtatagtaagatatgttgacagcaattgatgaaaatggacaagtagtaaacttattagaaatagaagtaaaagaactgacaggaaaatatttttgtccttcttgtaaatcagagttatttataaaaaatggtgaaataaagatgcctcactttgctcataaatctctcaaagcttgcgacttatggcttgaaaacgaatctgaacaacatttaggattaaaaaaagcactctatcaatggtttaaaaaaactgataaggtggaaattgaagcttatattcctgaatttaagcagaggccagatttattggtaaatgataaaatagctattgaaattcaatgttctcatctttctatgaaacgtttaaaagaaaggacagagaattatcaagtccacggttttacggtgctttggcttatggggcaagatttatggttaaaagaccaaataacagaacttcaaaaaaatctagtctatttttcagaaaatagaggtttctattattgggagttagatttcaaagctcagaagatgagattaaaatccctgattcatgaagaattgcgtggaaaaattatttatttaaaagaagaaattccttttggggaaggacgacttattgagcaattacgactgccttttttatcacaaaagttactgacaataccacttattgttgatcttaaactagcggaatttattcgtcggcaactttattattgttcaccaaaatggttgaaacttcaggaaaaatattaccagagaggtgaaaatttgttgaatttgacttttgaacgttcttttattgcgcctttgggattgaacttacttgaagtttttgatgataaaattcctttacataaatttactcaaattaagcagaatattaacctctattatgaaaactttttaataaattttcagcaaaatagctttaaggcagtctatcctccccgtttctatgctataatgaaaaagcagaagaaggatatgaataaatgaaattctgctaataagtttttaatgtgaataaaaattattttgagtaaaaaggagtgatcttcatggctaagaacagaaatgaaattcctgaaaaattaacttgggatttgacaacaatttataaaacagataaagaatgggaagcagagctaactagaataaaaagcgaactttcactcgttgaagagacggatcctggtcatttacttgattcagctgaaagtcttctgataattaccgaaaaaatgctatccatttctcaacaagttgaaaaactatatgtttatgcttcaatgaaaaatgaccaagataccagagaggctaagtatcaggagtatcagtcaaaagcaacagccctctatgtgaaattcggagaggtctatgccttctatgaacctgagtttttgaaaatttcaaaagaagtctataacaaatggttgggggaacttaaaaaattaaaaaactatgaccatatgtttgagcgactttttgctaaaaaagctcatattcttagtcaaaaagaggaaaagttattggctgcggctggtgaaatttttgaaagtccttcagaaacttttgaaatttttgataatgcagatattaagttacctatggtcaaaaatgaatctgatgagatggtccaactcacacatggaaattactcttccttaatggaaagtaagaatagagaagtacgaaaagcagcctacaaagcactttatagtaattatgaacaatatcagcatacttatgcaaagaccttacagactaatgtaaaagtccataatcttaatgcccaaatccgctcttatgattcagcccgtcaagctgctctggctaataattttgttccagaaaaagtttacgatgttttgatggaggccattcatcaacatttgccacttttacatcgctatattgaactacgcaagaaaattttaggaatttctgatttcaagatgtatgatatctatactccattatctaatttagattataaatttaactatgaagatggagtgaaaaaagcagaagaagttttagcgatatttggtaaagaatataaaggaaaagttaaagcagcttttgaacaaagatggattgatgtcgaagaaaatatcggaaaacgttcgggtgcttattcaggtggatcttatgataccaatgcttttatgcttctcaattggcaagaaacgttagatgatctttttactttagttcatgaaatggggcactcaatgcatagtgctttcacgcgtgaaaaccaaccatatgtttatggggattatccaatctttttagctgaaattgcctcaactacaaatgaaaatattttaactgaaactttattaaaggaaagtaaagatgataaagagcgcttcgcccttttgaaccactggcttgatagtttccgtggaactgttttccgtcagagtcaatttgccgaatttgaacaaaaaattcatgaagcagatgctgccggcgaagttttaacaagtgaatacttaaactcactttatggcgaaataaatgaaaaatactataatttagcagccaaagaaaatccagaaattcaatatgaatgggctagaattccacatttttattataatttctatgtttttcaatacgcaacaggttttgctgcggcaactttcttagctgaaaaagttgttcatggttcagatgaggatcgtcaaaaatatcttgaatatttgaaggcaggttcctcagcttatcctttagaagtaattgccaaagctggagttgatatggaatctaccgattatttagatgccgcctttgagctttttgaaaatcgattgagtgaattagaaaaattagttgaaaaaggagttcatctttaaaaatggttgaaacatataaacgtacaagtaaccccatgatgaatcgaccagttgtcaaagcagaattagtagaatggatgcgttcaagtcaaacacaaataaccggagaacttgcagaagtactgaaatttgctaaagaaaataatattccagttatcccacatgagacagttatttattttcaaatgttgttgagtttgttgcagccaaaaagaattctcgaaatcggaacagcaattggtttttcggctctcgtgatggctcaagaggttccaaatgcggagattgtaacaattgaccgtaatcctgaaatgattgagttagccaaaaaaaatctggacaagtatgaccatcgaaaccaaattattcttaaagagggcgatgctgcagatattttgaaagagttatcgggctcatttgatgtaatctttatggactcagctaaatcaaaatatatcgaattcctaccaactgctctagatttactatctgaaaatggagtgattttaatggatgatatttttcaaggtggagaaatattgaccccaattatggaaatcaaaagaaatcagcgggcgctagagcgtggcttacgcaagctttttgatgaggtcttagataatccgaaatatttaacaagtattctcccgcttggagatggcttgttgatgataaaaaaagcataaattaaacttttaggttgtcaattcgctgattcattttttggtgtatttaaagctttatttaattttttatgatataattgcaacaagttaaaaataaaaggatgttttaggacatattaactacaaacatcgaatcatgcgaaggagaatatcttgaaattcaaaaaactcggattagttatgactactgtctttgccggagccgcattggtaaccttatctggttgctcaagtagcgattcagcaagcaaggatatcatcacaatgaaaggtgataccattcgcgtttctgatttatacaaggaagccaaacaatttccatcacaaccgacaaatacattacttcaaaatttaacttttgacaaaatttttactaaagactttggaaaagaagtaactgataaagatgtcagcaaaaaagttaagtcaattaaagaccaatatggtagccaattttcatctgctttgcaacaacaaggcttgactgaagcaagtttcacaccatacatgcgtacacaaatgcttgaacaagcagcgattgaccatgaaatcaaagaaactcaatatacagatgctaaccttaaaaaagcttgggaatcttaccatccagatgtaacagcttatgttgtttctgaaacatcaaaagatgcagcaacaaaagcgttggatgccgctaaaaaagatgatgctggtaaagcaagctttgaaaaaacaaatgctgaaagcaaagtaacatttaattcaacttcaacaagtgttccaacagaagttcaaacagctgctttcaaattgaaaaatggcgagttttcagatgtcattgaatctacaagttcatcaacaggtgctacttcttactatattgtcgaaatggtaaaaacatctgaaaaaggaactgacatgaacaagtacaaaaaagaacttcaaaatgtcattaaaactgaaaaagaacaagatacaacatttgtaagtggagttattgctaaatacctcaaaaagaataacgtaactgtgaaagaatccgcatttgcatcactcttctcacaatttacacaaacatcaagttcttcatcatctaaataatttagataatagaaattaactttaaagagagctctaaatggtgagaatgagcaagttaaaaaaagtgcttatagcagcgataactgctttaacaaccgaactaagatgatagaaattctatcgtgaataagggtggtaccgcggtataactgtatacgcccctttgtttacggtagaattttattgttttattgtgaaaatattaacaaagtatatgaaataagtttattgttagactttaaactttatataaaaggagaaaataatgaaaaccatgacttccgcagaagttcgccaaatgttcctcgactttttcaaatcaaaaggtcacactgtggaaccttctcaaagtcttgttcctgtaaatgacccaactttgctttggataaattcaggagtagcaacgctaaaaaaatattttgatggttcagtagtgccagaaaatcctagattgactaatgctcaaaaggctatccggacaaatgatattgagaatgttggtaaaacagcacgtcaccatactatgtttgaaatgctcggtaacttttcaattggtgattatttccgtaaagaagcgattgcttttgcttgggaattattgacaagttctgaatggtttgaattcccagcagaaaaactttatatcacttattacccagctgataaggatacttataatcgttgggttgaggttggggtagacccaacacatcttgtgccaattgaagataacttctgggaaattggtgctggtccttctggtccagatacagaaattttctttgaccgtggagaagtttatgatccagaacatgtgggcttaaaattgttggcagaagacattgaaaatgaccgttatattgaaatctggaacattgttctttcacaatttaatgccgatccatcaatccctcgttcagaatatcctgaattgccacaaaaaaatattgatacgggaatgggacttgaacgaatggtttgcattattcaaggcggaaaaacaaactttgatacagacttattcttaccaatcattcgtgaaattgaaaaactatctggaaaaacatatagtccagacagcgaaaatatgagtttcaaagtgattgctgaccatattcgctcactctcatttgctattggtgatggtgctttgccaggaaatgaaggacgtggttatgttttacgtcgcttacttcgtcgtgcggttatgcatggtaaaaaattgggaattcaagggaaattcttggcttcactcgttccgactgttgggaaaatcatgcaatcctattatccagaagtgcttgaaaaagaagacttcatcatgcaaattattgatcgtgaagaagaaactttcaaccgcacgattgatgcgggtcaaaaattgattgatgaacttttggtaaatcttaaagctgaaggaaaagatagacttgaaggagcagatattttccgcctctatgatacttatggtttccctgtggaattgacagaagaattggcagaagatgaaggattcaaaattgaccacgaaggattcaaagtagccatgaaagctcaacaagagcgtgcacgtgctgctgttgtcaaaggtggttcaatgggcgctcaaaatgaaacattgtcatctatcgaagtagaatcagaattcctttatgaagataagactgctcaaggaaaattacttgttgctattcaagacgatgaaattgttgatgaagtttctgggaaagctcaacttgtttttgatgtgactcctttttatgctgaaatgggtggtcaagtggctgaccatggagtaattaaagatgctgagggtcaagttgtggctaatgtattagatgtacaacatgcgcctcatggccaaaatcttcattctgttgagactctttcaccacttaaagttggagaaagctatactttagagattgacaaagaacgccgagctgctgttgtgaaaaatcacacagcgactcacttacttcatgctgctttgcataatgttgttgggaatcatgcattacaagcaggttcacttaatgaagttgaattcttacgttttgactttactcactttgcacaagtgactaaagaagaattggctgagattgaacgtcaagttaatgaagtaatttggcaatcattaaaagttgaaacagttgaaactgatattgctacagccaaagaaatgggagcgatggccctctttggtgagaaatatgggaaaaacgttcgcgttgtaaaaattggtgactactctatcgaactttgtggtggaacacatacacaaacaacttctgaaattggtttattcaagattgttaaagaagaaggaattggttctggtgttcgccggattattgctgtaacaggtcaaaaagcttatgaagcctttaaagatgctgaaaatactttgaatgaagtagcaacaatggttaaagcgccgcaaacttcacaagttttagcaaaagttactagcttacaagatgagcttaaaacagctcaaaaagaaaatgatgctttggctggaaaacttgcagcaagtcaatcagatgaaattttcaaaaatgtgcaaacagctggttctctcaactttatcgccagtgaagtcactgttcctgacgctcatggtttgcgtaatttggcagatatttggaaacaaaaagaactttcagatgttcttgttttagttgctaaaattggtgaaaaagtaagtcttttagtagcttctaagtcatcagatgtaaaagcaggtaatttagttaaagaattagcaccttttgttgatggtcgtggtggtggaaaaccagacatggccatggctggtggttcaaaagcagcaggaatttctgaacttttggccgcagttgctgaaaaattagcctaaaaagataaatatcgtagattttctacgatattttttattttctggatatgagtcagtaaatttttatggtaaaatgatgaaaatacttgaaagagatgcctaaaatgaagattacaatttttggagattcaattaccaatggttttggaatggatgaagggggttcgtcaaatattattgcaagattaattgagaaaaatgagcccaagctgaaagtggtacttcatggaattaatggagatgatacttatggtggacttctacatctaaaatacgttctagaggaagaagcggacttaaattttattttttttggggcaaatgatgcttcaccttatcatttgattcgaccggcagaatttcgcgaaaatttattaaaaatgatttcgcagttgggtgtagaaagaacggttctaattactcctcctttttataatgatgatgaaccaacacattatagtaagctttccgaggttgaactttttagagaagtcacattaaatttaggcaaagaaaaatcgcttaaggtgattgatatttttcagataatgaagagctctgaaaatcctaaaaatttgttgagagctgatggtttacattttacatcaagggcttatgagttgttggtcagagagattttatctgtcattaaaaatccttaaataaatgttcattttgtggtaaaatgagggcatggtaaaaaatacagaagataagcctttagctcagaacaaaaaggctcggcatgattatgaaatttacgaaacttttgaagcaggaattgtgctgacaggaacggagattaagtctgttcgtcaggcaaaaattcaattaaaagatggatttgccagagttcgtaatggagaagtttggttatcaaatgttcatattgctccttttgagcagggcaatatttttaatgttgaagaattgcgtacgcgaaaactattactaaataaaaaagaaattgctaagattgataaggaattatcagggacaggaattacttttattcctttaaaagtttatttgaaaaatggctttgctaaggttttgatggggcttgcccgtggtaagaaagattacgataaacgtgaaacgctcaaacgtaaagaacaaaatcgggatattgcaagacaaattaaagcttacaaccgttaaaaaaaatcactgataaatctgtcagtgattttttactgacagaattggcatcttgctgataattcttttatttacagctaaaatatgccttctttgtcatattttattgacagatttaccgtcagtaaaaaagttttcaagataaaaatatcgtttacaatccatttaccttgtatttactaagtgtttacacccagtgccttctttcgatgatagaatagttttgtaagcaaaaacgcttaacaacttatttagaaattaattggagaaacttctcatgaaaaagaaaattcttgttggtcttattactgctggtgcattgttaactttggcagcttgtggttcatcaaacggctcatcatcaagtagctcaagttcttctgacaaagctctgtcaggaaaaattattgctggaggttcaactgctcttcaaccattagcacaacaatcgtcaacagaatttatggcaaaaaatactggtgttcaagtgactgtgcaaggtggtggttctggtgttggtttgacacaagttgcagctggttctttccagattgggaactctgatatttttgctgaagaaaaatcaggaattgatgcttctgcaattactgaccataaagtagcagttgttggttttgcaccgattgttaacgcaaaaattgatgttaaaaacttaacttctcaacaattgcaagatgtcttcacaggtaaggtgacaaactggaaagatgtgggtggttcagaccaaaaaattacggttatcggacggactgagggttctggaactcgcgtaaactttgataaattcgcacttggtggagcaacagaagttaaaggcccaacacaagatgcttcaggttcagttgttcaaatggttggtcaaacaccaggagcgatttcatatgtggcactttcttatgttgatacaagtaaagacatcaaagatatttcaattgatggtgttgagccaacagaagcaaatgtcgtaactaatgactacaaagtttggtcttacgaacatatgtacaccaatactaagaaagaaactgcagcagataaagctttcattaaatatgtggcagaaaacaaaaaagacatcaaaaaattgggatacattccaatcagtgacatgaaagttgaacgtgacgctgacggaaatatcactaaaaaataacactgacagtaagtcaatttcaaaataatttatgtctgtcagtaaatttaacaattaataaattagtttataaccataggattcaaagcaataaaaattttcttcttcataaattaaaatttaaaagtttgactccttttttataaaaattttatcagtgaacataaacaggatgaactgatgaaagactatctttaaatttttcttcataattctttccctaaaagacaggaaattgctcactctttttcagagttgggcattttcccgtattatttacaaaacatttacataagaacgctatcatcaaccgctcattgataggtcattatggtataattaagctatgaagaagaaaatttttattgctttgatggccagtgtgagtttatttgcattggcagcttgtggttctggaaataaacaggtcacagcgggtggctcaactgccttgcaacccatggttgaacatgcttctatggcatatatgaagcaaaatcctgatgaaattattatggttcaaggtggtggttctggtgtcggattggctcaggttgcggctggttctttccagattgggaattctgatattttcgctgaagaaaaatcaggaatagcagttgataaaattattgaccataaagttgctgtcattggttttgcaccaattatcaacaaaaagttaaaagtttcaaatttgactcaacaagaactgattgatattttcactggtaaaattaccaactggaaagaagtaggaggtcaagaccaaaaaataacggtcattggtcgtactgctggttcaggaacgcgagtaaattttgataaatatgctttgaatggtgccacagaagtgaatggtccaacccaagatgcttcaggttctgttgttcaattagttgggcaaacgccaggggccatttcatatgttgctttcagttacaccaataaacctggtgtaaaggcggttaatgttgatggtgttgcgccaaattatgataatgtaaaaactaatgcatggaaaatttggtcatatgagcatatgtacaccaataaatctcgtaagaacacaatcgaaaataaatttatcgaatacgttcaaaatgataagaaaaccctagagcagcttggttatatccgtgtttctgaaatgaaggttgaccgtgatgctaaaggaaatgttgaaaaaattaaataattactgatggaaattaaacttatcctccgtcagtaaaaaaattagtcaaaataagtttaatcaataacttcatttgcattaatcagatagatgcaaattaacaaaaatagttaggtccctatggaaaattcaaaaatcaaagaaaaattgctttcaagcaataaaaattcaagacttgaaaaatttggtaagagtttaactttcttatgtattgcccttattgtcttcgttgtaggtgcaattcttgtctttgttgctcaaaaaggtctgtcaactttctattcagatggtgttaatcctttccgtttcctttttggaacaaattggtcaccgggtaatcttggccctgacggtaaacccgcagttggcgcattgccgatgtttacggggtcattgattgttactgtactttcagcccttgttgccactccatttgcgattggtgcgggaatttatatgacagaaatttcaccaaaatatggtaagaaaattttgcaacctgtcattgaacttcttgttggtattccttcagttgtttatggcttcattggtttgactgttgttgttccagccattcgtaatgtttttggtggaactggtttgggtctcttgtcaggtgtgtttgtactctttgtcatgattttaccaactgtaacttcaatgactgtggatgctatgaaagctgtcccttcttattataaagaagcgtcactcggacttggtgcaacgcgttggcaaacaatttggcgtgttcttctaagagccgcaacaccagggattttgaccgctgttatctttggaatggcgcgtgcttttggtgaagctcttgctattcaaatggttgttggtaatgccgttaccatgccaaaagatttgatttcaccagcttcaaccttgacttcaatcttgacatcaggaattccaaatgcaacacctggtattcaattgaatgcactttggtcacttgccttactccttttgattatgtcactctttttcaacctcgcaatgcgtgctattgctaagaaaggaagtcttaaataatgaacgctaaacgctctgacaagattgccactggtgtcctttacgtcctttctggcatcattgttcttatcctcgcttttttactggcttatattttaattaaaggtttgccagttctctttaaagaccctaaatttatcatcaccgcgtcaaatccattgacaggtggtgggattgcagtccaactttttaactctgtttatcttttgattgtcactttgattatttctgttcctttatcacttggcgcaggaatttatctgtctgaatatgcgaatcaaaaacattggttaactggtgttgttcgctcagctattgaagttttatcttcacttccttcaatcgttgttggacttttcgggatgttaattttcgtattacaatttggtcttggtttctcagttctatcaggtgccttggcactaactgtgttcaacttaccattgatgactcggaatgttgaagaatcacttcgagcaattccaacttcacaacgtgaaggtggtttggcactcggaatgtcacgttgggaaacggcaacacaagtcattttaccagctgctgtgcccggaatcattactggggttatcttatcttcaggacgcgtttttggtgaagctgcggcactgatttacactgctggacaaacgaacctcccaattaactgggcaaactggaatccgatgagcttgacttcgccactctcacttttcagaccagctgaaactttggctgttcatatctgggcacttaataccgaaggaacgatttcaacagcacaacaaatttctgcaggagcttcagcagtattgattatctttgttctcctctttaacttgggggcacgtttccttggaaatcgaattcacaagaagttaacatcttctaactaagaaaatcaaagattttatagagaaagaataattatggcaacaacatatgactggtctcagcgcaaaattatggtgcctgagaaagaagaaattgcattatcaacaaatgatttgcgtgttttctataacggaacaaaagaagcaatccatggcgtgacaatgtcttttcctaaaaatgaaatcacagcacttattggcccttcaggttctggtaaatcaacctatttacgtgctttgaatcgcatgaatgacacgattgatggcgctcgggtgactggcgaaatcaattatgaaggggtcaatattaacgaaaataaagtgaatgtttttgaagttcgtaagcaaattgggatggttttccaaagacctaatccatttccaaaatcaatttatgaaaatattgccttcattcatcgtcgtgatggcgtgagagacagaaaaaaactggatgagattgttgaaacttcattgaagcaagctgctttgtgggatcaagtaaaagataatcttaatcaatccgcacttgccatgtccggtggacaagcacagcgcttatgtattgcaagagcattgtcagtaaaaccagaaattattttgatggatgaaccagcgtcagctcttgacccaatttcaacaatgcaaattgaagaaacaatgatggaacttaaagaaaattatacgattatcattgtgactcacaatatggctcaggcttctcgggcctctgacaatacagctttcttctattcaggagatttgattgagtatgataaaacaagcacaatttttactcaacctagtttgcaatcaacagaagattatgtttctggtcactttggttaagagaaaataaagtttaaaattactgacggaattttcgttagtaaaaaaactactgacggattcttgatttgtcgaaaaacttgtccgtcatatgacagtcgtttgtactttagtacattacgaatgtgctagtagttctatcagtaacttataaaaaggtaaaatatggaaaaagaagcagttttaaccgtcagcgacttatcgctttattacagcaagaaaaaagcgttgaatacgataaacatgacattctataagaatgaaattacagcgctcattggtccctcaggatgtggaaaatcaacgcttttacgttcaatcaatcgaatgaatgatttgattccgacagtaacaattactggagccattgattataaaggtaaaaatatttacagtcctaaagttgatactgttgatttacgtaaagaaattggcatggttttccaacaacccaatccctttccattttcaatttatgaaaatgtggtttatggattgcgtttaaaaggagtgaaagataaagcacttcttgatgaagtggtggaaaattcactcaaagcagcaaatatttgggatgaagttaaggatattttgcacagttcagcacttggactttcaggtgggcaacaacaaagggtttgtattgcccgtgtccttgctgtcaatcctgaaattatcctaatggacgaaccaacatcagcccttgacccaatttcagcggctcgtgtcgaagaaaccatgcttgaacttaaaaaagattatacaatcgcgattgttacacatagtatgcaacaagcatcacgaatttcagaccgtaccgcctttatgttagacggaaatctgattgagtataatgatacgaaaagtattttcttaaatccagaaaaacaagaaacttctgattatatttctggtaaatttggataaattttactgacagcctttgatgctgactttaaaatggaatggaccgtctagccaaaaggtgaagcgagatatttcattagcattcattaaagaaagcgaaatagcattgatttaaatgaatgtatcataataacattactataaaaacaaagaggggtaattatgttgcgtacacaatttgaagaagatcttaataaacttcataatcaattttactcaatgggcacgcaagtttctgctcaattgaataaggccgttcgtgcctttgttagccatgatcgtgatttggctgaacaagtcattgaaggcgaccatgccattaatgaccaagaaaaaagtcttgaaaatcaatcattagaaatgattgcacttcaacaaccggtttctagcgatttaagaacaatcatcaccgttctaaaagcatcatctgaccttgagagaatgggtgaccacgttgcatctattgctaaggcaaccatttcacttaaaggtgaagaaagaattcacgtggttgaagaagatattagcttactcggtgaaaaagttaaatctattgttgatgcttcactcaatgcttatattcaaggcaatgataaacgggctcatgaaattgctgaacaacaatatgtcatcaaaagcatgagtcatgaaattcaagaaaaaattcttgacggaatgaaagaaaactctgaaacagtaacaacaggtaaagaatacttgttgacactggtttacttagaacgaattaccggttatgcggtcaatctctgtgagtggattgtttacttgaattctggaaacattattgaactgtaaaataaaaagttactgacaagaattgctgtcataggatagtcgtttgtactttagtacattacgaatatcctggcagttctgtcagtaactttttttattgctcataatcaatttcaatgacttggtgggtcagatatttattttcagcaaagtccattttgatgacatagggcatctttccagctaaagattgaaaatcttgaaactgaaagtctggttgataaaaatttaaaatggtagaaagagaagtaccatgtgttccgattgcaactttttgattgttagaagttgctaaaatctgttcaagggctgaaatattacgattttgaacttcacgtaatgattctccgtcagcaaatttataatcaaaatcattccattgtcgcttagcaaagggccaaaaatcagctatttcatggccaacatttctttctctaaaatcagaaatgagttgaatttcaagatttttagagtgagcaagaggattcagggtacgaatagaacgttgaaatggactggaaaaaatttgctcgattgatacatttgcaaaagcatcggccaagataagtgcgcgtttttcaccctcggcagtcagcggaacatccatatcgtcataggctgcattatctctaagagaatgtcgaataaaataaacttcagtcatgtgactctcctttttgatgttctagccttctaagatttcaatttttaaaggctgtgtggaaatttctgcttgccctcccagaggaaaagtaaaaatcggttgagtatgtccaaaatcgacatcatagacgactggaattgtttttaaatgaggatatttatctaaaataaagtgtaaaatttcctcggtcatcccctcttccttaggaaaacgaccaatgactaaagcggaaatgttaggataaacttgtaaaaaatgagctaattctcggtcccaatcataaaaatcttcaccttcagcgttttctaaaaaagcaattggttgattggatttgacctgagcactggttcctgtcacaagcatcaaggtatttagatttccgccaataatttcccctgtcgctttgccatggttatatattttccaggcagcaggcagaagatgacgagcttgagtggggtcataccaagcatcactcgtgtaaaaatcgcaggcatttaaagaataagttgactgaccagcgactgcattttgccaagaatcagtttgaaagtcttgtaattcatccattaaaaaggcgatataacctggcccatagtaagtgactaagccggttttagcgaagacagcttggtgaagaacagtgatatcagaaaatccacagaaaattttaggattattttttacaatgttccaatcaatataaggaagaagttcatttgagttaaagccaccaatggtacataaaacagctttaacattagggtctgaaaatgctgcatggaaatctgcaagtcgtgaattaatcgaacttgattcaagcaaatcattttctaaaatatgctgaccaaaagtaacctgataaccaagtgcttcaagacgagcttttgcttttaatttatcttcaaattttccagtccgagtcaaagaagaactaggtgaaatcacacggatttcatccccctcttgtaattttttaggaaatattttattcatttatcaaagccctccgtcagtaaattgaactaattatagcatttactgacagcattgtcatcaaaaatatttaaagattttaatttaggattatattttgaaagttgctgacagaaatttctgtcagtatttttttatgttcgattaacttttggaatatatgacaaaagaaaaataaatacatttttttaaatcgttaaccaaagatactgtgtaagaactgacgataatataagaaaataaaaaaactaagaagacgttataatccaaggctttcgagcaataaaatcatcttttggcatatattccaaaactttttcacagaattttcagagtgctataatgaagttgccagtttaaaaactggagataaatttaatattaatcaactaccataaaaagaaggtaataaaatgaatagtaaaaaaataattgaaaaccccaaaaataaggaattagtgcaaacggacaaaattcttgaagtctttgcctgttcggcggctaaaaaaagtgtgcaaaatttacctatggccgttgttaagaaagaagaaattggcgcctaaataataaaacaagaaaatgtaaaaagagatatttttacttttgaataaaaaggttgattaatattctgagttttattgtaacgctaagagcaaaaataactttattttcacattttcttgttagattttaaggagtaggtatgtatagatataatagaaaagacggaaaaatagttttagtagatgaattcacaagaaactatgtttcttgttcagatgtttcaaggggggagaaaaaacttgattctcaacctagaatatttaataattataattcgtataatgcatacattaaccaaattgatactttaagtactgtctactataatgttacttactcatgtaatttacattgtccttactgttatgcacccaaaaataaaaattatatttctttagaaaataatagattatttttaaataaactggtgaaattaaatactcaaaatattgttcttatcggtggagaaccgatgatgcatccctatttagataaacttattgatgatatctataaggcaggtatacattcaatttcaataattacaaatggcactatattaaaaaaggaagttcttgaaaaaatcatagaatataagatagatatacaagtatcagttgacggacacacggaagaattaaattccccaaccagaggtaagggtagtttaaaaaaagtactatcaaacataaagattttacaagataatagtgtaaattatgcggtaatgcaagttttaacaaaagaaacaataaaattttcaaaagagttttctgattatttttcaaatatgggaatagcacacggattttttcttgtaaaacaggcaactgataaagaaagacccaccttaaaaagtattgttaatttatacgattttttattaaaaaaatatggagaagtacaaaaagtttttgattgtgcgaagtcttccgaccaaatgcaatttgataaaacaggttttccaataacacattgtggtgcaggaataacgatgttaagtatagatccacttgggaatgtctatccttgcgttaaattacaccgttcatcatttcttatcacgaatttattaaaagaaaattcgggagatgaaatacttatgaatagaaaaagagtaattactgaagaattagtggataatttggataagtgtcaaagttgtaatattaaatacatctgtgggggagcttgcagagcagaagagtattatcaaagcattcatagtgaaaataaatattctcagtgtgacttacaaaaaactaacttagaatatttcatggagcataccaatgtataaaaaaatgtctttatttcttggaataaatctactagtatcatttgctggcactttgtttcagatgaatattctttggagaatttttaccaatcatgagcaacttcagaccattgttcttgttttaagctcatcttttattcttcaatccattttttcacttgtagctggtgtaattgctgactcctatcctaaaaagagattattattgataagtattgtcagttttattttggttgttattggagtttatttcataaaatttgatagtgctcgaattattttttatctcatcttttcggcaattagtaccttattccagcgtggaatcattacccttgttgtctcagctctatcaacgaatgaatatataaaatatgactctatcagcgttttatccacacaggtcacagcagttttaaataatattttagcaggtcttattattacttttcttggactcaattatatttatcttttagtgttcttgctatttattttgtccctatttgtgacttatttctttattcctaatgaaaaaaagcaggagataaagaaaaaataaaatacttttcctctctcgtttattaaagaaaaaatattgtcagataagaaaataattattttcatgattcttctatttttcttaaatttagattatggatatattccaaatgtcctaccttttttcatgttacaaagtacaaaaagtctttctcccttgtttttatcattattaaagtcctccactaatataggcgaaagtttggcatctatcgtcattattcgctttagtaaaaaagtctcacaaatgacgaaaattggtcttttaggttcagctttttgttttatttttttgccaatgattaataaatttatatttgttacctttcttgttctccttttttatggattttttgatacctttactcaacccttgtttagctattttgtaagttctattgattcctccgttcgtgggcggattattggggtcattgattgtgtcgtctatattgcagccctattggaatgattcttggaaatgcagttagccattttggtttgattccacttggagctgcaatagcgactgtatttttactgacctacctgatactagttcagacaaaaatttatcgaaatattgatttagaggcaaataatgaatctgaataaaaagttcctaaaaaacgagttaatttggctaacttctataggctgtgaaattattgaaactgattcttatattatcgtgaaaaataaactgattaaaacagaggattttaatttcttattattgaaaagaataattcctgagataaaaataataaaaataatgaaaaatcaccatttacaatttttaaaagttgctgagaagattgtatcatatacgaattttattaaagagcggactgaagacattaactatgtcgcaaattataatagagaagctttagattttctaatgaaaaaaagtgataatttgtatatatcctcagaaaaaaagtgggcggtcatatttccacaagaaagattattttcaaaaactattgttccttatacgatttgttggggaagtgataggatagggaaaatttgtctagtatttttagatgatatcattggaatttacgattttgaaatttatcctccatttagaaataaagggtacgctaagcagttctttagttccttattagataaaggtagtagtagtcaaacacatcaagtctttattcaaacttggcgtgaaaatatttctgctaataatttatatttctctcaggatttcaaagttttagataaatactattatttcaaacttaagaatttttattagcaatagttgaatcacaagattactgacagaaattttgtcataggatattcgtttgtactttagtacattacgaatatcctagtagtcccattagtaatcttcaacaaaaaaatctactaacaagtccaaaaaatttctgtcagtagattttttaattatttaatcacttcaagtccacccatataaggacgaaggacttcaggaacagtgattgaaccatcttcattttgataattttcaagaatagcagccacagtacgtccaacagcaagtccagaaccattcaaagtgtgaacaagttgaactttaccctcttcgtcacgataacgaatttgggcacgacgggcttggaaatcttcacagtttgaacatgaagaaatttcacggtaagtattttgtgcaggaatccaaacttctaaatcataagttttagcagcagagaatcccatgtcaccagttgacaaagccacaacacggtaagcaagccccaatttttgcagaatattttcagcgtttgctgtcattttttcaagttcatcataagattggtcaggtttagcaaatttaaccatttcaactttatggaattggtgcaaacgaatcaaaccacgcgtatcacgaccagcagaaccagcttcagaacggaaagaaggactcattgctgtgaatttgattggcaattctgcgccatccaaaatttccccacggtagtagttggttaaaggcacttcagcagttggaattaaaacaaaaccacggtcatctttcaattcaaaagtgtcttctttaaatttaggatattgacccgttccaaacattgattcttgattaaccatataaggagtaatcatttcagtataaccttctttaccgtgctcatcaagcatgaagttataaagtgcacgttcaagtcttgcgccagcacctttgtagaaaaggaaacgtgaaccagtgactttaccaccacgttcccaatccaaaattcctaaatcttcacccaaatcccagtgagctttaggttcaaaattgaaagttggagtttgaccaacacgacgaacctcaacattatcatcttcatcagcaccaattggtgtactttcatgaggaagatttggcaatatgataatgatttcattcaagttttcttcgatttcagcaagttcagcatcaatggctttgatttcagcagaaactttttgcattgcagcaatttgtgcgctggcatcgccttttgcacgttttacttgagaaatttcatcagaaacgctattacgttcagctttcaaagcctcagattttacaatgagttcacgacgtttaatgtctaagtcatgaagtttttcaagtttctctttttcaacaccacgagtggctaattttgcagcaacaccgtcaaaatcagcacgaatttttttaatatcaagcataagctctcctttatttttatctaaaacttactgacaagaatattttagaaaaagttctgtcagtagaaaaaaagcgcccaaattcaaaaagaattagggcgcggtaatcgcacggttccacctaaattatctatttatttactgacgaaaactgatattcaagctgtcagtaaaaatagaactcaagtcgcttgtaacgtaagcagacgttctcattttcataagaaaattaacagaagtagaaagtcattatttcattttacttgttttcagcaccacaagctctctaaaaaaatttaataagacccatttctagatttattttaccattttgtgaattactttgtcaaaaatttttaaaatcataattttaaaatcaatcattactttttgaaagcgcgacggaaagggtcaagcaaactaggtgctctgacaatattttctttacccacatattcagcaacttttttcaaaatagatccggaatccttagaagaaaatcgtaccttagcttgagtgtctaaaatcaaagaaaactgctgaccaagttttccactgattgaaacatcaacttcggcgcttttaatacttgaccaagtaaagaaaatattttgtcctcggcgtggatttttatattcaaattcaaaaccagcatcacccaagataatttttccattttcaaccacacctaaataggctgttccttttgtttcataaaaaatttcagaattattagttgccaaaatcgccctcatttcgtttatacctgtattataacatatctatattatatcaagaactaaagaagataataaaaataggcccaacgagggatatggtttaaagaataaatataaaaatgttatcattagattataagaaaaaactaataaaggaggtaaaatgactttaatcggagtaaaaattgatagactatttctcagagatctattcatactattagttggtgtaggcctttatattctctctattcaactttttgtcgttcctaacgcgatggctagcaatggaatcgcaggattttcagtatttattcactttgttttcggaatgaatccagctttgactttttttgcagtcaatattccactctttcttttgagttggaaactacttgagcagcgggaattgttactgaccattcctggagcgctggccatgagcggatggatgatgatttatgaagccataggaattactggttttcaaatggactcattgattactgtgggaattatagacggaatcctctcaggaattggtgcaggtttagttgttctatcacaaggaacatttggcggctctattctacttgcgcgactttttgaaaacaagtggaaagtgcaaatagataaaacgctctttggtattgatattgtagttatgctattagcagtcgtgacttatcttgcccttccaaatttttttgtcacactcttatcttgttatatcttcagtaaagtcacacgtttcatcggacgaccctcataccgccaacaaattttacaaaaagttggattaataaaaaatgagtcaaactgttcttgcacaactaatgaatgttcttgctctaactaacaaaaaaatcccagattgggatttttattttttcttctttctcttaaaagcatttttaaaagttccgaggaaactaggggatttaaccactttatcgtttcctaaataatgacgaatccattttaaaacagttcctgagtttttcgatgagaatcgaaccttagagccattttgtaaaacgattgaaaattgtcgaccaacttttacctcacctttgagggattttgaaacatcaccctcaacacgagccactgccgtccaaggaaaagtcatatttttttcaacatttcggtcattataaaactcaaaagcaacatcaccaatcagaatttttccatattcagcaaaacctaaataagcaattccttctgttgaataatcagccttagtatttagtgattgagccacagattctctccatttcctagattaataatctaaaaaccattataccataaaaacgctttacttgccttaaatacttcaatttattagagaaaaataaaataaaaaaaccaatccaaagattgatttttttataccaaatcgattacatgatttgagcccaacgaccgaggatacccacgacgaagagaccaaagataataacgattggagaaacttttttcttaagcaaccacatgcaaaggaatgtgataagcaaaccagcaagaccaggaatcaattgattcaagttatcttgaaggtaagttacttttgtaggatcaagagaaagtttgttaccaacttgaccaagaatatcatgaagttgtgtaccagatacagaacctttagggaattctacataagcacctttttgtaaaggaatttttgaaacaacggcgttaggaccattaaagttaattgttacccaacgttgaatcaatacaccaaggacgaacataccaaggatagatgcacctttagtaacagtttggagaagtcctccaccaaggtctttagtgattgcagaacctgatttataaccaaattcttgagtgtaccacaagaaagcgatacggatagcgttccacacgatgaagaagaagagtggagcgataattgatccaccagtagccaatgaagctgcaatcgcaccaacgataggacgtactgtaaaccagaagacagggtcaccgataccggcaagaggacccatcataccaactttaaccccttgaatagcggcatcatcgatatcagcaccgttagcacgttcttcttcaagggcaagagttacaccgataataggagcggcaacgtatgggtgagtattaaagaattccaagtgacgtttcaaagcttctttagcttcttcgccagaagggtagagttttttcaatgctggaatgagcgagtaagcccaaccaccattttgcatacgttcgtagttccaagaaccttggaggaacattgaacgccacataacgctacgacggattttcttatcaagagttactttattttcagacattttttagatcctcctttcttagtagtcgttcaagatgtcgccaattgggtcacctgatgaagatgcagtaccatttccagaaccaccagaagcttggaggttaaggtaaacgatagcgataacaacaccgaggacaccagttgcaatcaatgttaattcagagattggtgcgagagcgaaaccaaggaagaagaatggccatacttcacgagtagccataaggttgataaccattgcataaccaacggcaacaaccatcccaccaccgacagcaagaccgccagagataactggaggaatagcagcaagtgctttttggatagcatctggtgagataaccaaaagaagtccagcagggatagcaatacgcaaaccttgacagataagcgcgatgaagtgccacatttcaacacctgagtatgaacctttttcagcagcacggtcagcttggtgaacgagcacaactgaaagcatacgtacaagagtagtcaatacaagaccagcagttgcaagcaagatagcagcaggaacgatagtacccatgatgtgagtcaagtcaaagttatttgattgaaccatcaagatagatgatgcgacagaggcaagggcagcatcgggtgcgacagcggcaccaacgttagcccaaccaagagcgatcaattggagtgaaccaccgaggataatccctgcagaagcatgaccggtaacaataccgatgagcgagcaggcgataattggttggtggaattgccattggtcaaggataccttcaagaccagcaaggaaggcaacaacaatgaccaagattacagataaaacaccgtattccatgttttttatatctccttaattatttggctgcctaatattcaattttagtaatcagaatatcagacgagcttattctgattattgtacgtcagctttgttaatcaaaccaaagaggtcagatttagagtcagctggaactttacgtacgtcgaatttaactccgaggtcacgcaatttttcaaaagtagcaacgtcatctttgtccatagaaagaactttgttgagcattgttttaccagttgagtgagccatagaaccaacgttcaatgtttcaattggtacgccaccttcgattgttgcaagagcgtcttgtggagtttcgaaaagaagaagggctttagtatcaccaaaacgtgggtctttagcaacttcaatcattttcttaattggtataacgttagcttttacaccagttggagccgcttgttcaatgagtttcttacgaagttcatctttagaaacggtgtcagaaacgacgatgatgcggtttgctcttgagtctggagtccaagcagttgcaacttgtccgtgaagcaaacgtgagtcaatacgagcgaggttaattttaattttaccatcaccgatgactgttccttcaggaatcgcaccttgaacagcagccggagcagctgcaacagcagtttcttcagcaggttgaagttcttcaggtagtactttaataccgcctttggcttctttcataatatttgctacgactttatccaccccggcagacgcatccatcatgcgttctgtgtaggcttggataagcataggcaggttgaggcctgtgatgatagcaatcttgcgctctggattttcacccatcactgcacttgcttgattaaatggagaaccgctccataagtcagcaaggacaagtacttcatcttcagcatcaaatgttgcgatggcagcttcgattttagcatgcaaatcagttggtccttcgctaggcataaaagtaacaacttgtactttttcttgctctccgaaaatcatagaaccagattgtttgatgcctgcggcgaattcaccatggctcgcaataacaattccgatactcaatgtgagtaacctcctatataagattataataaaaattattacttagttattatactacttcaaataaatatttgcaaatgttttcataaaaatattacacttgttttttaaggaatggaaaccctttataaataatttgtatagatagctttataaagcgttttttgggtcgtaaataaaaaaagattatcaaagtaagataaatctttttgaaaagtaacaggaatcgaaaaacttatggtagaatagtagttgataaaataatacactaatctctctcgattttaagtgctcctgtaggacaggattttatagctaaaagaagtgaattatcatcggaaaattctttttgaacttcctccgtatcataaaatttgacgattccattatcgtgataatcaaaaacttctggcgcatggagattacataaaccacatgcgatacatttgtagggaattatttttatcttcatataggaaatgataataaaaaaatagtaaaattgaaaggaaaaggtcgtgtcaacaaaagaaccctggaataatgaaatttatcgtgcgatgaaagaagaatcgactgaaatgaaaagacatgatagaggtagagatgaaagtaaacgtccgttaacgacgcgttttttgacttttctcgttatcctcatgtttattcttgttgggctaggtattggctttattttatggaataaccaagtacgaaatacagctagtatcgcaaaaagttttcatcaatcttcatcagtagctaaaaccgaagaatcaaccagtcaagccgcgacctcttcctcaacagaagcgactccacctgctagtagcagcagcacagttgcctcatcctctagcagtagcgttgagtctggaacaacttatacaattgctaccggagattatccaagtacgattgcagctaagacaggaattccttgggcaacgattgctagtttgaatggaattacagctgatggatataatgctgatggatcagctattcatgctggacaagttttaaaattaaaataaaaaatcactgacagacctttttacataattctgtcagtaaaaattgaactaaaataggaaataaggtaaataaagagattctatgaaaaagattcaaattgcaattgacggtccagcgtcaagtggaaaatcaacagttgctaaaattattgcacgaaatcttgacttaatttatttggacacgggcgctatgtatagagtagctacttttgttgccttgcaaaaggaaacagatgatgcaaaagaaatcattgaatttattgaaaaaaatccaatttcttttatgaatggtcaaaaaggtcaagaagttttaatgggctcagagaatgttacagaagtgattagaacaaatgaagttacaaatactgtttctaaaatctcagctatgaccgaaattcgtgaattcatggttgcagaacaacaaagaattgctaaaaatggtggaattatcatggatggacgtgatattggaacagttgttttaccgaaggcagatttgaaaattttccttgttgcttcagttgatgaacgagctgaacgacgttataaagaaaatctgtctaaaggaattccaaccaatcttgagcgtttgaaaattgaaatttcggaaagagaccgcaaagatagtacacgagcaatttctcctttgaaacaagcagaagatgcgatattacttgatagtactggaaaaacaattaatgaaattgttcaatttattgaagacaaagctaaagaactcatgtaaatgagttctttttaattattagatagtctaaagattggtaagattttgcaggaattatcaaactttgatataataatatgacaatgaatgaaaaaaagtataaacgcttagaatatttgagacataacatcaattatctcacaatccgagagcgtcaagagtactatgacttactcaatgaactaaaaaaagctggaaatcaatctgaacccgaagaattcgaggaatttgaagaatacgtcgagccagaatatggatattccgactatgaaccagaaagctttcaaaaaaatacttcctcttctaatggtagaaatgctagtcgaagaaatacgcgagaaagtttttcaaatcaagaaaacaatagaaataaaccatcaaaaaaagaaagtaaatcttctaaaaaagctaaatctggcaagaagaaaaaacgtcactggttaagaacaatattaacaattattgttgtgattattgcagtcatgattggtttctttgtttatggatatcaaaggggcgttaaacatgagggaagcgtcgctaaacaagaaaagttcacaagtttaaaaaattcggacggttctgtaaatattcttttgttaggagcagaccaaagaccatggcaatcatcaggtgttgctcataccgatactattatggttttacatgtcaatggtaagaatcatcaaacacaaatcgtgagctttatgcgtgatacccttgtcaatattcctgatgtcggctcaagtaatactccagactcaaaaataaattctgcctttacaattggagaacaatacaataaacagggtgtgaatttgatgagtgagacactgaaaaataactttggcattaattgtcaatattacgcagtcgtcgatttttcaagttttgcaacgattattgattctttgttcccaactggcctaaaaattgatgcaaaattttcgacagtgaatggtgagaatctttctgccgtacctgttcccgatgatttagctgcaacagaaggaaaagtttcaagtgacaaagacttgacagctgaagaagcagccgctttaggttatcctgatggtggtggaacatttatgatgattaaaccaggaactcaaaaaatggatggacgaatgctcttgaattatgcccgattccgtcatgatgatgagggagattatggacgagtaaaacgtcaacaacaagttttagaaacagtaatgtctaaaatgaaaaatccactctcattgtttactgcttcaagtgcgttgggaacaacaagagcagttacaatgacgaatattccaaattcatttttcttaactaaaggaattacagctcttctggatatgaaaaatggtataaaatcaacaacgattccagctaataatgactgggagaatgcctatgatatgtatggaggtctaggactttcaattgatatgacaaaatacaaagcgaaagcccaagaacttcttggtcaataaagagaaaattactaacagttttgttagtaatttttaattttaaatattcatatgaaaaaaatgatgacaatttttttctttagttattgattaatggcttataaataaattataaatttgtatttttatgatatgatatgagtatgataataagataagtaggtctaatccaatgatgtttaattatatttatactacttttttgacaattttatacacagtcgtgatgtcactttctctaagtttgtatctaaaagaacgaaaaaagaattatttattggtaagtctttattttttgctccttattttaaacggtttaatagtgaccatgtccgaaacttttcaaatatttgcaaatgactataatcggcaatttatggttaatccaatcattgaaaccatttattatttggcaacttttggtattgccttaaaattagtgaccgaattatttgaagaaaaaataaaaacttatcaatatggtatttatattgcttttgctttatggcttattgttgttccttttatggcaaattcagcgctaaaggtctggctctattattttccaagccaactactaatggtctgttttggaatttatttattaatccataatcgaaaaatgattcctaaaagcagtttaggaaagtatgtgaaattaattggaagcctagcgataatttttggattagctatagtagtagaagatacttttattatttattttagagatatttatcatacaaatatgcttaaaattcataatagaaatgtttcagaagacatttttcatatctcactttgccttattgctattaaatattttctaaccaattatcaaaaaggcaacgaagaagttgctgtcatcggtttcaaaaatgaaaaaaatgagactaatgattctgtaagtaattttgaagaagatgaatattactttgaaagatttatggataaatatggaatcactcaacgggaaggagaaattcttgaacttctccttcaacgtaaacacaatcaagaaatagccaatcaattatatctttctctaggaacagtcaaaacccacactcacaatatttttataaaactccaagttgaaaaacgttcagaagtttgcgaagtctgggaagcgtttgaaaaatcagagcttactcaataatcctaaaactccattttttaatggagtttatttttattttgattaagaaagcggttaaaatagttctaaaccttactaaacctttttactcaaccctttgctatcaaagggtttttggcttttttaaaagattaaatcctagagttgattgttttatatttttgctcttgatatactgaaatcgttcccaagagggaagccaaataactattttattcaggaggaataaagaaatggtaacaacaaacaaacgtgatttcatcacaacagaagattacactaaagaagaaattcttgatattgtaacactgggcttaaaaatcaaagcagcgattaaaaatggctactatccaccacttcttaaaaacaaatcactaggaatgattttccaacaaacatcaactcgtactcgtgtttcctttgaaacagctatgactcaattaggaggacatgcggagtatttagcacctggtcaaattcaactcggtggtcatgaaacaatagaagatacaagcacagttctttctagattgcttgatatcatcatggcgcgtgttgatcgtcatgaatcagttaataaccttgcaaaacatacaaccattccagttcttaatgggatgtcagactataatcacccaacacaagaagtcggtgatttgactacaatgattgaacatttaccagctggtaaaaaattagaagattgtaaagttgtctttgtcggtgatgcgactcaagtttgtttctcattaggtttaatcgcaactaaaattggaatgcactttgttcattttgggcctaaaggctaccaacttaatgaagaacatcaagcaaaattagctgcaaattgtgaggtttctggtggtacttatgaagtaacagacgatgaagaatcaattgttggtgcagatttcctttatacagatgtttggtacggtttgtatgatgcagaactatcagaagaagaacgtctagcaattttcttccctaaatatcaagtgacacctgagatgatggcaaaagcaggagtacatacaaaatttatgcattgtcttccagcttcaagaggtgaagaagttgttgatgcggttattgatggtccacactcaatttgttttgacgaagccgaaaatcgcttgacttcaatccgtgccctccttgtttggttgatgtctgattatgctgaaaaaaatccttatgatttgaaagcacaagctaaagctaaggctgagttagaggcttacttagcaaaataagaaagagtatcatttatggaaaatggaaagaaaaaatttagtctgtttagtgctattctttctgtcatttgtgttgtttttgttgccgaagcagcagcaccggttgctgctattggtaactcgcagttcttttggtggattgttctcatcgttgcttttctcttgccttatggtctaattacatctgaacttggaacaacttatactggtgagggtggactgtatgattggattacaaaagcctttggacatcgttggggagcgcgtgcttcatggttttattgggtaaacttcccattatggatggcttcacttgctgtactttgtcctgatttattgcatacaatgtttggctttcaattaaatacaggtatttcactattaattgaattaattttcatctgggttattgttttgattagtttatatccagtaagtgatagcgtttggattttaaatggcggcgcagtaattaaggtattcttagcattagcattaggaggcttaggaatttattcagctttgactaagggagtagcaaatcattatactttagcatcattatttccaagttttgatttgcatagtctatcatttatctcagtaatcatttttaacttactggggtttgaagtcatttgtacttttgctgacagtatggaaaatcctaagaaacaaatcccacaatcaatcatcattggtgggattgtaattgcagcgatttatatgttttcggcctttgggatcggtgttgctattccaaccgataaattatcgacaagttcgggattagtagatagtttccaagtgatgctaggtacaccaacaggttggttcattagtttaattgctttcttgtttatgctgactttagtgggtaatatggtttcttggtcacaaggggttaataatattgctagttatgctgctgataatggcgacatgcctaaattcttctcaaaaagacgtgcttctaatggaatttcttggggtgcagctttgatgaatgggattgtagcgacatttattgttgtgattgctccattattacccaatcaagatttgttctggtcattcttctcattaaatttagttctatttttattgagttatattccggtcttccctgccttttataaattacgcaagattgacactgagactccacgtccatttaaagtgagtgggagtgacggaatcttgaaagtatatatggtcttaccaatgattattattatcatatcattaatttttacagccatacctttgcaatataataaggcatcattgacagaacaattaccgattacaattggcgcaattatttttattgtgattggtgaattaattattaaatttaaaaaaataaaaaaataggagagaaaaaatggcaaaacgtattattggtacaacaccaaaagaagatggttttcggatgcctggtgaatttgaagctcaagatcaaatttttatgatctggcccgaacgtccagataactggcgtgatggagcaaaacctgttcagattgcctttactaatgttgctaaagcaattagtagatttacaccagtaacaatgttagtttcacaatcccaatatcaaaatgctcggtatcaattacccgctgacgtgcgtgtgcttgaagtttctaacaacgactcttgggttcgtgactgtgggccaagttttgtaattaatgataagggcgaacttcgagcaaatgactggacttttaacgcttggggtggacttgttgatggtctatattttccttgggatcaagatgatctagtggcacaaaaagtttgtgaattagaacgtgttgactcttatcggacagatgattttgttcttgaaggaggttcattccatgttgacggtcaaggaacagttttgactactgaaatgtgccttttatctgaaggacgcaatcctcacatgagcaaagagggcattgaaaataaacttaaagaacatttgaatgctgaaaaaattctttggcttggggatggaattgacccagaagaaacaaacggtcacgtggatgatgttgcttgcttcgtagcaccaggggaagttgcatgcatttatactgaggatgagaagtcacctttttatgaagcagcacaagatgcctataaacgcttgagccaaatgacagatgctaaaggacgtcaactcaaagttcataaattgacttgtccagctaaaaatgtaacgattaaaaaacaatttagaattgatacagttgaaggaacaatgccacgtgaagacggagatatttgtattgcttcatatatgaatttcttgattacaaacaaaggagttatcgtaccacaatacggtgatgaaaatgatgctctagcattaaaacaagttcaagagatgtttccagaccgcgaaatagttggcgtgaacactgttgaagtagtttatggtggaggaaatatccattgtattactcaacaacaacctaaagccaaataaggagtagagaggatttaacagaaaatggcaaaacgtattgtagttgctctaggggggaatgctattttaactagcgaccctacagcgcaagcacaatctatggcacttaataagactgccgaacaattaatgcctttaataaaagacaatgatgttgaaatggttgtcactcatggaaatggaccgcaagttggtaatttacttttgcaacaacttgaaagtaattcagttaaaaatccggcaatgccacttgatacagctgttgctatgacccaaggacaaattggttattggatggcacaagcttttacagaagctcttgctaataatggaatgtctgatgttccatttgtttctgtagtgacaagaacagtagttgatgctaatgatgaggcttttaaaaatccgacaaaacctattggacctttttatagccaagaagaggctaaaaatattcagactcaatatcctgattggaaattgattgaggattctggacgaggttaccgaagaatagttccttcacctttacctctcaaaattgttgaagctaacgcaattaaaccattgttagaatcatcagctttggttacagtatctggtggcggaggaattcctgttattgaaaaaaataagggatatcaaggagttgaagcggtaattgataaagatttttcggcagcaaaattagcagaacttgttgatgctgatgaactagttatttttacctctgtcggtgatgtctttttaaattttggtaaacccaaccaaaaagcgttaggagttgtaccagttagcgaaatgcgtcaatatctagaggaaggttattttgcggcaggttctatgaaaccaaaagtggcagcagctgtcgcttttgtcgaaaatactggtaagcaagccacgattacttcacttgaaaatgtggaaaactttgttaaaagtggggcaggaacacggattgttcctgattgattaaaaatatcattaaaaggttactaggaagaaagaattctagcaaccttttttaaaggaaattggcctaaataatagagcttgttaaaatttttttgtaaagcgccagtatgatttgtaatcacctttctatctaggatataatataaaagtacctcttagcgttggggtacaaaagcaaattctacggagcttctcggatattggagttccaaaaaaagttcctgttaagtcaggaacttttttattttaaaagaaaaaactactgtaaagttacaatagcttttaatatatattagtcatcaaaaaactagatatcatactttcctgtatgcaagtgtctaatagtttcgcctccgggtaaaggaggtaagccaagagaatcttcacggctaaaggcttcaagtaatccaggagttaagtgagaatactcaactgtttccggactaatcttatgaagaattgtgtccccttttccttcagtaacttttttagcaaagttagggtcaatcaaagttccacgagcaacagcaattaaatcagcatagttttcaatcgcatcagtcgctgtatcctccccaaaaataccaccgacaataagaagttttgttttatcatctaagatttctctaaaaagttcagcataagatttttcgctattttcaggtttagaattgtatcctgcccataatgaaagatggatataatcaagttcatatttaattacttcagagataagtgagagagcttctttataatcatagccaacattttttccatgaagttcttcaggagaaatacggtaaccaatgataaagtctttaggagcatattcatcaacgattgcttttacttctttaacaacagctagcggaaaggccattcgattttccagtgaaccaccccatttatctgtgcgaagattagaaagttttgagaaaaattgttgaattaaataatgattggcaccatgaatttcaacaccgtcaaaaccagcatcaattgcacgttttgtggctttaccaaaatcaagaatgatatcatcaatctctgttagtgtgagttcacgaacagggtaatctaagaaagaaaaatcgatagcagaaggagccaccacatctaatccattaacatgacgtcctacagcggctcgcccagcatgatgaatttgaagaatagctttatttccatctttttttagagcctgtgcagtttttcgtagtccttcaagatgagcgtcagaataagctcctaattgttcaggatatcctggcacatatgctggtccaccattttcactcacataatggaattctgtaattaacatacctgccgcttgtgaacgggcagagtaatattgaatagtatcatcagaagcgaaaccaccttttaaaccagaatgagtttgcattggagacattacaatacgattgtttaaagttgccccatgacgtaaggtaacatgatcagttaattgatttgacatatttttatcctgttattattatatttggaaagtatattattaaaactataattcgagaaatatcgatattaagaaataaaaagaaagttaattataactcttctaatatgaaatttttaaaatcggaaatcatctcctcgtttcgacgataataggtccatttaccaatgcgagtagcaattaataaattgtctttttctaacatagataaataatgagaagtagtagactgagttaagttcagtaatttttggatttcacctacacaaacacccgtttcaacttcatctactttagtttcgttgtagaaatgtttttttggttctttgagtaaagtaagaatcttcaatcgatattcatttgatagggttttaaaagtttctacattttccataaatctattatatcgaaaaaatacgatatgtcaatataaaagattttgggagtaagttaaatacctatcgtttgttggttttttttcttaatttcaaataaactaaagaaccatctgtagaaatcttatctcccccaccatttctacttcgataaggatttgtgaaatgagtatatagcttcctttcttcaactagtccatgctcgatgagttcatttgcgataagatttctttcttcatctatattctcatcaatacgatgagtaatttgtcctgtaaataaagaaaatctaataccaatatctaaagaagcggcacagacccaatcagactttactcccccagggaggtaataatcttgtggagtttcccataatctgatatgatgcctttgtttaggactgccagcaatttctttttcaaaggcgaggtcttgttttttagaaaataagaagagagagctaacgggtgcagtgggatagctttgatgtaataagcttgattttataattttgagagatgaccttaaagtaattttatctgattttgtccaccccattcttaaaaaagcagcttctatatcctcttttgaaccgtcaattaataaatttaccgaatcacctaatacaccatcagaagttctggaccttccaataaagtattccggtagataaatttttgtgatgatttttgtgatattcggaataatcagataggacaaaattagccatgtgacaatatataaaaaaatatgaatcttacgagttaatatatctctgaaaaataaatcataaatggtatatccaaagacaactgctactaaaacacgaaaagtacgagcggtgaaatttataattttagttttttgatccatcgatatcatctttcttatttagaggttaatgaatattttttgataaagtattatagatttttttgacacaaaatctatttatatatctattctaatttaaaaatgactaaaatactagagagagtattgaccaaagatttagaaataaataaaatagattcggaagaaattgactatattatcagaaaattataaaataagctatctgaaaggttaaaggagtgaataaatggtcaaaaaagcgagtgaagcagaaatcttagaagaactttatgatttaattcttagtaaaacattgaatagcaaagaacgtgaagttttagtgaagagtaagaataatttagaaaagggaaattatactccgaaggtaatcaacgatctccaacattctctagcgcctcttgctagaaaacaggaattatctagtgaagttgtgaggttttatcttcagttgtcgcaacaatttattgaaagaggtcaacgtggaagttggctttcgctttaatgataataaatctttcctttagaatgagcaaacaattcaatacactttataataaattttttataaaataagagtagtttttattttatatattataaggagattttgaaatggtaaaaaatatatcgttggattggtttttgggaattttattgccttgcttatggattggtattgtttctggactaatttctggaatggtaaaaattggttgggaagccattcttcctcctcgtacaaaagagcgagatgaaacaaatcctcctcaaaaacttatgcaacaaattggctttccccaaaaaattactcatgcttactttttgtattctaaagaccaaaaagtgtattggtttgccttgattcttcatttcagtttttcaattgttttttcatttatttttgttgtcttatcacaaatatggagtggtataagcttaggcgagggggctctttacggtattattatctggtttttatggcatattctgttaatgcctattactagaacggtaccacaaccttggaaacaacctttttcagaacacttttcagaattttttggacacatcgtctgggcttggtcaatagctgctgtgagtttttatatgattgctactcactattcagatgttctttcacttttctaaaataaaaagagccattcttaagagggctttttttatttcagatttgatgagaatttattcactttaaagagattttcttcaataacaaattcccacttttgtacgtctttttgatatgtttgtctatcaggcaggggatcttttagcatttcattatatctggacattgaccttgaggtgacaaggtacataaggctatcattttcatcaaaagatagagaatatttcgctttaagggaaatttccacagtaattttattcttgaattggtgtaggttgtttattccttcaatctgaatatcaaaaatggattctttttttccatacatatcattgtatacaatatgtttatcctgtttttttagtaaatttttactgtaaaattggctgttttgatatagttttgactgattccatgagctaagaacagctaaaacaagagcttcaatctcatcagccttaatcacgtcttctgagatatttttagcggtaatatatttttttttagttaatttttcaattaacaataaggcaagtggtgataaaactagaatagggattagaagtagtttcagggaaaatagattcatattaatttgtggtttctacggggcttaaataagctttaaattcgtgatctgttgaaatgtctcttgttgtgatagtgcactcatcaaattgagtgagagttgatgaaactgtagctctataggcagaaacagtaatctcttgacttaatgttgagtcgggaatgctatatgctaaggtcacttcttccaagtccataaataaatctctgaaagttaatttttttatttttacttttgtttcgtttaaattttctgaggcactccatccaagacctaaaagagtgtcaaaatcggaatatgaaagttttattgcagcatcagagatatttttgtctttaaagttgactgacatcgttttatccggagcacctccagtaaaggaaatatcaaagaagagaaatttaggtgtggagatggttagagtggcatcaggatccggagaatcatgatttaaattaacttgggcatttcctttggcattcgaccagtttcctgcaattgcctcttcaaaatcctttaaaaaagattgattttgagctttccatgcttcattaactgaagtcatattatttttaattggagttattgcttttttatactgaacggaatttttccgatagtagatcatcttttgctttttattgcttagtgtcaaaatgtttcccgaaatatcaaaagatgtttgatatttgtaggagttgagataacttaattcatgtttcttttcattaaattgataatttttttctttagtgaaattaacgatagaagtactcttattgggaaaatctaataatttgagattacttgttacttgtgtgggttcttgtaagagttcccactgaccttttattagtgtactttctgactttgttagtttgctacatgctgaaagagagaaaaaagttgttattagtatagctactacgataattttatttttcaatttttttactccgttttagaaacatctccagaaatttgaaccccttcattaccacattgtgtgatgagtaaggcagtatcaaatgataattttccgtttttatatgaaagttcggaaggggaaaagctttgagaaatcgtgccagtatcagttgttacatcataggaaaaagcaatatatttgatacggctaaacatttgttcggctgtgaggtctttaatgatatttaaaagtttcttaggatctactggaatatgatctgaaggttctaatcctaaaatgccattaggttgataagaagcataagcgttgtgaattactttctggtcaaaatttgtcaaagaatcagaagaggcgtgaaatgaaagattagttccaccatcgaaagttaatgtttgcattccgggcgcccaagccacaccttgcccagtagttgttaccgacttaaagtggcctgcccatgttccaatcattgctaccttgagtgatttttcaatgatgtctgtttttgctttccaaacttcattcaaatgagtcactgattttttctctttggcttctttgtcgttaatttctttggtcttttctttttcaagcttacttcctactcgataataaacatttccaccaatatctgaactcgtcgtatcaaattttaaaatatcctgaccgtgttctaacttataatcataactgtatgaaccaataataatttgtcgacctagcttatagtcgtattcattagtagcaagtgtgacttttttcttatcaaacttgattttttcactggtagatgcggttaaatctaacagtttatgtgcatctgcagcactcgttgttttcggaagattgattttactttcggaatacgaaatccattctccttgaatagcttggtgaggagtagtattagttttaacgctatctttacttgaagttttacagctgcttaaaattccaatagaaaaaatagcaaagatgataataaaaaattttttcataaatttatatactccaattttggtgacattacggcttaattatagcatataaaatttttatttatgaatataattagaatataaagaagagataaaaaagggcgccgataattattattatcagtgccctttttatcttgttaatgaaatatttacttttttatcctttatctgcaccagctgtgattccattgacgtagaatttttgcatgatgacaaataggattgtgattgggatggcaatgataacacagcctgcaataaattgtgtgaagaaggctgtggcagctcctttttgcgagtgaaccatgctatataaaccataggcaattgtaaaggtttctggatgggcttgattatttcctaaaatgattccagaaaagatgaagtctgtccatggggcgatgaatgccattaaagcagtataaacaatgattgggcgagagagaggcaaggtgatatgcgtgaaaacttgccatttgtttgctccatcaattgttgcagcttcatcaattgaacgtgggatggtgtcaaagaaccctttagcgatgtagaaacctaatccagctccaccaacatataccaatatcaaaccaccgaggtttaacatgttcattgcttttaatatataataaagagcaatcattgacatgaatccagggaacattccgagaacgagggcgatttgcaagaatggtttacggaaagcaaaacgtaaacgggaaagtgtatacgacatgataattgtaataaatgtagaaagtgtagcagagataacggctacaataaaggtgttaataatccatgaaacgaaggggaaactaccacttttattttggaaaagttggatataattctcaaaggtaaatgtttttgggatgattgttgagacaaaccctgtattgttttgagtcagactggctaagacaatccaaataatagggaaaatccaaacaattgctaagagagcgagtagaatatatctcaaacttaatgagatacggcgttgcgttttataagatttcatttcaattagccctccttaaatgcatttgtacgacggtatgctactaatgaaattgatgcattaacaatgaaaattaagataccaagaacagcggctgcgttataacgctgagtttgaccgaatacgaggttatagagccaagtaacaagaagatcggttgaacctgctccttggtagtttggattcattggccaaccactagtcaagaggtaaataacgttgaagttattgatattaccaataaactgttgaatcaatgcaggagtcataacaaagagaatctgagggaaagtgatagagcggaagatgttcaaactatttgctccgtcaatacgagcagcttctatttgatcttgggggagattttggataattgcagtagacacaagcattgagacaggaataccaatccacatattaacaaaaattaccgtaatccgtgcgaccattgggtcagaagctgcaccaataaagtttattggattagaaataagatgaagattcatcaagattccatttaaagctccttgttggtccaaaaattgtgccatcatcaataaggttacaaattgtggaaccgcaaatacgataacaaaaatggttctccagaatcctttaaatttaattccagtagattcaatgagaagagctagtaatacacctccaaggaatgttgtagctgttgcaacaattgcccatactaaggtccatcccaaaactgggaagaatgtgccagctaaatcaccggttaaaacattagcaaaagcttggaatccagtccatgagaaagcagtagcatgaaggcgatcatagtttgtgaacgccattgaaatcatatatacagtaggtaatacggtaaaagctaatacaccaatcaatggaacagccatcaaagttgcataaagtttttcgtcaagtaaagaagcgagttcttctttatttgttgggatatgtttaccttctcgttttaaataataaagatgcttatttgagcggtagttgaaccaataaagcagtataaataaaatcacaacaagacaggcaataagtccccaaagtagaattaaaacagagttatctggctgtaaagtttgtggaaaaccagaggcatcggtaattgttctttttattttatttgggcctaagctactaagaagagagaaggcactgattccagagaaaagaagccagccaataaatgcaatttcaagaattaaaagtgtgaagccttttacccattgtttatttttaatttggttcaaacccataacaaagaaggttaattttgttactgtgtccccttttgagaaaacttcgcctaatttaattgatttttcttcaggagaaatcgtgctttcagtgagttttctttttttctttttagtcataatatttcctttaaaaattaagaggttaggctgaaggagcccaacctcttattcacatataaccattagattgtctcttatttagagatgctgtcttggaatttttgtaattgagcttgatagtcagctggtttgatagagccagtgtaagcaccgttcatcaaaggaccagcattattccagaaagttgccatttgtggaagtttaggcattactacagaatttccttctttagacattgtaataactgctttggtaacgtctgaattcttcacagcgtcattcatttgagcgtcgttatttgtaggaacatctccttgagaattaaagagtttcaactgagcagattcacttgagagatattgagcaactgtttgagcagcagcttgactcttagaagctgaattgactgcaaatcctttaataccttggaatgattggagttgtttagcttgtccatcaatgttgattgttgggtaaggagcaactgcgaagttatcacctaaaatctttttaatgttagcagtatcccaaggaccgtcaaacatggcagcaactttaccggcttggagttgatttaaggcattagttgtttgaattacatttttatttgatttttgtgcagcaatccattcaagtgctttaacaccatttgccgatgcaacatcagtagatttcacatcttcgcctgatttaccgaaaagggttgtgccagctgtaaagaatactggataagagtagtaagggtcggtgtagttagcagcaaatccagctttagcagtcattccttcccaagttttgacatcgtcagctgacaatttagacttgttatagaagaggacaagagattctgttgatttagggaatgcataaatcttgtctttgtaagttacaccattaacagtgacatcagagttgtcttttttgatttcgttagcgaattttgtagcaactggattgatataacctttatcagccatatcaccaagttggtcatttggtacagcgaagacgtcagcatatttagaagggtctttagcgatatctactttagcatttgctgaaccagatgcattggcaataatttgaactttaaggtctgggtattttgaagccaatcctttagcaacgtctgtatatgttgctttttgttgtgtgtctacataaacacgaactgttcctttaatgctgtctgagctagaagatgatgatttgttagaacttgctgatgaaccgcaagctgcgagggttgcgagggcgagtacagatgctccaccaagagcaacttttttccatgatttcattttgtgtttcctcctaatgaaaacggtttattttatacactcctcattttacgcaaccgtttgctttttgtcaaggaaaaaaatattacattttgattacttagaaattggtttataccgactttttagcgtattctttagaatgaaaaataaatgttttaaaaaataatatacgaaaattgccgcaaacggttgcgtcaatgaaagcgttatgataaaatatgattaatgtgagatttatcttctccagatgtggtggaaatgacactatcgaaaagcgacggaaaaggtgcttttcgctgtccttgagattaattgaaaatagtttaagacagtacagccatcaaaaaaatttggaggttctattatgaacaaagctgcaatttatcatcgtcctgagtcggaatttgcttatctttatgcaaaaaatctgatgcatgttcgtctgcaaacacaaaaatctgatgtggaaaaagtcgaattattttatggcgatccttattcgtgggaagggcttgataaccctaaaacacagtattgggctagtcaaaaagtagagatgaaaaagtatctttctactaatatcagcgattattttgaggccgaaattactgttgcaacgaaacgagtagattacttatttgtcattacaggtttggatggagaaaaagtagtttacacagaccaaggaatgtttgattacgatgagagcttggtgactaaaaaatatggggctttccgtttgccttatttccatgaaagtgatcgttttaaagcacctgaatgggtcaaagaaacggtttggtatcaaattttccctgaacgttttgccaatggggatacgagcaatgatcctgagggtacaaaagcttggaatccacaagatgttcctgaccgtcaagatttttatgggggagatttgcaaggggtgattgatcatttggaacatttgactgaactcggtgtgaatggcatttactttactcctattttccaagctttttctaatcataaatatgatacagaagattatatggaaattgataagcaatttggggataaggaattgtttaaaactttggtgaaagaagcacatgcgcgtggtattaaagtcatgttagatgcggtctttaatcacatcggagatacgtctgctcaatggcaagatgtattgaaaaatcaagaaaaatcaaaatttgcggattggttccatgttaatagttggccagcaacttatactccaactgatgattttgaaaatgctgagaatgcaacttatgatacttttgcctttactccacacatgccaaaactcaatacggctaacccagaggttgaagcttatcttttgaaagtagctgattattggatttctgagtttgatattgatgcttggcgtttggatgtggcggatgaagtggatcatactttctggaaaaaattccgcacaacttgtgatgcggcaaaagatgatttttatattttaggtgaggtttggcattctgcacaaccttggttagttggcgatgagttttctgccgttatgaactatgcttataccgatgcgattaaagatggtttgattacgaagaagatttctttggaacaaatggtttctaatattaatacgcagctgacattataccgtaagcaagtgaatcaaatgatgtttaatgttttagattctcatgatacacctagaattttgactgttgcaaaaaataataaaaatttgatgaaattggttgaaacattcaccttcatgcaaccaggtgtgccttgtatttattatggggatgagtatgcggtgacaggtgggatggaccctgagtgtcgtaaggtgatgccttgggaagaaaaagatcaagatttagagatgtttgaattctttaaaaatctgattgctctacgcaaacaatatcaaggaattttaagtgattcagaagtagaatggaaaatcgtagattcagaaaatggcattgtgaaatttgaacgtggatctctgaaagctattttcaatattggcgaaaaaccggcttatttttcagctgatgaggtggttttctctaatttggttgaccaaaataatattttacaatatggttttgtaatctataaatagaaaatggattctgtcagttcactgcgaccgaaagagtcattgaatcggtaaataaagaaactatcggctttgctgatagttttgtcagtaaaaattgctgacagaatctttggtttagtgagtattttactgacgggattagcttataaagcagtcagtaaaattttaattgagttcattctcctatatcctgggaaaataggagaatgaactcacatcttaatggagtagttaatatgaaagaaaattggtggcaaaaaacagtcgtttatcagatttatccgcgttcttttatggatgctaatggtgatggtgttggtgatttgcaaggaattatctctaaattagattatcttgaaaaacttgggattggtgcaatttggttgagtccagtttatcaatcgccaatggatgataatggttatgatatttctgattatcaagcaattgctgatgtttttgggacgatggcggatatggatgaattgctcaaggaagctaaaaagcgaaacattcaaattgttatggatttggtagttaatcatacttcagatgaacataaatggtttgtggaagctagaaaatcaaaagataatgcttatcgtgattattatatttgggctgatgaacccaatggtttgcaatctaccttttctggttctgcttgggaatttgatgaggaatcgggccaatatttccttcatctttttagcaagcgtcagccagacttaaactgggaaaatcctcaggttcatcaagaagtttatgacatgatgaatttctggattgataagggaatcggcggttttcgcatggatgtgattgacttgattgggaaagaaattgaccaagaaatcacaggaaatgggcctaaattacatgagtatttgcatgagatgaatcaggcaacttttggtcagaaaaatttgctgaccgtaggtgaaacttggggagcaacaccagagattgcggaactttattctgatcctaaacgtcaagagttatcaatggttttccaatttgaacacatcacaaatgcttatcttgatgagggtgaaaaatgggataaaaaggaattttcagtttcaaaacttaaagaaattttagccaaatggcaagctttagaaaaaggttggaattcacttttttggaataatcatgatttaccacggattgtctcaaattggggaaatgacgggaaatatcgtttgaaatcagctaaagcttttgcgattttattgcatttgatgaaaggaacgccttatatttatcaaggtgaagagcttggaatgacgaattatccttttgaatcaattgaagaagtcaatgatatcgagtcacggaatatgtttgctgaacgcttagctgctggtcattctgaaaatgaaatcatggattcaattcgtcgtgttggtcgtgataatgcaagaacaccgatgcaatggacggctggagaaaatgcaggttttactgatggaaaaccttggctcgctgtcaatcctaatcatgaagaaattaatgctgatcaagccatgagtgatcctgattctgttttttatacttatcaaaagttgattgaacttcgtaaacaacatgattgggtcatttatggggacttcaagttgattgattctgaggctgatgtttttgcatatttgcggacttataagggcaagaaatatttggtcgttgccaatttatctgatgaagaaaatcaatttaaaacaggatttgtctgtcgtgacttattgattcacaatgaaaatttcctgcctgaactttctcagattaaattaaaagcttgggaagcctttgcttgcgaagtggaatagttaaagcgcaaaagggtgaggtgaaaatgagcgaatttaaaagaatggttgctggcaaactctataaagcaagtaaggttgaaccagaatacaaacctgataataatcgagcattaaatcaagaaattaaccaactcaatctacttgatacagaaaaaattgtggcacttgaaaaagaactttttggtcaaactggcgatgagttatttgtaaatccaccgctttacatcgactatggtaaaaatacaagaattggtcagcgcttttatgccaatatggactgtatttttctggatgttgcaccgattacgattggcgatgatgtgatgtttggacctcgcgtcagtctgattacggcttctcatccaatagatgccggagttcgacagcgtggactagaatatggaaaagcgattacgattggtaaccgagtttggcttggtgcaggagtaattgttaatccgggcgttacgattggcgaaaatacaattgtgggttcgggaacggtagtgacgaaaaatttgccagcaaatgtgattgcagtaggtaatccagcacgaattctccgcgaaattactgattctgaccgactttactgggaagaaaaagagaacgaatattatgaaaaataagcttttacttctgtcagtaactttactggcgacgtgtactttaagtgcttgtcaaaaagcaaattcaaaagattcatcagtaaaaaaagcggctgtcagccaaaaggttgataggagtttgtatcgtaatttttatgaaatatttacgagttcatttgccgattcaaatcatgatggcgaaggtgatttaaatggggtcacgcaacatttagactacttgaatactggaaaatccaattctacaacggatttgaaagtgcaaggactttggatgacaccgatttttgctagtcctagttatcatggctatgatgtcactaattacgaagaaattaatcctaaatttgggacaatggctgattttgaaaatctgattgctcaagctaaaaaacgaggaattgctgtgattttagatatgccatttaaccacacggcgactgataatgtttggtttcaaaaagcactagctggcgacaaaaaatatgtggcttattataattggtcggatacagcaaaagagggttatagtttagccagcaatggcaaatactatgagtcagagtttgataaatcaatgccagacctcaatcttgccaatcctgaggtcaaaaaagaaattgcaaaaattacgaaattttggttagacaaaggtgtttctggttttcgtttggacgctgtcggtttttatttctcaaatgatgacaaaaaaacgacggtctttaccaaatggctgacagacacggtcaaaaagcaaaatccaaaagcttatttagtgggcgaagttttttcaacggcttcggcaattgatgatatttatcagtcaggtattgattcattatttgactttccgaatgctttgcaatcgagttcaagtccaattaattcggctttagtcttaggtgaaggttctttatttggtcaacaaattgaagcatgggaccaagaaattcatgcggataacccgaaagccattgacgctcctttcttgagtaatcatgacacagaccgatctgcaacccttttaagttctttatccatgcagaaaatggctgctcaaacttatcttttgatgccgggaaatccatttatttactacggtgaggaattggggctgacaggttctggcattgaccaaaataaacgtttgccaatgtcgtggaatgctgctgggacagattctcccaaagcggatatttctgtgccaggtgcgacagaaattgccacaactgacggaggctcagtagctcaacaagaagccaatccaaattcgctgctcaattggtacaaaaaaatcttgcgggtcaaagcaaaatatcctgaaattgcgactgacagattgaaaaatatttctgtcagtgaagagagcttgtctgtcattaattatggaaaggatttgactattatcaataatttttccgatacagaaaatgtgacaatgaaattcccaaaaagcattgttgggacaaaaatcactgaccaactttctgtcagtagttctcaagcaaaattaactgatagaaaattgacaataccagcttacagcaccgttattttgaaaaaataaataagttcagtttagggactttaaaaatgaaaatgtaaaactatgaaaaaaataaaaacaaatgattttcacaagatggtaggttatcagatttatccaaaatctttcaaagatagcaatggagatggcattggcgacatcaatggcatcattgaaaaaattccttatctacgtgaattggggattgattttatctggataaatccaatttacaagagtccacaagttgacgggggctatgatatttctgattatcaagtcattgatgaaatgtttggctcacttgaagattttaaaaaattactagataaagcgcatgaaaatggcttgaaagtcatcatggatttggtagtcaatcatacatcagaccaacatccttggtttttagaaagtcaaaaatcaaaagataatccttaccgtgattattatttgtgggaagacgctagccctaaccaaatgccaaatgattggatttccttttttggtggttcaacttgggcttatgatgaaaaaacaaaacaagcttattttcacgtttttgccaaagagcagcctgatttaaattggaaaaatcccaaagtccggcaagaaatttatgacatgattcgctggtggttagatttgggaatagatggcttcagattagatgcgatttcacacattcaaaaaatgccatggaactataaaattaaatcttggaaaggcgacggcccgtgggtgcctttcatgaatgttgctgggattgaaacatatatgtcagatttgaaagctatttttgatgaatatggtgctttgactgttggggaagcttcaggggttcgctccaagcaagcgcccgactggaccgatgaagctggctatatcaatatgatttttgaattagaacataatgtcagaaaatcaaatggcaatggtcagggcagtatttatggctacaaaaaagtcattatgcgttggcaagaagatttgcttgaacggggttggaatgctttgtatattgaaaatcatgaccaaccaagaagtattgatacttttggcgatggttcaatagaatcagcaaaagcgttggctgtcagttatatgctcttaagaggaacgcctttcatatatcaagggcaggaatttgggatgactaattttccatttactgacgcaaagcaattacgagctgatgagattaaaaagaaatatgaaatgttaatgacagaattgtcagcaaagctgtcagttcctcaatctgccgattcaacatcttccgttggtcgcgttgaactgacagaactgtcagcaaatcaagcactagcagaagtcacccaaaatagtcgtgagcactcaagaacaccaatgcagtgggacaattctaaaaatgcaggatttacaagtggacaagcttggatggaaatgaatccaaatttttctgttattaatagtcaaactaatcaagaactcattgaactttataaaaaattgattgaattacggcatcaagaaccagcgatttcagagggttcaattaaatttcattttaaaagacatcctcaagttttagtttatgaacgagctgaatttttaattattgtcaatttggctgacaaaaaagctcatttagattttacaaaacttgacagttttactgacagctctgctgaaaattctgtcattaattatcaacaagtcttgggcagttcaaatcaaaaatttcaagaaaaaatggttctgtcagcctgggaatatcgggtttataaaaaatagaaggtgagaacaagataacactatgaaacaaatcaaaagaattatgggcattgacccttggaaaatcacatcaaatcagattgaaaaagaagaccgtcgtttgcaagaatcgcttacttctattggaaatggctacatgggaatgcgcggaaattttagtgaaacttatagtggcgacagtcaccaaggaacttacattgcaggggtttggtttccagataaaacacgtgtaggttggtggaaaaatggttatcctgaatattttggtaaagcaatcaatgccctcaattttgcttctgtcagagtttttattgatgacaaagaagttgatttagccgcaagtcacgtgattgattttaatctgtcgcttgatatggaaaaagggatactcacctatacttatgtagcttatggagtacgtgtgactgccgaaagatttttctcaattgctcaacaagaacttgcggtttttgctttcatgtttgaaagcatagatggtgaaattcatcaaatccgtacagcctcaatcattgatgccaatgttcgtaatgaggattccaattacgatgaaaaattttggacagtaaaaaaccttgataatacagctacaggttcatttattgtcactgaaacaattcctaatccatttggagttgaacaatttacggtagcagctaaacaaagctttgcaggcgattttactcgagttaatcaagaaacaagagaaagttctgttttagatgtttacgaagcaaaattagtggaaaatgcaccactcacctttattaaaaatgttttggttgtcacaagtcgtgatattgaaccctcgaatttaacaaaggtgctatcaaatttgacccttgaaatttctaagaaaacatatcatgaattttataaagaacaagaaatcgcttggaaaaaacgttgggaaattgctgatgtacaaattgacggttcagcagaagctcaacaagggattcgctttaatcttttccaacttttctctacctattacggcgaagatgaacgtttaaatattgggcctaaaggatttactggagaaaaatatggcggagcaacttattgggatacagaagcctatgccgttccattatacttggcgctttctgatgaaaaagttgctaaaaatcttttaaaatatcgtcataatcaattgccacaagcacagcataatgcccgtcaacaaggacttaaaggtgctttgtatccaatggttacttttacaggtgttgaatgtcataatgagtgggaaattacatttgaagaaattcaccgtaatggagcaatggcttatgcgatttataactacagcaactacacgggagatgaaacttatcttgctcatgaaggtttagaagttttgattgaaattgctcgtttttgggcagaccgagtgcattatagtaaacgaaatgataaatacatgattcatggagtcacaggcccaaatgagtatgaaaataatatcaataataactggtatactaataaattggccgcttgggttttgacttatactgctgaaagtttagcgaaatatccacgcccagatttaattgaaggtgctgaaactgctcactggtcagaaattgtggataaaatgtattatccagaagatgaagaattggggatctttgttcaacatgatggctatttagataaagatttgactccagtggctcaacttgaccctaaaaatcttccattgaaccaaaattggtcttgggatcgagtgttacgtagtccatatattaagcaggcagatgtacttcaaggaatttacttcttcggcaatcagttttcattagccgaaaaacaacgaaattttgatttttatgaaccattaactgttcatgaaagctcactttctccatccattcatgcgattttagcagcagagcttggcatggaagacaaggctgttgaaatgtatgaaagaacagctcgtcttgacttagataattataataacgacacagaagatggacttcacatcacatcaatgactggctcatggttgtcgattgttcatggttttgcccaaatgaaaacatgggatggtcaattgagttttgccccatttttaccacaagcatggacgggttatgcctttcacattaactatcgcggacgtttattaaaaatttctgttgatcaagaagtgaaacttgaattattacgtggccaagccttaaatcttgaaatctatggtgaaaaaattgaattaaaagatttttatgttacaaaaacaaagtaatttgatgtctttaaatgacttttttatcaaaaatctaaaaaatagttgaaaattaatcgaaaatttggcaaaataaaatttcagagtgtcaaataaaagaaagagaaaggagcgctgagttgagctgggtttagctagtctcaagtgaaaatatggcagttacaattaaagatgttgcaaaaaaagctggtgttaatgcctcaacggtcagtcgggtcattaaagatagttcagagatttcggacaaaacaaaagtaaaagttcgcaaagccatgcatgaattaggttatcgaaggaatgcagcggctcagattctagcttcgggaaaaacaaatacaattggtgttgttttcccgccagtggctgacaaagcgagccaacctttctttatgaaaatattgacctcaatcaatgaaacagctcgtgattacgatgtttcaatcgctattgcgactgggcattcagccaaagagttgaaaaaacagattgaacttcaatattcagaaaagcgagttgacggatttatcgtgctttacgctggaaaaaatgatgaagttcgcgattatttattagaaaataaagttccttttgttttagttggaactccggctgaaggaaaaaatgaaattacccatgtggataatgataatatgctgcttggacgcgaggctgttcgtcatttagcacaattaaaacatcaaaatatttcatttgtgaccgatacgaaagaaacagaagtttttgaagaacgttatcaaggttttaaagatgaatccgagaaacttgggctcaatcatgacctcttgtttatggatgctaatttttccttgcgaaacgaaacagctcttgtagttatggatgatgtcttgtctttaaaagttgtggaacgtctaagaagtcaaggtttaaatgttccagaagatgtgagtttaattacttacaacaactctatctttggagcaatgattcatccttatttaacaacttttgacattcatattgagcaattaggggcaagtgcaattaagaaaatcttggacttacgagataagaaagaaaatttgccagaaaaatcaattattccttttgaattaattattagagaatcaacaaaagctagaatttaagttctagcttttttagttttgtttaagataaggttaagcctagtacaagacaaaaatatgataatagtgtaaaataatagaaagggatgggcgcagttttattgactttccaagcaatttaactaaaaataatttataaattatgagccctaaaaaaagtgaaaagggatggattcaatgattaaaattttattagtggaggatgatttatcactctcaaaatctgtttatgatttcttaaaatcatttgcgcaagtcaaacaggtttatgatggtgttgaaggactctatgaggcagaattgggaatctatgatttaattttgcttgatttaatgcttccagaaaagaatggttttgaagtcttaaaggaattacgtgagcaaaatgtagatacgccagtcttaatcatgactgctaaagaatctttggatgataaaatgcacggattcgacattggagcagatgattatttaacaaaacctttctatttagatgaactaaaagcacgtattcaagcacttttgaaacggacaggtaaattagaagattcaaacggtttgacttatggaaatattcgtttgaatttatcaaataaatcaactttagttgatgatcaacctgttgatttaatcggaaaagaatttgatttagtcgtttatttaatgcaaaatcaaaatgttattttgccaaaagagcaaatttttgaccggatttggggctatgacagtgatacaacagttactgttgttgaagtttatatgagtaaaattcggaaaaaattgaaagatacagaatttgtcaataatctttcaaccttgcgaaatgttggctatatcctgagataaaattttactgacagcttattgtatagaggtgaaattcatctattaaattaacaaaaagttctgtcagtaaatctatctagaaatgagacctctttgaagaaaataattaaaaaaattaaatcttcagctattgtaaaaaatgatgggaaaaatttccttcatttttttctagcttttacagtcatttttgttgctttagccgtgattattattcaagtcatgcaattaggaatgtatcgagcgactgaccaaaatttacacaatttggctcaaaaccgagtgtttttggaagaagcagcgaataatcaattaggaacaaataattcacaagatagtggcttttatggaccaaataatagtgtaattttttatgattcagaaggaaaaaactttatgccatcaacgggctcaaatgcaaatataagtacaaactttggcatgagtcttttgcaaaaagcaatgaaatttaatgaaaaacatataaatacaattcagacagtatctgtaaaaaatccttatggagataatttgcactatcgttattacacaacatcgcaatttatcattacaaattctgatggtactgtgacgccagtttatatgcaaattttttcaaacgttgaccaaattcaagatgccatgagccgggccatgtgggtcattgtgacaacaatgattactttctggctactatcaataattattagtctatatcttgcaaactggactttaagacctattctggctgcttatgaaaaacaaaaagaatttgttgaaaatgcttcacatgaattgagaacacctctggcaatcttgcaaaatcgtctagaattacttttccaaaagccgacagcaacaattattgatgaatcagaaaatatttctgaaagtttatcagaagttcgtaatatgcgattattaacaagtaacttactgaacttagctcgtcgagattctggaatcagaattgagccagaggcgactacggcaacttattttgagaatatttttaatagctatgaaatgcttgctgaaaacgcaggtaaaaagttttcaggccatttgaaattagatggaacgattaatttggaccaagccctgattaaacaattgctaaccatcttatttgataatgctcttaaatacacgggtgatgagggtgaaatctctgtagatgttcaaaaaaatggaggattcttagtttttgctgtcgccgataatggtgaaggaatttctgatgaagataagaaaaaaatctttgaccgctttttccgagtagataaagcaagaacacgtcaaaaaggtggcttaggtttgggtctttctctggccaaacaaattgttgaagcttacaatgggaagattacagttgaagataataaacctaaaggtacaaaattcattgttagaattcgtgtggacagcacaatttcaaatcctgcaaaaattttccaaaagttgtaaaatatgataggaaaaaattactgacaaattatgataagataatagtaacattcaaattatgacaattttgtcagtcgatttactagtttttaaagacaatttctgttagtaaataactaagtaaatctaaaaaggagaaaatcagagatgtcagtgttagaaaaaatagacagcccagcggatttaaaaaaagtatcaaatcaagaactagaagaattagcttcagaaattagaacagcagttcttcataaagtatcaaacatcggtggacacgttggcccaaacttgggtgtgactgaattaacaattgcccttcataaagttttcaattcaccaattgataagtttatttgggatgtttctcaccaaacttatccacataaaattttgactggacgtaaaaatggatttactgatggacatttccatgacatcacaccttacaccagtcaaagagaatcagaacacgactttttcacagttggccatacctcaacttcaattgctaatgccttaggttatgccaaagcgcgtgatttgacaaatgacaaaggcaacattgttgcagtcattggtgacggttcactttctgggggacttgctatggaagccctcaataatgccggagatttcaaaggaaacctcattattttagttaatgataatcaaatgtcaattgctgaaaatcatggaggactttaccgtaaccttgctgaacttcgggcgacaaatggtcaagccgaaaataacttctttaaaacttttggtttagattataaatatcttgaaaatggaaatgatattgaatctttaattcacctatttgaagaagtaaaagatatcgaccatccaattgtccttcatattcatactgaaaaaggacgtggttatcaaccagctcttgaaaataaagaagcttttcactggcacatgcctttcgatttagaaactggtcaatcaaaagtgattgattctggtaaatcttatagttcagttatgttggattacatggataaaaaggtttcagaaggccttcctcttgttgccatcaatgcagcaattccaggaatctttggactgaaacaatttgcagctaaatatcctgaccgttatattgatgcaggaattgctgagcaatttaccattacttttggtggtgcaatggctgcggcaggtgctcgtccaattattttccacaattctacttttgttcaacgtgcttatgatcaattttggcatgacttagcaattaatgaagaaccagcaattgttattgttaaaggtggagttatttcaggttcagatgaaacacaccaaggctcatcagccatgacttggatttcaaacattccaaatatcaaatatcttgctccaacttctgaagaagaatttatttcaattcttgattgggctcttgagcaacatgaagaaccagttgtgattcaaatgccagaacacggcttagaatcacgtccgactgttctcacagattattcaaccccttcatatcaaatgacaaaatcaggcgaaaaagttgccctcttggcacttggcggcctttattcacatggtgaaaaagtagctaaagttttggctgaaaatggaattaatgcaaccctaataaatccacttttcatcaacgatttggaccaagctttccttgaaaacttagttgaaaatcatcaagttattgcaacgatcgaagatggaattcttgacggaggatttggtcaaaaagttgcttccttccttggtaagtatgatgttaaagttttgaactttggtgcgaaacgtgaatttaatgattctgttccagtgacagaactttataatcgttatcatttgacaccagaacttatggttgctgatattcttagtcttttgaaataaaaatttactgacagatgttccaaaatatttctgtcagtaaaaataaagaactgataatgtctgtcagtaaaactagcaagaatgatgataagttcttacttaataaagtgaaatagatgaaaaaagtattagtaaaagcagtacatggctaccaacgctggatttctccagccttgccaccagcctgtcgctattatcctacctgctccaattacatgattcaggccattgaaaaacatggaccagccaagggtttggcaatggggacagcacgtattttacgttgtcacccattttgccagccaggatatgatttagttccagaccattttagtttgcgaagaaattgggcagaaccagaaaaagaagaagactcaaattaatttgagtcttttctatttataaaattatagaaaacgctccaaaaaatagatgaaatcgctatcaaatgtcataaaaaaatgttaaaattaaaaaaagaataaaaaaggagtgtcatctattatgccatttagtaaagattttctctggggcggagcaactgcagctaatcaatgtgaaggcggctataatcagggaggacgtgggcttgccaatgtcgaccttgttccacacggaaaagaccgttttccaattattacaggggaaatgaagcaccttgaattcgatgaagaccatttttatccagcaaaagaagcgattgatatgtatcatcattggaaagaagacctcgcactttttgctgaaatgggatttaaaacctatcgaatgtctattgcttggacaagaatttttccaaaaggtgatgaacaagagccaaatgaagaaggcttgcaattttatgaggatatttttagagaatgccaacgtttaggaattgaacccttagtaaccatcactcactttgattgccctgtccacctaattaaagaatatggtggctggcgtaatcgaaaaatggttggtttctatgaaaatttagccagagcaatttttactcgttataaaggattagttcgctattggttgacatttaatgaaattaatatgctcctacatgctccatttatgggagcaggacttgtttttgaagaaggagaaaataaagaacaagccaaatacttagccgctcatcatgaactattagcatcggctttagcaacaaaaattggacatgaagttgacccagaaaataagataggctgcatgttagctgctggagattactatccatttgattgtaatccagaaaatgtttttgaagctcaaaaacaaaatcatgataatctctttttcattgatgttcaatcacgtggaaaatatccaaactaccttttaaagagattagagcgtgaagaaattacacttccgattgaaaaaggcgacttagaaatccttgctgaaaacacagttgactttatttcatttagttactatgcaagtcgagtcgctaaagtcaaggatgaggatgcagataaatcagctggaaatatctttgaatctgtaaaaaatccttatttagaggccagtgaatggggttggcaaattgacccacttggtttaagaatcacaatgaattctatttatgaccgctatcaaaaaccattatttattgtagaaaatggtttaggagcagtagataaacctgatgaaaatggatttgtagctgatgattaccgaattgattacatggctgcacacatcaaagaaatgaagaaagcagttgaacttgatggcgttgaactattaggttatacttcttggggatgtattgacttagtatcagcaggaacgggtgagatgagcaaacgttatggattcatctatgtcgaccgagatgattatggtaaaggaagtttgaaacggacgcctaagaaatcatttaactggtacaagaaagttattgcaagcaacggtgaagatttaacaaatgaataattaaaaaggggggctttcctcctttttttatcaaacaaaacatttctttgatttaagatttttatctagcaagaaaaatttacaatagttaagcaagtgtccattaaaaggaagcagtgctagaacttttttatgaaatatgataaaatcgtgtattgcgtaatttttaaatccgcagtcatgaagtatgaaaaagcctcgatgatatttaagaaatttaaaaagttacaagtgagataagaatgatgaggataagaagtgaaaagtattaaaaatacatggaagttgtttgccctagactggaagcgaatatttaaaaatcccgtggcgacttttttaattgtcgccctaatgataattccctctttatatgcttggtttaatattaaagccctgtgggacccctatgccaatacttcgcaactgccaattgcggtctatagtgcagataaatcggcaagttttcaagataaaaccatcaatattggtgatgaagtactgaaaaatttaaagaaaaatcaccaattaggctggaaatttgttgattccaaagcagatttagataaaggtgtgaaatctgggaaatactatgctgggatctatttaccaaaggatttttcaaaggatctcttaagtttcaccacgggtgatattaaaaaaccacaaattgtttattcaattaacgaaaaaatcaatgccattgctcccaaaataacatcaaaaggagcctcttctctacaatcgcaaatttctgaagagtttatcaaaacggcaagtagtacccttttaaaaaccttcaatacaattggttacgatattgataaaaacatgataagtattcagaaggttaaatcagcgattttatcaactaatgataatttaggaaccattgataaatacactcaacaagttgttgaccttcatggaaaaatgccagaaattaaagaaaaactggcaaaagctaatgaatttatcacttatttaccagaagtagatgctttaggtcaaaaggtcattaaattaaatgataaaatgccagaaattgataaaagtttttcactcgttttgacccttcaagagaaaatacctgagattcaaaatgctggaaaacaaatctcgatgattgatgatgactttgcgtcagtagaaagtaccatgactcaaggtattcaagaagccaaacaaggtttacaaattatcaatcaagtccaaaaatcaatgccagacattaaaaaattgggacaagatgctgatagtttggggactataaccttggatgcggctaataaattacaaacagcactgccagcaattacaagtagttctaaagttgcattagaatctattaaagatttttctaatgatacttcgacaattattggtgcgattgaaaaagcgattgatgacaatcaacttactccagaagaaaaacaacagattaatagtcttatcactactttcgtcactaatatcaaccaacaaagacagtcaatcaaaacaacggttgactatctcaagcaaattcaagaaagtaacggaagtcatgatttagattcagtaattgaaaatctaactaacttagaatcattactttcaagtcttaatgacagaatgaatcatcttaacgatttgattcaaacaggggatgtttctgatgtcaaaaattattttgatgaaattaatagtttagccactaatatttctaatatagcaagtcaaatcaatgtagatgaaattaattcaactattaagcaagctctaacaaccttaattaataccataacagacgctaaaggtttattaaatcaagctcaacaaatcgactttgatgccttactaaattcaacaagtcaaacagtttctaatgctattaccattttagaaaaatatcaaggcgaaatgccagccattaaacaagaaattcatgatgcgaatgtaatgttaaatggcaatatgacaacgattgttaatgcaattaatgaaggagctaatctctataaaaatgagtttcctactcttaaaactaagttagggacagcttctgatttctttaaaaatgattatgctggtgttcgtaaagatttgacagataccttaacaatggcaaatgataaaatgcctgatgttgagtctgctttgaatcaagccaatgatttaatccaaaatgattggcctgaaatcaaatcaggaattcaaaaagcagccgcagccattcaaaaaggtgaaaaagaagttgacttaggtgaaatcgtcaaactcctaaaattagatgcaaccaaagaaagtgacttcctgacacaaccagttgaagtccaagaaaatcaaatctacccgattgccaacaatggttcagcaagtacacctttctatactgcgctttgtctgtgggtcggtgcagtcttactttcaagtttggcaacaacggaggttcacttatcagataaagataaaaaacgttattctaaacgtgaacaattctttgctcgaatgggaagtttcgtagccattggacttgctcaagccttgattgtaacgcttggaaattattttggtttaggagtagatgtaagagatccattctacagtgttctctttgccttactaatatccatagcctttatgataatggtttatgttctggtcgcactgtttggcaatgtaggtaaaggaatagcgattatcatcctggttctttccatttctggtggtggtgggaactatccaatccaagtttctggaaaattcttccaagccattaatccttatttaccatttactcacgctgtcaaccttttacgagaatcagcgggaggaatttactggccaaatgcttggtttgcgataattatccttgtagcagtatcaattgtgtttgttgcaataggtgccttcctcttcccacactttgaagataaaacgaagaagatttccgaaatcggaagcaagagtcatttcttccattaatgttaagaaaactactgacagactggtcagtagtttttctgttatttataatcataatgagcaaatagtaagggagaacttgtgctataatatgtctatgacaaaagtaaacgaagaacgtgtacaagaaatttttaatagtatttcatcagattatgataaaatgaacgccattatcagttttaaacaacatgatttatggcgtgctaaaacaatgaaaagaatgggagatttaactggtctgtctattcttgatttgtgttgtggaactggagactggacttttgatttatctgaaagtgtcggcccttctggtaaagtaattggtcttgatttttcagaaaatatgctcgaaattgctaaggctaaactcaaagaagaagcgaagaaaaatattgaatttctccaaggaaatgcaatggcattaccttttgaaaataaaagttttgatgtagttacgattggttatggtttaagaaacacacctgactatcttactgtattaaaagaaatttttcgtgtattaaaaccagggggcagagtagtttgtatcgaaacttcacaccccacattgccaatttataaacaagcttttgaactttattttaaaaatgtcatgcccttttttggtaaagtttttgccaaatctttaaaagaatatcaatggcttcaaaaatcagcagaagattttccagatgccaagacacttgaggaactttttagaaaagctggctttgttgccgtagaatatcaaaaacatggcggtggagcaatcgcaagtcattttgccactaaatccaaaaaacctaaatcaaatattcgtattggtaaaaagtaatcggtcaataaaaaataaaaatttcgaggaaaaaatatgccttataaacgttatggggaaatttttaaaaaactacgagaacaaaagaatttttcgctttctcatttttcagaaataggaatctcaaaagcgagtttatcaagatttgaattaggtcaaaccatgataagctttgaacgcttggatagtgcgctgcaagagatgaatgtgactttagctgagtatgaacattttatcaataatttttcaatggattataaagaagaatttttagaagatataattcttgcggatattgcagatgacgtcgataaacttcacaatctctatctagaagctatggaatatgattcaaaaatgctagcttattgtgctaaaagtcgttatgaaatcctgacacaaacggaagctgacgatgtggttgaatatctctatgatgttggagaatggggctattttgagctttcgattttttatctgactttggatagtttcagtgaacgagaaattatgtatttgatgaaagaactctgggggaagagtaaacacttatatggtgtttttaaatatcgcagaagagttcttcaatcttcgtatcgagcggtcgttttgctttcctcaaaaggagctcgtgactcagctaaaagtatcttgcaaaaaagttaccctaaagatgatttctacgacctctatgttgaaaatctaagaaatctggcacatggtttttatagctattgtttcaaagacaagataagcggtgaaaagcaaatcaaaaatgccattgaaatttttcgacaagttgggtataaagatttagcagattattatcaaaaacgctatcaaaagcttttaggaaaattattaacataaaaaagtctccagattacttcgttgcatttctgcaatgatttaaaaatgaggctttttttctgctaaaataaaattaaagataaaagaaagcgcgcttgaaaattaatggaaaggagaaatatattaaaaaaatttaataggatgaacaaaattgcacaaaaatataatagaaagaaggaaattcttatgaaaccaaaacaaatttaagtaatcctaatagctttagcagttttttcagaattttactcaatatcagtgtctgccgattcagttgtttcgaattctcaagaagtaatagctcctttaagaatactaccacggatgaatatggaatttgaaggtggtagttcagatagtggatattggaccaatacttctaatctaacatttattcaaaacactgcttctggagtactttattatgatcaagtaaatcataagtatgtttttgctcaaacgagaggtccaatgggagccgcaatttacgtatttaatgctcaaggagtaaactggtagaaaggagaaaatataacatgtttaaaaaggagaaagaaaataaagaaaaaatactaaaacgaattgatgaacttctgaaaaataagtcagaacttaaatcacctgagaaagaaatattattggattatcgcgaacgaattgaaaaaagtaaaaaccttgaatttgaattagttcattttagaaatgctttacttcccttggttattagttctcaactttctcaagaagtcttgagtttttataaagaacttcgagctgaaagaaaagtagcttggggagaaggaagttctttgttgacaggaatttctcaatttccacaaaaaagaaagtgatgtagattattagagaaaaactcagatgaataattctatttacgctgtataatctgattattttaaaaaagaggtattaaaatgttacttagtatcgctatactattgataatctggggggcttatttaataggaaaaaaatataaagattcttttttaatcagctatggccgaaggaaaagaggattgattatcattgtttcgtcgttgttactgcttagtttctttgtttttgtaaaaaatgatggcttgttcccagtagttttattctctattcttttaattggcttaggtatctattatttaatacatgatagtaaacgagattctgagggaaaaaaagagaattaaacttaacaaggaggtagagtgatggttttagttttatggttggtagtgattgtcatttcatttcttttacaaatctatgtttggccacgaattccaaaatcaatttttaagtatagaggtttagtcttatctctctctctcattattcttatttttgttgtaagaataccactagaaattactgcattgacacttccattttatttgatgatgtttttcgggctctttcttttttggaaagatagaaaactttaagtaaatctgtagttaaaaaattaaaggtactcgattgagtgcctttttgagtaaatttatacaggtgatgtgtatattattaaaagtacaaaacataagaaatctattttatggtataataatcttgcttaaaaatttattaaaataagcgttagtagggaagtagtaatgaaattaaaagatatagagaaatcaacaaataaaaatctttatctgctttttctaagtgtactcgtgggcttgactgcgggttttttggccagtctttatcggttgacactggaaaaagctgaaacttggggcttgagtatttatcgcttcgttagctcacaccttatttttattcccctccttattttgggtttggctttcttagcgtttgtggttacttactttatgaagaaatacccgatgagttcaggttctgggataccacaagttaaagggcaattacagggttattttaaaaataattggttcacgacggcttttgctaaatttatcgctgggactttagcaatgtttgcaggtctatcactggggcgtgagggtccctcagttcaacttggggcttcaatgggtcagatggtttctagccggttggctgaaactgaacgtcataaaagaattctaattgcttctggggcatctgctggtttatctgctgctttcaatgcacctttgtcaggtgtcatgtttactttggaagaagtatttaaatacttttctccattgattttattaacttgtatgacctcagcaatggttgctgatatggttgcacgaataatgtttgggagtggtccagtttttcatttccaaattgttggttcaattgaactctcaaattattggctacttattattttaggaattattttaggatttttcggtgctttttataactggacactcctcacaagtcaaaatttgatgaagaaaataaaaagtccatttcttcgtgttttacttacttttttagtggttggggcaactggtttattgtttcctaatataattgggagtggccatcgtttaatggattcctttagtttaggaatgggattagcctttctatgtttgattctcattgggaaatatctgatttcaatggtatcttatgcttcgggggtgccaggaggaattttctttcccctattagttttgggtgctagtcttggagctgtttttgcgacaattgtcatttcactttttcatcttccaagccatttgtttgccaatctagtaattttagcgatggctgggacttttacagcaattgttcgagcaccgatgactggaatccttcttttggtggaaatgactggttcatttgaccatttacttcctttggctcttgtctctttaattgcctatgtcgttgctgatttattacaatctgagccaatttatgattctttattagagaacatgttgaaagaaaaagaaattgatgttgatgattcggataagcagatgatgtttgaaacaattgttcaatttgattcagttgcggatcgtaagaagttgtcagagatacatttaccagaaggatgtttgcttgtttcggttcatcgttcaggtaaggatattattccacacgggaataccgaattacaagcaggagattatttgacctttttgattagacgagaagatgaagtgattgctagagaacagcttcgtcaggttttaaatgaaaaataaaaaagtgatattctatcactttttttagttgcttaaatattgccaaaggattgataaaaacagactcacagcataagcgctgttaaatagaaccatatttctcagtgaataaacaaagctgcgaggacttggaacttgactagcatgagattttagattctttctgataattggaaaagtgagtaaactaagtaaagttggccattcaaatattctaaagataaatccaagaataatagctaaataggaagaatacatcaaaagttgaaaaagtttgattccgtttgaacgaccgatataataaactaatgtgtaacgatgattttttatatcgctatctaaatcacgtaaattattggccagcatgatgtttgcaatggtaaaaatgagtggtaaacttgcaattatcatggcgatggctgcaaaaatactaccagtaaagctaaaagagtcgtttgtaaaatcaagatttaggttaaaaataggtgattgagcgctgttgattaagatgatcattgcaaaaattccaaagcccattgtcccaccagaaaaaatttctcctaaaggcatacgtgaaagtggaataggaccataagtatagaaaacgccaataaagaagacgattccaccaagaataaagaaaagccagccaacaaaataagcgaggagaaatcctaaaaaaaggctcaaaataagcataaacaagataattgaagctatcaatcgggtggaaagattggcttgaccaatgatgttttcttgctttttgtattcttcatctttggcttttttgaaatcttgataattgttaatagcagttacggtcatatcaaaaaggagcatagctattaaaaataagagagataggccaatatttatcattttaaaatagcttaaactaaaaagtaaaccaataatgtaagggaaaatactggcgattttagttttaatttcgacgagttctaaaaaatttttgagggacataactactcctgaaaatataatttgaataaaaacagccgttattttacggcttttacttatttattttttgagaaaataattctctattttttaatcatattaaaaatatttaagcaaaaatgttaacaaatgttactcattttactgaagtgctttcatttctattgtaattataactgattataggttaagaatcaacatagacttgaagattatatttagtaatctttgttaagataaatataaaatatgctaattttaattgatttgtgaacggtttaagtctccaatagttcgtactaaagatactacaatatgagaataagatttgaaggaaaaggctttataatcagttttgtgagggattcttagcatttattttaaggttcggttaagtaatggataatataatcatctctcatgagtggtggagaaaatttactactgatgttaaattgttttttaactcacaataagttgtgagaaatgaatttttaaacgtccatagcgtgcaatgacgttaaactgcttacggtaatcctacacaagcgttcggactttatgatgtgtatgggaagtaaccatgttaatagaagatagactggattcagtttgaatcctatggaatgttcttagtggcgaaatcgaaaggtctaaatgaaattaagtaaagttgctatttcaacgggattagttgcatcattcatgtttattgggggcggaatcgctcatgcggatacacctaaatcaactcatgaagttgctatagaagtaattaacggaaactacggaaatggagatactcgtgtcactaaccttcaaagtaaaggttttgatgtgaaagcaatccaaacagaagttaataacattcttacaggaacaacaactcaagtttctgcaacaactaaaactgctgaagaacaacctactaaagttacatcagttgcaccaactcaagcaacacaaagtgtttctggtgggcttaatatgagccaaacttctggacaagttgacatccaagctcttgctaattatatggcatcgaatacagctaatgcagcgggctattctgctagcgaatgggcttatatcattactcacgaatcaaatggtgggattgatagtgtgaattcaagttcaggtgcttatggtgctttccaattgctaggccatggcgaatatgctggaatgactttggcagaacaaattgcgatggcaagtaaacttcctgctggtagctgggttgtttataactaagcattgattaaacctcgtcttaaaatctttgataaataaatcaaacttagtggctcatagcaatcaactctcaagttcgtttgggattgattgagtataaaaaagaacaccgaattcggtgttcttttttattagatggcccctgccagaatcgaactggcaatcactgcttaggaggcagtagttatatccaatttaactaagagaccagagataaattactgacagccttacaaaatatttctgtcagtaacttttaatgagctttatttattgtcagcatcaaaaacaatgccagcactttgacgcatttggtatgaagtttctgaaacttcttgggcaaattgatgtaggtcataacttgcagcaaaatcattattttctaagatttgggcaaagtcaacagcttcatcataaagagagtgttttggagcttcaatgtcgattctagtttctgaaccatccatagtaatgaatttggcagaagtaatcgcattaacaccatccaaaattaaagttccatcagtagtatagatttcactaggaagatatgaattcacatttcctgcgcatttaatcgaaactttgtaatcttgatagtcaagaattccaacaccagctaaatcaacgcctgacggaagtaaaactgcatcataagttgctttttttggtttgccaaaccaaaagattgcagcatacaaaagatatacaccaagatcggctaaaagtccaccagagaattttgcattaaatttattagggatttcaccgtttaaaagagcaggcatttttgatgaatattttgaataagtaaagtctgcccctttgactgttttgtcagcaagaaagtctttaataatcgaaaatgaatgttcatgaatatttctggctgcttcaaagaagaagacctcattttctttagcaagcttaataatttctgtcagttctttaggatttgaaaaggcaggtttttcaacaatgacattatgtccggctaaaattgcggctttagcttgctcaaagtggagggcatttggactggcaatatagataatatcaagtgaagctttaaaaaaatcgtcaagattatcgaatttttggatgtctttaaaatcggcagaaaactgatcagcagattcgagccgacgggaatagaccgcagaaaactgaaatttttcagtcatatgggcagcatcaataaatgagcgagcaatccagctcgtaccaattactccaagttttagcatcaaattctcctttataggtggacagaatcattcgttagaagattctaaaattctgttaaaagcttgttctattatatcaaattttttcttaaaggtcattgctctactattgaattttcagtaaataaattataaaaataagaattccaaagattccatgtcacttattaagagcttttgtcagtaaaattaagagtttttgatgtgaacgcttaaaaagtaaaaaaattgtcagttgatgacaaaaagctcaaaaattgtggtagaatatatagaagaaaatttggagaattaattttgaagaaaacgttgattattggtgtcactggtgggtcagcaagtggaaagacaagtgtttcacatgctattttagaaactttttcaaatgaacgaattgcaatgattgaacatgatagttactataaagatcaatcgcatttgacttttgaagaacggacaaaaacgaactatgaccatccattagcctttgatacagattatttaattgctcaattaaaagagcttcaatatggacgagcggttgatattccgatttatgattatgcaaaacatacgcgttcacaagaaacttaccgtcaagaacctcttgatgttttaatcgttgagggaattttggttttagaagatgaacgtttgcgtgatttaatggatatcaaaatatttgttgatacagatgacgatgtgcggattatccgtcgaattcgcagagatattgaagaaagaggaagaactcttgattcagtaattacacagtatttagatgctgttaagccaatgtatcatcaatttattgaacccacaaagagatatgcagatgtgattattcctgaaggggtatcaaatactgttggtgttgatattattacgacgaaaatcgctagcattttaaacgactaaaaaaagctgtctatgacagtttttttgtttttggctagtgaatctcgtgaaaaattggaaaaataaaaaggctaattgtccttaaatagcaataatggtaatgcttactttttttgtgaaagtatgatatacttaattcgtaacaattgcagaaaggaaatccgcaacttaaagcggtgggttatgagaaatttgtaaccaagggattttgtcaaaatggaactttttgaatcactgaaacaaaaaattagtggaaaaggcttaaaaattgtctttcctgaaggaactgatgcacgtattttaggtgctgccaatcgtcttaacgctgatggactaattacacctgtctttattggaaatgtaaaagaagtcactgaaacattgatttcacgtggaattaatcctgaaggctttgagatttatgacccagaaaattgtggacgttttgaaacgatgacggaaacttttgtggaacgtcgtaaaggtaaagttacagaagaacaagcaaaagagctcttgaaagacccaaattattttgggacaatgcttgtttatatgaaaattgctgacggaatggtttctggcgcaattcattcaactgctgatactgttcgtccggcccttcaaatcattaaaacgaaaccaggagtaaaatctgtttctggtgcttttattatggttcgtggtcgtgatgacaatgaaaaatatatttttggtgactgtgcgattaacatcaaaccagatgcaccaactcttgccgatattgctgtagcttcagccgaaacagcagcactctttgatattgaccccaaagttgccatgctttcattctcaactaaaggttctgggaaatcagaagatgttgataaagtagtagaagcgacaaaacttgttaaagaagattaccctgaaattgaaattgatggtgaacttcaatttgacgctgcttttgttccagcggtggctcgtcaaaaagcaccagattcaactgttgctggtcgtgccaatgtctttatcttccctgatattcaatcaggaaatattggatataaaattgctcaacgattgggtaattttgaagcgattgggccaattttgcaaggtttgaacgcacctgtttctgacctttctcgtggaagtaacgaagaagatgtctataaacttgcaattatcacagctgcccaagctttaaaataaataatgatattctgtcagtaaatttgtaaatgaataattactgacaagtctgtcattaatccgccatttgaggcggatttttttgttggtctaaaaatgttataattaaagaatcaaaaaggaaatgagaaaaaatgagaaaatcaaaaatttttgctctagtagggtcgattattttttcaattttggcacttgttgggctaattagtttttgggccattatttatatgccagagaattcagaaattatgacagaacttcaagattcaggatttgataagcaattattgtctaccgcagcaatgattgcagctctgattttaatcgctttactagctttaaattgggtggcttttgcaagattgacaaaagaaaaaggttggggaatttatttcttagttgttggtatcttttattgtgtagcctctgtttttaacggtgttggtatcttttattgtgtagcctctgtttttaacggtgttggcttaattttgaccttaccagttgccctctgtttcattcttgcttatgtctatcgaagacgagaagtccttgaaaataaataaaaaaattactgacagactttctgtcagtaattttttattagactttacatgatgccccaatgattaaaagcattgatgattccgtggttagtattttctgtagagataaaatcggctaactcttttaattcaggaacagcatttcccattgccgttctgtggtcagcttctttgaataaatctaaatcattgcgaccatcaccaaaagcaaaagtttgaccagtgaaatttagcacctctttgacatgattaattcctgtccctttattagttgtgctgtttgtaacatcaatcgaacttggagagttcatgaaaaagttaagttcaggaacgcgttctttataataatcaacttggctgagttgattggtcaaaaccaagagcatattgacttcctgagagaggtaacgtctagcatctgcctgaggcattggcatatgagtgtaagcataagcggttttagctaagtcagttaattcactcacccaataaccttgactgtcataaaaagaaagagcttctgagtgaggacttgctgcctcaagtaatttttcaacactacttgtcggaatttcttctttatatattgtttcaccatctaaaacaatatactgtccgttcatggcaaccgctccactaatcccagttaaactcatgatttcatcaagttcaaaatgtccacggccagtagcaatgaaaggtaaaacaccattttcgcgaatccgatgaattccttcaataacttcttggtcaagtttactttgactgttaagcaacgttccgtctaaatcgaagaaggctaaagccttataatcattgatattttccataattttattgtatcaaatttatgatataattgtaagtggaattatccattcttttataaagaatttaaatgactgacagaactgtcagtttgtgttaactataaaaataaataaatataattaatattgttttactgacaaacctgtcaatattattaaaaatgagtgaaagtaaaaaaatgcctgcaaagaaaaaaacaaccagaagaaatactaaaaaagaacaacagaaaaaggccgcaacacgcaaaatgattgctttttttgttgggcttcttttaatcttatttgcgcttgctcgcctaggaattgtcggagtcttactttacaacattgtccgcttatttgttggttctcttgcgattatttttcttctcttgcttgctggactaatgattatttccgtctttcgtaagcaagttttaaaagaaaataaaagaattattccagccattattttaacttttatcggcctaatgtttgtctttcaaattcgatttcatcaaggatttaatgaaacttttcatcttatctggtctgatttaatggctggccgtgtcattcattttgtcggctcaggtgtcattggagcattaatcaccgagcctgctaaagccttgttttcagtcattggtgtctatattattgctgcagtactttggttagttgctatttatctcatgattccaagacttttccctaaaatgcgtgaagatttacatcaacgtttagcgaaatggaaagaaaagcatgccgaaaaagcagaagctaaaaaagcagcgaaagcacttgctgagctagaaaaaaaacaagcagtagctgaaagagaagagcttccagaggcagcagaaaattcattatttacctcagcacctactgaaattccaattaatattccggaagcgccttttgaagaaaatgaaaatgaaactgaaagtccagttttagcagaagttcctcttgatgatgaacctgtcaatttttcaaatactaataactacaacggtaactataaattaccaaccattgatttactggcagaagttcctgtcaaaaatcaatcaggcgaacgtgagaatgttcgtaaaaatattggtattttagaagaaactttcaaatcttttgggattggtgccaatgttgaatcggcagtcgttggtccatcaattacaaaatatgaaatcaaattagcgactggaacaaaagtttcacgcgttgttaatttatcagatgatttagcattagccttagctgccaaagatatccgaattgaagcaccaattcctgggaaatctttagtcggcgtcgaaattcctaatgccgaagttgcaatggttggtttccgcgaaatgtgggaggctggcaaaactaatccaagcaaattgttagaaattcctcttggtaaatcattagatggtggaattcgcacatttgatttaacaagaatgcctcacttattggttgcaggatcaactggttcaggtaaatcagtggcggtaaatggtattattacttcaattttgatgaaagctttgcctagtcaagtgaagtttctgatggttgaccctaaaatggtcgaactttctgtttacaatgatattcctcatctattgattccagtcgtaacaaatccacgtaaagcttcacgtgcccttcaaaaagttgttgaccaaatggaagaacgctatgaactctttagtcgttatggcgtccgtaacattgctggatataatgaaaaagtacaaagatataatgcagaatcagatgaaaaaatgcttgaacttcctctgattgtagtcattgttgatgaattagctgatttaatgatggttgccagtaaagaagtggaagatgcaattattcgtttgggacaaaaagctcgagcagcagggattcatatgattcttgcaacgcaacgtccatctgttgatgtcatttctggactaattaaagcaaatgttccttcaagaattgcctttgctgtttcatctggaacagattcacgaacaattttagatactaatggggctgaaaaattactaggtcgtggggatatgctctttaaacctattgatgaaaatcatccgattcgtttgcaaggggctttcttatctgacgatgatgtcgaatctgttgtgacctttattaaagaccaatcagaagctcagtatgacgaaagctttgaccccggtgaggtagatgagagtcaagttggtacgggcgcttcaaatacaggttctggtgaccccttatttgaagaagcacgaaatatggttattatggctcaaaaagcatcaacggctcaattgcaacgagctttaaaagttggattcaatcgcgcctctgacttgatgaatgagttggaagcgcagggaattgttggtcctgctaaaggaacgactcctcgtaaagtccttgttagtccagatggagaatttattggaggagtagaagagtgagtgaggaactatattatcgacactattttctacaaatctatgaaatcttacgagaagatgagcaaaataaagaactttcaatcaaggaaaaaaatgttttagctgattctttggttttaaatgaacgcaaagaaccagttttacaaatattaggtcagctttatatgcgcttagaattttggaatcggcctgctgatgatgagattttaaaaggcggcatgaaagccccagtcagaacactttatgaagaattaaaggcagataaaaatatcacttcttcacaaaaatttattccaggagttgaagcgtatcgaccgattacatggaatgacgccttgtatggaaataaaatgacggaagatgatggctttatcggtgggggctatgtcacttttgactctaatgaaaaatataaatcaatggaagaaagaatagctgtacctgataatgaaattgttagaaatgcaaaatcaagttttgctaaactctttcaagttagttgtttaggttttgctttgctcatcctgctccttgttctcttggggtttgctttaaaaatggtaacgaggtagttaaaaatgacagtatttgatgaatttaatgaaatcaaaagaaaaggactccctcaaattttagtaatttttggtgagtcaagggaactagttggagaattgaaaaatcagctcttaacagaggttaatttcgagccaacggatttgagtcaggcttattatgacttaactcctagtaatagtgatttagcccttgaagatttggaatctctcccttttttctcagattctcggttggtaatcctagaaaacttggttaatttaacaacggctaaaaaaagtgttttagatgaaaaacagttgaagcgctttgaaaattttttagatgatccgccggaaactacgcaacttgttttaatcctttatggaaaattggacagtcgtcttaaagttgttaaaaaattaaaagctaaagcagctttgcttgaagcacaagaattaaagagtcaagaattaattcaatattttagtcgaataagtcctttaccaaaggcagttttgagtttaatcgccgccaaatcaaatgataatttttcagtaatgaagcaaaatattgacctcgttcaaacttatgcactagggcgagaagtgacacttgatgatgtggaaaaagtcgtcccaaaatcgctacaagataatatttttgccttaactgatttaatttttaaaggaaaaattgatgaggcgcgtgatttagtacatgatttgaccttgcaaggggaagatttaattaaaatattagctattttgacaaattcttatcgtttgtatttacaagtcaaacttttccaatccaaaggttggcaagaaaatcaacaagttgcctttttaaaaatgcacccttatcctgtaaaattggccaatcaattggttagaaaattaaacgttaaatccttaaaaaatggactttctgatttaattaaacttgattttgatataaaaacaagtgcagctgataaatcctatctttttgatatcactttaatcaggttgaccttgaaaaaaaactgaaaatctgttatcataagtatggacattttataatgatgatgaagaggtaaaaatgccgacatttaaatttacgcctaaagatatctatgaagcagacttctctacaaagatgcgtggttacgataaagaagaagtcgatgaactccttgatgatgttattgctgattatgaaacttatcagactgaaaacttgcgtcttcaagaggaaaatgagtttttgaagaaaaagattgctgaattagaaatgcaagtttctaaaccaaatcaagcaaatcttgatgatacacaacgctttgaccctaaccaaattcttcaagcacgttcaagtaaaccaaaagtggaaatgcgtaatccaagtaattttgatttactcaaacgaattaatcgtttagaacaagctgtatttggacctaacggcattgctagtgaaaacaactaagaaaatataaaattgaaatgttttatgttctgcattaggtttagcaatgagcctatttgcaaacttcacaagatgtgaaggcaaagattttggtaaatgaactttattgttctgcttaatttttgataaaaacagttttcggataatcgcgcgatttttttgtaaatcgtgaggaaagtccatgctcgcgcgttgctgagatgcacgcagtgattgtgctaggtcaaacaataaacctaggtaggagcgtcatgcctaacggctggccaaaacgctaagtcttttgatatgcgtgagtagcctgtaaaagtgccatagagacgagtcttagaggaaactctaagaatggaacgtggtaaacccctcaagcgagcaacccaaacttatggtcggggcacttgactagccaaaatgaaggcgtggtcgaggctgaaattaagaattttggcagacagatgattatcgaaggggagattcacgaatgtgaattgaactggaacaaaacatggcttatagaaaactgtatgacacaggctggggcttttagcctcggctttttttgataaataatgtttaattgaaatagatagaattatctctgctcattttatgcagagaatggaaagttaaaaaatgcaaaagaaattcaagttattagcaacttcttcaagtggtttagagagtttagttgctcgcgaacttcgtaatctggaaattgaaaatgtttcaattgacgaccgttcacgtgtcttctttgagggaaatttggcaacaattgctaaggcgaatctttggttaagaacggctgaccgtgtaaaaattgtagttggggaatttaaagctagaacatttgatgaattgtttgaaaatgtttatgcgcttccctgggcggagcttattccttttggaagccaatttcctgtcagcaaagctaaagcagtgaaatcaactttacataatgagccgtcaattcaaagtatcactaaaaaagcgattgtcaaaaaattacagacgacttatcatcgtcctgaaggtgttccaattcctgaaaatggagctaaattttcaattgagattgctttacacaaagatatggcaactgtattgattgatacgactggcgattctttatttaaacgaggctatcgttcagaaaaaggagaagctcctttgaaagaaaatatggcagcttcgattattttattaaccaattggttagcaaatcctcgtcgtgcttttgttgatcctacttgtggttctggaacatttacaattgaagcagcaatgctggctttaaatatggcaccaggaatgaatcgtccatttgcttttactgcatggccttggtttgatgaagaaattttgaaacaagaaaaagctttggccaaaaaacaaattcgtacagatttagaattggatattcaaggttttgacattgatggaaaaatgattgaaattgcaaaacataatgcacttgcggcaggcctttcagatgtgataaaatataagcaaatgcgacttcaagattttagaactgataagcttgacggtgtcttagtttctaacccgccttatggagtgcgtttggaagatgaagaagctgttgcagctctttatggtgaaatgggtaaaacttttgcgccactagaaacttggagtaaatacattttgacgagtgatgtcgcttttgaaaagcattatggggcaaaagcaactaaaaaacgcaaactatataacggaacacttagaacagatttgtatatgtatttcggaaaacgtatgaaataaatttaactgacagaacaaaaagctattactaaaacaaaaaaattttagtgatgacggctgtcagtaaaaattcagacgagtttgagcaactctcgttgtctgattcaccattttattggaattgtgggaatcttattcggaggaaaaatgtcaaacaaaaataaaaataacaataataagccaaaaaatgagcaacaaattggtgaaaaaactttgaaacttcaagatttacaagattttaccgtagggcaaattgttgaagaatcaaaacgtgttgataaagaaaatgaagaaaatgagtctgttttagataaatatattcgtcagcaccgtggagaaattgaagaagccaaaagtaaaaatttggatgaattcattcaggcagaacgtacaaatatagaagttccggttgaagaagaaaaagaagctaagtcagaaaaacttcaagaagtttccaaagaggaaatcgacgagaatgatgaattagcagcttcaaaaattgaaactgaaaaagttactgacagttctggttctgatttgtcagcagaaaataaagacttagaagttgctgacaaggaaagcgaagaaactaaaaaatcaaaaaatgatttagttttagatccagttgtgatggtcgacgctcctgtcagtactttgccagagcaaaaagaagctccacaagttgaagaagtcaagaaaactgaaccaactgacgaagaagaagccgaaagtccacaagatgagaaggtagttgctgcaccagttatgatgtcagcaaacgaagttccaatggacgagccaagtgaaccagaaatttctgaaactgacgctgacactaaaactgattcaataattgacgaaaaatcagaaattgaaccaaaagtaacagaagaaccagtagaagaaattaaatctgattcaaaagaagattctactgaaaataatcaagtccttgaatcgggagctgaggaaaaagtgacagagtcaccaaaagagacaaaaagtgatattcctgataaagttattactgctgaatcagtttcacctcacttactagctgaaacaacatcctttaaagcagataaagtagaagaaaatgcggcaaaaattactgacgaaaagtcaaaaaatcgtaaaaaaccaatcattattggtctatgtgcaattgtcttaattgcagctggagcgattgggtttgctcaatataatagtcatcaaaaagggaaaacggttcaaacttctcaaagcagtcagagtgatttagataaatatcagaaacaatacgatgcttttttcattgacaaatcacatactattttgagaaatagtcaatttagcaagttatcagctcttgaaactttagttgatgctcacaaaaattccatggcatggtcaaatgcagtttctgatacagaaagcctaaaagaccaaattaatgcgattaagaaagtgaatgctctctttactagcgcagcaattactgacggaaaaattgattcagcagctaaagtagtggcaaatgtaaaagttccagaaactcctaaaacaaccaatgaaaccctgaataaattactgacacaagccattgatttagctaagagccaagttgccaaggaaagttcagctaaagcgtcttcaagtgcagcagaagctaaagcgaatcaaggagctactagccaaagttctacatcaagtacagctagtcaaagcaattctacgacgactccttcgtcagcagcttcagcaggttcaagtacaaatgccagcacaagtagtaatactaatggtttgagtagcaacggagttaatttagaagtatcagcagcacgtgtccaacctcaagctggagtcaacacgaatgatcctgctttcacatggggagctggaattaaagaaatggttctgaataaagcccgtgaacgcggctatattacaggagataattatattttagttccaacagcgattcatacaaccaatggttcccaaggtttcccagccggaattgttagtggttattacaatctttatgcaccagatggtcggtatttagtatcaatcaatgctaaaacaggtttctttgttggtaatggttctggtcatgctgataacttagattatgacgcttagaaaataaaaaataatcatcattcagatgattattttttttactgacagaaacttactgacagaaacttactgacagaaacttactgacaaaaaacttactgacaaaaaactttcgccaaaatcagcgaaagtttttacttttatcaattaatcgattagaaaattaataagtcatggtcagtatgagtgaaactttcacaaccattttctgttacgtaaagacagtcttcaatacgcacacctactttaccaggaatataaattccaggttcgttagagaaacacattccttcttgaattacgaggtcatttccggcaacaatagatggatattcgtgaacgtccattccgataccatgtccaaggcggtgattgaaatattcaccatatcctgctttagtaattaaatcacgagcaacagcatcaacttcatgtgcagttacaccaggtttaatgaagtccatggctgcttgttgagcttccttaacgattttatggatttcagcatcaaagtcattaggttgaccaattgcgatggtacgtgtcgcatcagaagcatatccgccactcatgacacccaagtcaaagagcaaaagtttattttcttgaatttcaacattttcaggtgcaccgtgtggattagcagcgcgagctcctgataaaacaagcgtgtcaaatgacatctgtggaacacccatacgtttcatttcgtattcaatttttgcaacgatatcagattcagtcacaccatgacgttcagcagcagtggcaaaaccaatttcaaaacacttgtcagcaaaatcaccagcaactttcattttttcaatttcatctgctgacttaatcaaacgcatttgttcaatcaaaggagtcaaattcacaaaattaacattaccaaattgtgcttttaagccttcagttttagctaaaggaatatctgaaaattcaaccgcaattgatttaacttcggatttcacatgatttttaacaacttcccaagggttttgagaatcttcgtatccgaaaatatccagaccacttgtgtgttctttagctttttccacttccaaagcaggagtaaataacatcggagttgaatctctaaaaatcatcagcccagcaattcgttcatggggatcaattgctagccctgttagataatttagagttgtcggattagtgatgaaagtcatatcgacttccttgtcattcagaaaagctgaaatacgttcaattttgctcaaaatggttcctccaatatttatgaaaatgagtttcttaaattctcgtgaaaataaaaaacactatatcccctattctacgctatttttattaaaaaatcacgtaaaaaaacatagctgaaggttgaaaaggtttacagttaatgatataatttgtaaatgaaaatggttttcataaatactatgaataaaaagaaaagaaagaggatagccaattatggtagaatcaacaacaacaatttatgatgtggcacgtgtcgccggagtgtcaatggcaaccgttagtcgtgttgtaaatggaaatgcaaatgtaaaggaaaagacgcgccagaaggtcttagacgctattgctgagcttgactatcgtcctaatgcagttgcgcgtggacttgcaagtaaacgtacaacaacagttggtgttatcttgccaaccatcacttcaacttacttcgcagcgattactcgcggagtcgatgatatcgcttccatgtataaatacaacatgattttagctaatagtgataatgatgttgaaaaagaagaaaaagttttagaaactttcttatcaaaacaagttgatggaatcgtctatatgggttcatctttagatgaaaaaattagaacttccctcaaaaattcaagaacacctgttgttttagttggaacaatcgatggagataaagaaattccatctgttaatattgattaccatttggctgcttatcaatcaactaaaaaattgattgatagcggaaataaaaaaatcgcttatatcatgggttcattgaaagacgttgaaaatacagaacgtatggttggttatcaagaagctttgcttgaagcaaatattgaatttgatgaaaacctcgtttttgaaggtaattatagctatgaacaaggaaaagcacttgctgaacgtttacttgagcgaggagcaacttctgcagtagtatcacatgatacagtagccgttggactcttgtctgcaatgatggataaaggagtgaaagttcctgaagatttcgaaattatctcaggtgcaaattcaccaattactcaatatacatatccaactttaacttctgttaaccaacccctttacgatttgggagcagtagcaatgcgtcttttgacaaaattaatgcttaaagaagatgttgaacaaaatcaattagttttggatcatgaaatcttttctcgtcgttctaccaaataaaaaatcaagcccttttgagggctttttttatttaaagtaaaaagtatttgacatttgagagaaaagtcgcaataatagagagatgataaaaagaatttattcaatagattaaatgaataaattgttaaggagtttgatatgcaagaattagatttaattattgttggagcaggtcctgttggtctatatgcggctttttacgcaggaatgcgcggtttatcagttgcaataattgaatcagcgcaagttccaggtggtcaaccccaaaatctttaccctgaaaaattaatctacgatattgctggcctaccagcagtgacaggggcagatttgacaaaaaatcttttagaacaactagcacaaatctctcatcgattatttcttggggagagcgttcaaaaaattgaaaaagaagaggggattttttctgtaactactgataaatcaaccagaagagccaaaggcgttttgttgacgactggtgccggccttttgaaacctcgaaagttaggaattgataacgaagaaactttagccaatgaaggaaaaatatcttactttatcacttctctaaaagagtttgagggaaaaaatgttgcggtttttggtggaggagattcggctttagattggtcattaatgcttgaaaaagtagctaaaaatgttcatttggttcatagaagaactgcttttcgtggtcatgaaattacagttgaccgagtgatgaattctaatgttcaagttcatacgccttatactttttcaaatttgattgaaaatgaattagaattaaaaaaagtaaaatcagaagaaagcttgaacttttcgattgataaaattttggttaattatggttttttaacaaatcaagtgactttagctgagaacttagaagtcagtcgtaatggtcgtgttaaggccgattcaatgatgcaatccaatattgagggactttatatcgcaggagacgcaagtgattatccggggaaaatgcccttgatgtccgttggttttggtgaagcagtccatgcgattaatgccatgacgaaaaaacttgaatttgaccacccacttagagggggacattcttcatccattttttaaaataaaaagcgtattctaaataggggtacgttttttttatgaaatacggtataatagagaaagaaaaatgacttgaacttagcttcattaataaaaatgagccaagttttatgagtgctttgtttaaaaagcaaaataaaagtaaattgggaatgtttgatgatattaaatttgattattttagtagccttggtttgggctttcatggttggttactcacgaggcttgattttacaagtcatctacagttttggtacgattattgcgaccttcattgcagccagtaattataaagaattagcacaaaaattgagtatttgggttcctttttcaaatgccacagaaaactcacatctcttactttttagtgataaacttctttttcaactcgatgatgctttttatgcgagcatttcgtttttagcaatttttattgtcgtttatgctattatccgtcttatcggtttatttttacattttgcacttagtcctctgggaagaaatggaaaaatcattgctggaattttaggatttgcggcgacttattttggtttacaaatggtcttgatggtcttgagtttggttcctattgcagcggttcaaagtcaacttgatgctagtattctagctcgttttatggttttacatacaccgatttcatcaggaatcttgcaaaacctttttattgaaaatattgtccacattaatcctctaggatagtgctaggggagaaatctacagatacaacttgaaatttaaatagaatgaataaaaaaattctccaaatattggaatatgataaagtcaaagaacagttcatgaatgctttgacgacagcgcagggtcaacaagaattaaaagatttaaaacctttgacagataaggaaaaaattcagctcctttttgatgaagttgctgattttcgcttattgacccaagaaaatggcctattaaatttaggaaaaacaaatgatttaacagaaatactcagacgtctagagcttgaagccagtctttcaggcaaggaattcgttgaaataaaaaaagtgattcaattaggaattaatattcaacgcttttttgatgaagctgaaaatgttgaaacaccttcactagctattactttggaaaaattggttgatttatcagcattagtcaaaaaattagaaatttttgataatgcgggaagtctttatgataatgctagtctcgaattgatgcatatccgtgcttcaatcaagagtcatcaatcagaaattcggaaaatcatgcaggaaatgctgaccaaaaatctctcatctttgagtgaaaatgtcatcactatccgaaatgaccgacaagtgcttcctgtaaaagcagaaaacaaaaataaaattgctggtgtagttcatgatatgtctgcttcaggtcaaacgctttatattgaaccaaatgcggttgtttcattaaataataaacttaatcaaaagagaattgaagaacgccaagaaatcacaagaatttatcgtgagcttgctagtcaattaaaaccttatagctttgatataagacaaaatgcttggctgattggtcatattgattttgttcgtgccaagtatctttatttagcagcgaataaagcgacacttccagaattaacaaccgataaagatattaccctttttgcagctcgccatcctttgattgaagcaaaaatagttgtggcaaatgatattaaatttgatgcagggctcaatacgattgttattaccggtccaaatacgggtgggaagaccattactttgaaaacagttggtctgttgacaatattggctcaatccggtctgccaattttagcagctgatggcagtcgaattcatctttttgatgatatttttgccgatatcggtgatgagcaatccattgagcaaagtttatcaactttctcaagtcatatgactaatattgttcatattttagctcaagcagatgaaaatagtttggtcttgtttgatgaacttggggcaggaactgatccaaaagaaggagcggctcttgcaattgctatactggaaaatttacgtgaacgaaatgtgaaaaccatggcaagtactcattatcctgagttaaaagcttatggggtcgaaacgcaacgagtaatcaatgcaagtatggaatttaacattgataaaatgcaacccacttatcatttgcaactgggagtgcctgggcgttcaaatgccttggagatttctagaagattaggtctgccagaaactattatttcagtagccagtcaacaaatttctgacagtgagcatgatgtcaatcagatgattgaaaagttggaagaaaaaacgcgtgaagtgattgaaagttcaagaaatattaaaaaaattgaacgagaaaatcaaagtttacataaagatttgacgaaagtctataatcaaattaatcgcgagcgcgagtttgaattagaaaaagcacaaaaagaagctcaagaagtagttaaaaaagcgagtcttgaagcgcaagaaattttgaagaatctcaatgataaagcagcgttgaaaccacatgaaattattgctgctagaaaagaacttgaaggtttggctccaaccattgatttttctaaaaataaggttttgaaaaaagcgaaagcacaaagaggacttaagcaaggggctgaagttaatgtcacttcttatggtcagcgtggtaaattgattcgtttagaaaaagatggacgttggacagttcaaatgggttcaatcacgactcgtttaaatgaagatgaatttgaagtgattgaaagtccagaacaaattcaagccaaaactaaaaatgtcagcaagaaggtgacttctaaagtcaaagctcaacttgatttacgcgggatgcgttatgaagaagcagaactggaattggataattatattgaccaagctctacttgcaaatttgattcaaattacgattgttcatgggattggaacgggtgttattcgagaaatggtacagaaaaaacttcaaaaacaccgtcatattaaatcttatgaatatgcaccaattaatgctggtggctctggagcaacgattgctattttgaagtaaaataataaatttctcaaaatctattttcttgaaattttaagtgaattacactagaatagtcttactgaagaaaattatttcaatgaaggagataaaatggaatataatattactgatgcaacgtttgatgaagaaacaaaagaagggcttgttttaattgacttttgggcaacttggtgtggtccatgtcgtatgcaagcgccaattttggaacaactttcagaagaacttgacgaatcagaacttaagatttgcaaaatggatgttgatgaaaacccagcaacagctcaaggatttggcattatgtctatcccaacattgatgttcaaaaaagatggtgaagaagtaaaacgcattgttggtgttcaaacaaaagcacaacttaaagccgttattgctgaattatcataataaaaattactgacagaacttttttcttcttgaaataaagtttgtcagtatttttttatattcaattctagtgaaaagttctgtcagtaaaagagagtggaagtatggtacatactgacaagtctgtcagtaaaatgagcgtgacaaaaagcttttaaaatgatatgattgagaaagaaaaatttcaaagaaaatagggatttggaaggtcaaaaagacttttcaaattttgaggagtttaatatgtcaaagaaaaaagatactgaacttgaaattattgatacagctgacggagctgtcattaaaagtggaaaaaaaacaatcgccgaaattaaagaaaaatcaggaaattttgtcattgttttttcaggtaaagaaattgctacagtgacttcttttgaagcagctcttgaggaagcaattatggcctataatctttcgatttaaagatttatttgtgattgatttgaaatttctaagttataacttgaaattaataagataatttgttaaaatatttcttgtcgtcataaaacaatcttggggtatagccaagcggtaaggcaagggactttgactccctcatgcgttggttcgaatccagctaccccagtaaaaaaacgtaaaaggaaacgccgtttccttttttctttttgcgaaaatatgctagaataggggaaagcatttatgaaaatgtaaggagaagtttatgagaaaaacaaaaattgttgttccaatcatgctgacagagttagcagagcttgagaaagtttctgtcagtgattatcgaacagcagatattgttgaatggcgtgccgattttttgtcagcagatgaaattttagagatggctcctaaattctttgaaaaatttaaagaaagtaagattttatttactttaagaacagtcagagaaggcggaaatattcaagtttctgaaaaaaaatatttacagattttacaagaaattttgacttacaatcccgcatatatcgatgtcgaattctttacgcacggcccttcatttgccgctttgaaagattttcgggataaaatggtactctcttatcataattttgatgaagttccgtccgatttaaccaatcggttgattaaaatgcacgaagaaggaactgcctttgttaaagttgctgtgatgccagaacgtgaatgtgatgttcttgatttattacaaatcactcgtgatatgactttagaatacggtgaacattttatcagcatggcaatgggtgacttagggcgactttcaagaatttctggttatttgactggttcttgctggacttttgcaagtttagacaattctagtgcgcctgggcaaatttctctcaaagaaacagagtatattttggatatcttagaaaaatagaaaaatgatctggtcagagatattgttcggttatgacagataatttttttacttttatttggaccagtagaatggaccaaatgctttgtcagtgaaaatgttataatagataatgaaaaaggacgctttgttcattagaaattaaaaataggattaatttactgacagctattctgtcagtaaaaaaggagaaaaaagtggttattagccgttattcacgtccagaaatggcagagatttggtcagaagaaaacaagtataaagcatggcttgaagtcgaaattcttgcagatgaagcttgggcagagcttggggaaatcccagcagcagatgtgaaaaaaattcgcgaaaatgcaacttttaatgttgaacgcattcttgaaattgaaaaagaaacacgtcatgacgtggtagctttcacacgctctgtcagtgaatcattgggtgaagaacgcaaatgggttcattatggtctgacatcaacagatgtcgttgatacagcttatggttatctttataaacaagctaatgatattttgcgcaatgacctaaaaaacttcgcagaaattgttaaaaataaagctttagagcataaatacacagtaatgatgggtcgaactcacggcgttcacgctgaaccaacaacttttggcttgaaattagccacttggtacagcgaaatgaaacgaaacattgaacgttttgaacatgctgcgaaagctgttgaagctgggaaaatttctggtgctgttggaacatttgctaatattcctccatttgttgaagcctatgtttgtgaaaaattagggactcgtccacaagagatttcaacgcaagtcttaccacgtgatttacatgcagaatacttccaaacgttggcactcattgcgacatcaattgaacgcatggcaacagaaattcgtggattacaaaaatctgaacaacgtgaagttgaagaattctttgctaaaggtcaaaaaggatcgtcagcaatgccacacaaacgtaacccaattggttctgaaaatatgacaggtttagcccgcgtcattcgtggacatgcaattacagctcttgaagatgttagtctttggcatgaacgtgacatttcacacagttctgctgaacgtatcattgcacctgatacaacagaattattggattatatgttgaaccgctttgggaatatcgttaaaaacttgactgttttcccagaaaatatgaaacgaaatatggatgcgacttttggcttgatttacagccaacatgtcatgttaatgttgattgaaaagggaatgacgcgtgaagcagcttacgatttagttcagcctttgactgcacaatcttgggatgaacaagtgatgtttagaccattgcttgaagaaaatgaacaaattcgtcagtatttgaatgatgaagatattgataaagcttttgattacaattatcatttaacaagagtcgatgaaatttttgaccgtgtctttgattaataagaaagcctactaaaaagtaggtttttttgttattaaaacgaaatataaaaaggattgacaaatttaatgaaaacggatacaattgtaaatgtaaatatgagaacgttcccacatgtgaaaggaggaagtaatgacaaccatcaaacaagttgcgcttgaagcaggagtttcaaagtccactgtttcacgttttattgctcagaatggctatgtaagtgatgaagccagagaaaaaattgaacgagcaattaaaaaactaaatttcagacccaatctttctgcccaatctttaaaaacgaaaaagaatcagcttgttggactattattgccagatatctccaatccttttttcccaatgctagccaaaggagcagaggaatttttaaaagaaaaaggttatcgtgtgatgctcggaaatattggtgaaaagaatcaatctgagcaagattatttgaaagttttgattcaaagtaatgctgctggcatcatttcaacccatgattttaaagaagactttcctgatttggatattccaactgtaatcgtggaccgagtaggccataaaagtaactatggtgttttttcggacaatgagtcaggtggacgattagcagcaaaagtgattgtaacagcaggagcaaaaaaagttgctgtagtcagcggtcctttgaatgccacaaatatcaataatcgttttaaagcaagtattgcttatttaaaagaaaaacaagttgattttaaagctttttacagtcaaagttatgattttgaagaaattcagaaagaggcgagagaagtgcttgccaatgaagaaaactttgatagtatcattgcaccatcggatattcatgccatggcttatatccacgaaattcatcggttaaataagaaaattcctgaggatattcaaattattggttatgacgatattcaaatgagccaattcatttatccagcactctcaaccattcatcaatctgcttatcagatggggcttgaagctgctcaacttatttataaaatcgcgactgaccaagtaattgagaagtctaaaattgaactccctgttcattatgtagcgcgtgaaacaattcgacaaaagagaaaagaatgaggaaaaattaatgacaaaagtaagtgttataggaagcatttcaatggatttagtcacaaggactaaccgagtgccaaatgctggagaaacagtatttggtgaagatttcgctatggttcccggtggaaaaggagcgaaccaagccgttgcttttgccagactttctcccaatgaagtaagtatgattggagcagtaggcaaggatgcttttggtgagagtattttgcaaaacttcaaagaaaatgcagttctttttgaaaatgtgggaacggtaccacaaacaacagggattgctcaaattactctctatgatgacgataatcgtattattattattccaggtgctaataatgaagttctaccaagttatctagcagacctttgggagaaaattaaagaaagccaacttgttattctacaaaatgaaattccacatgaaacaaatctagcgattgctaaattctgtaaagaaaatgcgataaaagttctttataatccagctccagcaagaaaaacagatttggaaatgattgattttgttgattatatcacaccgaatgaacacgaatgtaaggaactttttccgaatttagcacttgaagaaattctcaaaaaatattcaaatcgtctgattgtcaccttaggaagtgaaggagtcattttccacgatggagagactcttcaaaaaattcctgccataaaagctaaggttgtagatacaactggtgcaggagatacattcaacggagcctttgcctttggtttgactgaaaacttatcaattagtgattctatcagattagctgtcgttgcttctcatttatctattcaaaaatttggtgcacaaggcgggatgccaaagctatcagaagttaaagcaaaattaaaagaacttgaaattaatctctactaaaaaagaaagagagttaaatttatgaaaaaagaaggaatacttaatagtgaattagcaaaaattgctgacgatttgggccatactgaccaagtttgtataggagatttaggactaccagtaccaataggtacccccaaaattgatttagccctgaccagaggaaaacccagttttcaagaagttctggacatctatttggaaaatattttagttgaaaaagtctatcttgctgaggaaataaaagaaaataatcctgaacagttagcgattttactgacaaaattatcagcagatgttgaaatagtttttgtcagtcatgagaccttaaaattaatgaatcatgaggtcaaagcagtggtgagaacaggagaaaatacaccttattcaaatattattttacaatcaggtgtcgctttgtgaaaaaggaggaggtcaattttgaaaatagaaatgaagaacatttctaaatcatttggaacgaataaagttcttgaagcaattgatttaacgattaattcaggagaagttcatgccttaatgggagaaaatggggctggaaaatctactttgatgaatattctaactggtctatttccagcttctggtggggaaattgagattgacagtgaaaagaaaatttttaaaaatcctcaggaagcagaaggatttggaattagttttattcatcaggaaatgaatacttggcctgatttaacagtcttagagaatctttttttaggacgagagataaaaaataaatttggtattttagatacgaaggccatgcgaaaaaaagcaaattttgcttttgaacagttgggagtaaaaattgatttagacaaagaaattggtaatttatcagttggtcagcaacaaatggttgaaatagctaaaagttttttgtctgatttaaaaattttgattatggatgaaccaacagcagcattgaccgaaagagaaacagaaagattgttttcagttattgctggtcttaaaaatcaaggggttggaattatttatatttctcatcgaatggaagaaatttttaaaatcacagattgtgtaactgtcatgcgtgatggtctagtcattgatacgcaaaagacgaaagaaaccaatgttgatgaattagttagaaaaatggttggtcggtcaattacagattactatccccaaaaaaatgctgaaattcgagaaattgtatttgaagccgaccatttatcggcagaattttttaaagatatttcattttcagttcgttcaggtgaaattctcggatttgcaggactcatgggagctggtagaactgaggtcatgcgagcaatttttggaattgataagctaaaatcaggcatgataaaaattaatggaaagagtctaactatcaataacccggcacaagcaatcaaagaaggaattggctttttaacagaagaccgaaaagatgaaggacttgttcttgatttctcaataaaagataatattactcttccgagtacaaaggattttattcatcatggcctctttgacgataaaacagcaacaacttttgttaagcaactctctgagcgtcttaatgttaaagcgacagatgaagaacaaatagttggttctctatctggaggaaatcaacaaaaagttgtcctcgccaaatggattggcattgcgccaaaagttttaatcttagatgaaccaacacgaggagtcgacgtgggagccaagcgtgaaatttatcaattaatgaatgaacttgctgaacgtggtgttccaattattatgatttcaagtgatttacccgaaattcttggtgttgcagaccgaattgcagtgatgcatgaaggagaaatagcaggaattttagccaaaaatgaagcaacacaagaaaatgtgatgcagctcgcaacaggaggacaataagtgtgaaagctctatctcaaaaattcagttctttaacgacaatgattgctctgattgttttgatgattatcattacgtgtatcaatcccaactttatgacggcaaacaatttgctaaatttactcttacaagtcacggctaatggatttattgcctttgggatgaccttcgtaattctaacttcaggaattgacctgtcagttggcgcaattttagccctttcaagtgcagtgtccgcaggttttatagcccaaggaatgcctttaccgctagcagtagtctgtgcgttaatcattggtgcttttcttggagcgatcaatggtgcacttattgcctatgggaaattggcccctttcattgtaactttagctactcaaatggtttaccgcggagcaacccttgtttttactgatggtaatccaattactaaacacatggatggctatttcttagcctatattggacaaggttatttactgggtattcctttccctgttattttaatgattcttgttttcattgttttatggattttgcttcataaaacagcctttggtaaatcagtttatgctttgggtggtaatgaaaaagctgcttatatttcaggaattaaactaaataaagtaaaaattgccatttacactttatctggagcaatgtccgcaatttctggtttaatcatcagttctcgtttgtcatcagcaacgccacaagcaggatctggctatgaaatgtatgcaatcgctgccgttgtccttgggggaacctctctaatgggagggaaagggcgaatgtttggaacaatgattggggtattaatcattggtgttctaaataatggcttaaatataattggtgtgtcagccttttggcaacaagtcatccaaggattagttattctcgttgcagttcttatcgatgtcattcgtagcaaacggaaataggagagttgaacatgaaattagtaaaaaaattaacttttgcttttgtagctactttagcagtctcaactttgaccgcatgtagtctttataccggcattccaggccgtgatggaaaagaaaaagtagaagaggtaacgcataagaaaccaaatgaattaaatattggtgtttctatttcgacaacaaacaatccttattttgtttcaatgaacaatgcgattaaatcaatggccaaagaaaaaaatacaaaattaacggtttctgatgcccaaaatgattctgcaacacaattaaataatgttcaaaatttcatcagccaaaatgtggatgcgattttaattaatcctgtagattctgatgccattgttccagccattaaagcagccaacaatgcgcatatcccagtgattgcaatggatagaggttcaaatggtggaacagttttaacaaccgttgcctctgataatgtggccgctggaaaaatggcagctcaagccgttgaaaaattggttgggaaaaacgtaaaagttctggaactttctggaacaccaggagcttcggcaacaatagaccgtggtaaaggatttaatagtgaagctaagaccttaggtttaaatatattatccagccaatcagctaattttgacagaacaactggtttaaataccactcaaaatatgctccaatctcataaagacgtccaagcaatctttgcgcaaaatgatgaaatggcactgggagcagctaaagctgtgcaagccaccggacaaaaaatagccatttttggaattgatggtgagtctgaaacacatgatgctataaaagcagggacaatgaccgcaacgattgctcaacaaccggctaaaattggtgaaatggctttgcaagctacctatgattattatcaaggtaaaaaaatagcacatatgataaattcgccaatctatcttgtggataaagataatgttgatgagcaccaatggtagtataaaaacaaaaattctgtcgctaggacagagtttttttatttttaaaaataaagatgaataatgaataaaaatataaatttgtccaagtgacatttttaaacttcgcaaaaagtaaaatttataatataatagatagctggggctcttttaggtttgtaaaactaaaaagagtttatcctctaaaaaaaggagaaaaaatgggagaaaatactgttcctcaaaaatctagtgataatgcgggttcaatagtggctttaatggtggccctattggtagcaatctttgcttttcagctcaatgcttcaatgctctcgcctgctttggttaccatgcagacccaattacacacgacagcttcgtctatagcactaacacaaaccatcttttttacagctgcggccttatttgctctatttttgcctcgtttggcggatttgattggacgaaaaaaagttctaattggaatgcttactttgacaatgattggttgtcttatctcaggatttgctacaaatgtggggattttgatgattggtcgtattttacaaggtgctgctggccctgtggttccgctttgtttaattattctgcatgtgaaagtgcgtgatgagaagagatatgcaaaattaatggccatactcacttcaatcaatggtggaattgctggggttgatgcattagcaggtggttggctagtaagtcatggtggatttcgttctgtattttttgttatgggaattactgcggcacttgctattcttttagtaagttttggaacgcaagagtcaactgcaaaagatacaccaaaaatggattggagcggagtcattcttttagtattggcaatgggtgcgctcttgagtgcggtgaatgccttgcaaggaagttttggaaatcttggacttcctaattggcttttagcttcagtcttggctcttttaggtttgatttgttttgttggattttggcaagttgaaaaacgagtgaatcatccaatggttcctattcattatttgaaacaaagaagaacttgggggttattaattacaactctcctaacgatgactggtgtctttgcaattatgaatggtattattccagctttgggtcaagatggtaagtttggtttgggacttggggcagatatggtttctcttgttacccttactccttatgcgcttgctggcttattctttggacctgtttcaggattcttggctgctcgctttggctttacaaaagtccttcgggttggacttttaacgacgattatcggtattggtttggccgttgttggagtgctacaaccttcaatctggcttttattgttggtatctaccttcattgggattacctatgctggaataacaaatattatgttaaatggtctgggaatcgtgctttcaccagaggataatccaggttatcttccgggcttaaatgcaggaatgtttaatttaggagctggtatcagtttcattattttgtacgcagtgccaacgcttttacataccagtgttggtggaagtagttctggttatatttctggaattgtcacaggattgattcttgttattattgctttctttacttcattttcaattccagattctaaaaatgtaaaataaattagttacttataaaaaactctgttggaattccggcagagtttttttattcgggtaaattatcaaagtattcaggaaaagcttgtaaaactgccatttcttcgtcaaacatcaagtgcaaatgcttggcagccgctgtgacagctttttctccatcatgattttcaacagcggagagtatttccttgtgttgctcaatcaaggtattccatggtaaatcagaaatcgcaagacgtaaccaacggaaacgattgaactgaatattaatggtttgaagccagtcccagacttgggcatggttagtcattaaataaaaagttttatgaaattcttcatcagcgttaaaaaaattgtgatattcagctttagcagcatattgttcttgaagttcaattgcatctcgtgcttggttgagtaaaagattattattctctaaagccgcagcttcggaaacaattttggcttctaaattttctcgaatgaatcgagcattgatggcagcatctaaatcaatttttgtgacgaaggtccctgattgagggatgctataaatgagtccatcacgacgtaaacgaagaagtgcctctctgacaggagttcggcctaattgcaaatcaatttcgatatttttttgtgaaattttttgtccaggacgatattcattcctgagaattttgcctgtaatttgtttataggcctgattctgtagattaaaattcaattcattcattctgtaattatagagcagaggggcggtaaagtcaaataataaaggtattcttttaaaataatgtcttttttttaatatattcttgacaacggtttcttaaaagtgatatactagttttcgtagaagaaaaactgatatatcacttttcgagatttaaaggagaaatcatggtgaaattgcttgatgattatttgataaagggtgaggaatttaaaaaagcaaaaattaaaattcctaactttaatcaagacaaagttatagagtcaacagctgataatccagtctgggtccactttggtggaggaaatctttttagatgtttccatgcggttgtcgcccaagacttactcaatcaaggagaactcaactcaggtcttattgtggctgaaacttatgatgatgaggtaattgataaaatctatcgggcctataataatcgttttctgtcagtgacaatgaaaacagatggagcttttgacaaagaattgattgcgagtgttgctgaaagtttttattttaatgcagaaaataccgagggttgggctcatttaacaaaagtctttgaaaatccatctttgcaattgacaactttttcgattacagaaaaaggttattcactacgggattcaaaagaccaattgacgcctttggcacttgaagatatgcaaggaagaagcaagcctaaaaccaatatgggggccgttacttatctcctttatgcaagatttaaagctggtaaatttccgattgccatggtcagtacagataatttttcagaaaatggtttgaaattgcaagaagcgattttgaccattgctaaagcttgggtggaaaatgaaatcgtagaacaagatttttatgattaccttatcaatcctaaaaaagttagtttcccctggtcaatgattgaccgaattacacccaatccgtctgaaaaagttgcaaaattactgacagctgatggttttgaggatacagaaattttacatagtcaaaaacatacaaatattgctccttttggtaatacggaagaagttcattatttagtgattgaagatacttttccaaatggcaggccggcattagaaaaagctggagttatcttgactgatcgtgaaacagtcaatgatgctgatcagatgaaagttaccgcttgtttgaaccccttgcataccgctttagctatttttggaagtttattagattatcattcaatttgggaagaagttgccaatccagatttgttagcacttgttaagaatttggggtatggcgaggctttgcctgtggttaagaatccgaaaattatcaatccgaaagattttattgaccagttattgactaaacgtttaccaaataaaaatattccagatacaccacagagaattgcggcagatacgtcacaaaaaattcctgttcgctatggcataacgatttgacactatattgccaatccaagattttctgttaaagaattggaatttattccattagtcattgctgcttggtgccgttatttaatcggaattaatgatgagttagaatgtttttctccaagtcctgaccctcttcttgaagagttgcaagcttttgttgccgaggtaaaattagatggtagtcagcaagaaattcatgatattctaaaacctatcttatctaatcaccaaatttttccaaatgagatgtaccaaacagggctagctcaaaagattgaaaattactttaagcaaatgcttcaaggcaaaggagcagtgcttaagacgctacaaaatgtcctaaaggaacacggaaaaaattactgacagactacttatttagaactgtcagtaaaaaatatctgaaaatttactgacagaatgtttaattttgagctgtcagtaaaaatactgctatcagttttccatttctgccaaattgtgaaaagaaaaaactgaccaactttttaatcaagctttaaataaagttttggcagatttgcaaaatcaaaattacgaaatcattgacgtaaaactttcagcaggtcttaccgcttggtgggaagctatagcacgctatttgattttatataaataagataaaggaataaaaaaatggaaatgacaatgcgttggtttggttcaaatgcagataagataaaactttctgaaattgcccaagttccaggtgttaaaggagtcgttggaatgattatggacattccagcgggagaaatttggccaaaggagagaatcaaagcacttaaagaagaaattgaagccgcaggtttaagtttaaaagtaattgaatctgtcaatattcatgatgatatcaaaattggtttgccaactcgtgataaatatattgagaattataaagaaacgattcgaaatcttgctgagtttgggattgaagtgatttgctataattttatgcctgtatttgactggttgaaatcagatttggattatcgtttagctgataattcacaaacaatggcttttattgctagggatattccagcaaaccctcaggagataattgaccgcgttcaagcagcggatggtggcttttcactcccaggttgggaacctgaaagattatcagaagtcagaggactctttgaggcatacaaaaatgtcgatgagcataaattgcgtgaaaattttgcttattttctaaaagcaatcattcctacatgtgaagaagttgggattaaaatggcggttcaccctgatgaccctccttatccgatgtttgggcttcctcgggtggtgaaaaatcgggaagatttagattggatatgtaatgttgtagatagtccgtcaaacgcgattacgctttgtacggggtcgattgctgaagatccagctaataatgtctatgaaattatggctgaatttgtcaaaagagaccgaattccttttgcacatgtgcggaatattaaatttttgccaagtggtgaaaaagatttttatgaagctcctcatctgtcggagtatggttcgcttgatatgtataaaataatgaaagccatgtatgataatggttttgatggctatattcgtccagaccatggtcgaatgatttggggagaaacaggacgcccaggctacggtttatatgaccgagcacttggagcaagttatcttaatgggctttgggaggcgcttgagaaaacgaatcagtaaataaaaatgatatgaagaaatctattttaaagaactttttgtgaaaaaatgtgcggagaatactctccgctaaaattaaaacgttggagtaagcgtttcacaaagttcacaaattaacaaagtttatggaaaaatttgtcaattttcactgacaaaaatataaaaataggagaatctgtttaaaatggcagaaaaacaaaaaacttcatgggtttataccccaaaagcaatcaatacaaggcgtggtcttctttacggtttgactgatttaatgggcggaggctggaataacattgtttcaggagtcatctttgtctttgttctttcacaaggaattagtcctctttttacaggagcagttttgggaattggtcggattattgatgccatctggtccctcttttttggggcaattactgaccgtttttatcgaacaagattaggacgaaaatatggccgacgtcatttctttattgcacttggcggaatattatttgcgattttatttccaatgttttggatttcaactagcagttggcaatattatctttgggtttatgttgctattgaggtagcgatttccatgattttaattccttgggaaaccttgcctacggaaatgacgcctgattataaaaaacgaaccactctttcagggagtcgaatgtttatttcagcaactggaacggctattgtcttctttaccttagctgtacttaagtcatttaataatcctaatgcttatctttatacgggaattacttggacggtcatttttgtcattgccattttcacttcatggcgagcaagctgggagcgtcctttaactccagaatttctagcagaattagatgctcaaccacgacttggatttagtggatttatgaaaaaaacagtgacagattactttggcactttcaaaaataaatcattcagaaaacatttattggtttatctcctctcatttacaggaaaagatttctattctacactgctcccaacttttatcgtgattggattgtccggaacatcggcaaatgctccgtgggttctccaagcactctcagcatttggtattctatcaaccattgccgtagtaaaattaatggtcactcgtggtccgaaatatttatttactttgagttatttggcgattatagtggccatgttaggttattttgttatctatttgacagggattaataatccaatgtggatgcttgtgattgtttccattatttatcaacttggacgaggaattttagaatttactccttggaatgttttcccttttatacccgatgttgaccgaatttttacacatggtgataaagcaggcgtatatgcttctgtcatgactttctttcgtaaatcaacaggggcacttgcaacatatattgctggttgggctcttgaagaaattggatttaattccacaacaatgacgactcatgcaaatacaccattaggtattcaacacggaattatgttgattttcatctttgttccaattggcttgttagcagccgcattgattgcagctcgcacctttaaacttaatcgagccaatcatgatattttaaaagcagaattgcaacgtcttgaagaaggaggctcaaaagttgatgtaactcttgaaacacgtcaggtcgttgaattactgacaggtcactcttatgaaaaatgttggcctgaccaagcagacatttaatgacaaaagcttaaaagtttactgacaggcgctgtcagtaaatttatcggagaaaaacgatggaaaatcaattgttaacactaaaaaataatgagcttactgttcaaattaatccaaaaggggccgaattaactcatgtaattgagaataaaaataaatttgattttatttggaatggctctgagtggccaaaacatgccccaattttatttccggctattggacgttcaactgatgatgaatatttgctgaaccagaagatttatccgatgcaacaacatggttttgcttcagattatttctttgaaattattgaccagaaagaagaccagataagtttgtcattaaaagataacgaggaaacttatcaatcctacccttttcaatttgaattaaaagtcacttatcaactggtcagtaaaaaattgaagattcaatttgaaataaaaaatctgtcagtaaaaaaattgacatttgccttaggatttcatccagcttttaacctatcagcaaattttgaagattaccagatttcctttgaaactaaagataggactttaaaacaatttgaaattgtcaaaaatccatttccttatcgttcgggaaaaatcatagaaattaataaagctgtcagtaattttccacttgaaagagaattctttgaaaaagggctcgtcatttttgacaataaaatcgagaaggtaaaacttttttcacaagatacagattatcaaatgaccatgaaaatggcggatttcccttatctttgcttgtggacaaaagaagacgaaaatctttcttacctctgtattgaacccttccaaggactgcctgatattctcaatcaaaaacaagaactcttgcaaaaagaaggaaatatcagcttaaaatcaaatgaatcaaaaacttacgaagttgaattaacttttaatagtaataaaggagaatcatgaaatttttatcagaagattttttactaacgaatgaaagtgccaagatgctttttcacaaacatgcagaaaaaatgccaattatcgattatcattgccatcttgaacccgcagaaatttatgaaaataaaaaatatgaaaatttaacacaaatttggctaggtggggatcattataaatggcgtttgctccgtgcgaatggcattcctgaaaaattgattactggagatggagaggattatgaaaagtttttagcatttgctaaaacacttgaaaaatcatttggtaatccaatttatgaatggactcatctggaattaaaacgatttttccatattaataagttgatttcaagcgagacagccaaagaaatttgggatgaagcgaaccaaatgcttgccacagatgatttcagaccacgcgcattgattaaaaattcacaggtaaaagttgtttgtacaacagatgaccctgtttcaacgctttcttatcataaattattagccaaagaggaaaaagatttcaaagttttaccagctttaagaccagaccatttaatttcgattactgacggacattttgcagactatttgacagagctgtcagcagtttctggaattgaaataaaaggttttaagacgatgattaaggcacttgaacaaagatttgaatttttcacaagccttggtggacgtttgtctgaccactccttatctacctatacttttgcagaaactaaaaacgtggatttagattctatccttcagaaagccaaagaaaatcaaactttaacagacctagaatataatcaatacattacggcattaatccttgaaattatgaaattaaataaaaaatttgaatggacaatgcaactccatgttaacgtcaaccgttctatcaatggcccagccttaagtaaaattggtgaaaatactggatttgatagtatgggtactcaagctaatatttctgaggaattaaccaaactctttagcaaagcagcagaacttgaaaccataccaaaaaccattctctactcccttaatcaaaacgattggcttgaattagccacattgattggctgttttcaaggtgaaggagtgcaacagttacaacttggagctggttggtggttcaatgacaccaaaaaaggaatggaaaaccaattagagatttttgcttcacaaagtttattgtccaattttgtcggaatgttgacagattcacggagctttttaagttatccacgtcatgaatatttccgtcgcgtcctctgtaattttgttggacagttgattgaaaacggtagaatccctgataatgaagcacttgttggaaaaatgattgaagatattagttataataatgtgcatgattattttggatttttcaaagatgaggactctaagtaatgactgaatttataacacttggcgaacctttagtagttcttgcctcagaaaatcaagatataagtttagatgcagctgagcatttcagcaaatatttagctggtgcggagctaaatgttgcgattggtttgagtcgtctaggacataaaggaatttacctttctaaagtcggagaggattcatttgggaattttattattgaatcagtcaaaaaagcggagattgaaacgacctatctcaccaaagataaaaactattcaacaggcttttatttaaaacaaaaagtaagtgagggcgacccaaaagttgattattatcgcaaaaattctgcagcggccaatttatccattgctgaactaaaagctctagatttatcagggataaaaattgcgcatctctcaggaatttttccagccctttcagaaactagtttaaaaacttttcaagcattcaatcaaaaattaaatgaagcagatattttaaccatttttgaccctaatttacgacctgtactttgggacaatcaagaaaaaatgataagaacaatcaatgatttagcaaagcaaaatcaagtcattctgccaggaataaatgaaggtgaaatcttgaccggttcatctgaaccagaaaaaatcgctgatttttaccttgagcaaagccctctcacaaagattgtagttgtcaaattaggtgctgacggtgcttttgtaaaattaaaaaatggtgaacaatattttgtttctggatttaaagtagcaaaagttgttgatacggttggagcaggagacggattcgccgttggtcttgagtctgccttacttgaaggaaaaaccttaaaagaagccgtcaagctcgcctgtgccgttggagcattagcagttcaaagctcaggagatagtgaaggttatcccacaaaagaagaactaaaagcattttatgaggagatgtagtcatgcaaagagcagaattattaaataaagtgattcaatcaggagtcgtctcggtcgtccgagctgagagtggcgaaaaagcattaaaaatcgtagaagctgtcgtctcaggaggaatcacttctatcgaattgacctattcagttccgcgagctaacgaagttatttctgatttggtagccaagtatctaggaacagatgtagtgatcggagcggggacagttttagatccgacctctgctcgtttggccattgttgcaggggctcaatttattgtcagtccaagttttaacaaagaagtcgcaaagatatgtaatctttatcagattccctatgttccgggaattttaactccactcgaagctcaaaaagctttagaatatgggtcagagttaatcaaacttttcccaggtgatattacaggtcccaaaatgataaaagacttaaaaggtccatttccttatattaatatctttccatcgggaggagtaaatgttgataatgttgctgaatggtttgcagcaggagcagtagctgtaagtgctggaggtggggttacagctccagcagccaacaacaattatagtggggttactgaaaatgccaagaaatttatggcagcatttaaggcagctaagaaataaaaattagctattaattttccctcttgaataataaaaaacttcattttttggagtttttttattttctaaagttcagtccaattatttttattaagtaaaagtaatttgggctgtaagcgctatattttggtaaaataattgagttataataaaaaatacaagggagcgtttttatgattaattatgatttagacattctctttttttcaaaacataaattatggaaattagagcgaatattggaggtcactaatctagataaagaaaaattttatcgaatattggaggaatttaatcaaaaattagaaaatcaaggtttaaaaaaattagattataaaaatgaatgcttagcaatttttgataaaatagaaaattttgaagaaactcgttattctatcaatcaaaagacatttattttatcagaagttgaaagacgttcccttatatatctacttatttttacaaatgaatcttccctctcaatagctctttttcaaaaatatcttcaagtaagtaaaaatacggttttaagtgatttaaaaaaacttagagaggagcttatgagcaaaaatattcagattgaatattcaagaaaaaaaggattttaccttaattttgaggagaaaattttacaggagaaggcttggtattatttgcaaaatttatctgaggacgcaggattttataccttatcaaaagttttaaatgataaggatccattaactatttttaagaataatcagctattgaaaaagataatgcaagaactacagattgagattgtttatagtcgatatctttcgacattactgtttgcaagtctgctcaagtgtagaggttttgaaaaggggagtgaaaatattaatgagctactcaaatcattaattattgggatgtcggatggaaaaaatacaattgagcaagacaatggtttataccgaatggcctttaacattatggaaaatgttatgaaattagcagcaattgaattcgatgatttcacaaagacctttatggcactattagctcacctaactcctgcatactatcgattaaaaaatcattttgaattaaaaaatgtcctgcttgaacggataaaaaaagagtactactccttgtttttactgatggataacgtccttcaaccattaaaagaagaggtcggtgaaatttcagaatctgagaaagcttattttgttattttatttggtggagagatttataaaaataagtactcaggtaaatcattaaaagcaattgtactctgtgtaaatggaatcagttcgagtttaattatgcaaaaaagactagagagtttattcccgacaatggaatttattctgagtgctcgagtctctcattttgaaaaattacctataaattcatatgatattattttttcaacggttcctgtaaagtcagacaaaaaagtttatcttatgtcagcttttccagagcagcgtgaagaaaataagctctataatcaagttttacaagattttcagctcccaggttttataaaaccatctgctcaaactattttagattcaatagaaccttacattattataaaaaaaccagcaagtaaactggatttaataaaaattattgaaaaaaaattaaatcgtactagaaaagaagggaaactatcaggagttatgctaacagatttacttacaaaagaaaaaataaattttaccaatagagaattgacctggcaagaagcaattgaattagctgcacagccccttcttgataaacatgaaattgaagagcgttatatcaaagctattattgataaagtagaagctttcggcccttatattgacttaggattgggaattgcccttcctcatgctcgtccagaggaaggggtcaaaaaattaggaatgtcatttttaagatgtgaacatccagtaaagttaatgaacgatgataagcatgaaattaaactttttattgttttagcagctattgataatgagacccatcttagagctttgtcaacacttactaagatattatcaaataaagaacgcttgggtcagttacttgcagcaacaaatgcaacagaagttgaacaaatacttttagaagaagaaggagaaaaataatatgaaatttgcatgtgtatgtcaatctgggttaggaacgagttttatggttcaaatgaacattcagtcattattagaagaatcaggagtaaatattgataatttcgaattggagcatatggatgttgggtcagcaacaccagatgcagcggattatttttttgttgaggcaacattagtatctgctcttcctaatattccaacagaaaaaattatgccacttcagtcaattattgataaagaagttgcgcgtgaagcactttataaagtgcttgatgaaaataacataagtcatcaataagaaaaaataaatcgaatctataaagtacaaaatttttctagactagaggagaaaaataaaatgaatggtattttaaactttattgtatcagtcgcaactactccagcgcttttagttggattaattgcaatgttgggattgattttgcagaaaaaaacagcaagtacagttatccaaggttcaattaaaacatttgcaggttttttgtttttgaccggaggtgcggggatattagttacctcattgaatccctttgcaacgatgtttcaacatgtctttaatgctaagggagttgtgccctccaatgaagcggtggttgctttagcattagtgaagtatggaacacccgcagccttaattatgattgtgggatttattgttaatgtaatacttgcacgttttacaagatttaaatatattttcttgactgggcaagcaatgctctatgtatcaacaatgtcagctgttgtacttatttctgctggactaggaaatggttggttgacaatcttgttaggaggaatatttgaaggaacattgctgacagtcacacccgctctaactcaacgctatatgcggaagatcactagtaatgatggagttgcaatgggccatactggcaatataggctatgctctatccggttggcttggagaaaaatttggaaataaggatccagaaaaatcaactgaaaaattaaatatccctaaaaaccttgggtttttgagagattctactgtttctatttctctagtaatgatggttgtctatattattttagctttaattgcaggtcctcattttgttgaaagtccagctttgtctgctggaactaattatattgtctatgcggtcattcaagcagggacttttgcagcaggatttgtggttgttcttcaaggtgttcgtatgattttgtcagaaattattccagcatttcaagggattgctaaaaagcttgttcctaactccaaaccagcattagatgttccaatagtatttccttatgcgcccaatgctgttttaattggattttttgtctcatttattgttggagttatttctatgctaataatgcttggcttaggaacaactgtgattattcctggtgttgttggtatcttcttttgtggaggagcagcaggagtttatggcaatgcttttggaggtttgcgtggggcgattatcggctcaacagcgaatggattactgttagcttggggtccacttttaattctgcctgctttaggttcgtttggagcgaattctgcatcgacctttgcagattcagattatattgtttcaggaggattgcttgggggaattggcaaagctggatcaatagcattaatttcctttataataatttttctcttgattgtattaatgacgagtttgattttgaatagaagagataaaattaattcaaaaagcaaagaattataattgaaaaaataaattttttgaagatttataaaacaggtcaaccgcaacctttcccaccaaaattaaaaagattttcatataaaaacataaaaaaagaaaaaaattttaatttcagagaatgaaaaccgtttctaacttgtgttataatgtgagtataaataaaaaatatggagaaatcttatgtttgatactactgatcaattggctgtaaatacgattcgtactctatcattagatgcgattcaaaaagcaaattcaggacatcctggacttccaatgggctctgcaccaatggcttatgtactttggagcaaatttcttaatgtgaaccctaagacaagtcgtaaatggtcaaatcgtgaccgttttgtcttgtctgctggtcatggttctgcaatgttatatagtttattacatttggcaggttataatgtaacgactgatgatttaaaaggtttccgtcaatggcaatcaaaaacaccgggacatccagaagttaatcatacagatggtgttgaagcaacaacaggtcctttaggacaaggaattgccaatgctgtcggaatggcaatggctgaagcacatttagcagcacaatacaataaacctggttttgatattgttgaccattacacttacgccttaaatggtgatggtgatttgatggaaggtgtttcacaagaagcagcttcacttgcaggtaaattgaaacttggtaaattgattcttttctatgattcaaataatatttctctagatggtgacttatcaatgtcatttattgatgatattcaaaaacgttttgaatcatatggctggcaacatttattggtaaaagatggaaatgatttagaagaaatcgcagcagctgttgaagtggctaaagctgaaaaatctaaaccaacaatcattgaagttaaaacagtcattggttttggtgccgaaaaacaaggaacttcagcagttcacggagctcctcttggagctgaaggtgttgcatttgccaagaaagcatatggttgggattaccctgaatttacagttcctgaagaagtatcaaaacgctttttagaaacgacagttgcgcgtggtgaagcgatggagcaagtatggcgcagtacttttgatgattattctgaaaaataccctgagcttgctgagcagtatgcaaaagcttttgaaaatgagacaccagagcttactttgaccaagcatgaaatggaaacaagcaaggccagccgtgtaacttcacaagaagctatccaagaattatcagctcaaatgccaaatctttggggtgggtctgctgacctttcggcttcaaataatacaatggttaaagttgaagaagacttcatgccagataactatgctggacgtaatatttggtttggtgtacgtgaatttgcaatgggagccattatgaatgggattgctttgcatggtggaactcgtgtctatggcggaacattcttcgtcttctcaaactacatgcttccttctgttcggatggctgctctacaaagcttgccagtcacttatgtttggacacatgattccattgctgttggtgaagatggtccaactcacgaacctgttgaacaattagcttctgttcgctcaattcctaatttggatgtaattcgtccagctgatggaaatgaagtagtggctgcatggcgtcgtgctgcatcaagtaaaagccgcccaaccgcacttattttgactcgtcaaaatcttccagttttacctgatacttatgaattggctgaagaaggtctgaatcgtggggcttatattctttccaaagaagaaggaaaacttgaaggaatcatcattgcgactggttcagaagtagcattagctcttgaagctaagaaaactttaggttctggcattcgtgtcgtttcaatgccttcaatgaatatttttgacgaacaagacgcagcttatcgcgaagaaattttaccaaaagctgtaagacgtcgtttagcgattgaagctggtacaagttacggatggggtaaatatgttggacttgatggtgcaacagttacagtagatacttggggcgcttcggcaccagcaaatatcgttcttccagcttacggatttactgctgaaagtgtagttaaagcatacaaagagcttgactaatattgaaaaaggagttctgattttttgtcagagctcttttgattacaaacaagtctgtcagtaaattttaattaaaaaatagaaaggaaataagatggggattttacttgcaattgttgtgggagtagcttcaattttgaacttaatgtatggacaaaatcagccaatccaatatttactgacagttctgtcagtaatatctttaatcatttatcgtgggaaaagaactaaaagggttcattataatggatatggtcagaattattttacgataggatttactatttgtatccttagttttgtgggaacggtaggaattttgattggcttcttgtttcatttagcataatatgttaaaatttaactatgcgatgagtcgaataattctactttgtagaatttcgaagctaaggaatactgggaaattgggttttccgcgcaggaagcgtgagtatttgtcaaattgtgtgaacctttttgacacacttttagtgcctttaaaagccctcgaaagagggctttttttacgtaacgattaaaataattaataaaaaaatcttgttataatcagatgaatacaatgctgaaaaaatatataaacaatctattgtaggagttaattatattttcgatgttattattagcaagagttaagaaaaatatgataaaattgaagtgtcaacatctttatatattttttaaaatagaaaggaaattatcatggatgtttcatggatgacaaaatatattgctgagggattgggaactatgcttctcgtcttgcttggtaatggtacaattgctggggtaaccctcaaaggctctaaaaatgagggcatgggtggtcttgcaattgcatggggatatggaattgcgattttagttcctgtacttgcttttgcaaatgtttcaggtgcacatattaacccagcaattacaattggactcgcttcagctggctatttcccttgggcacatgttgcacaatatattttggcacaacttattggtgcaattattggtcaattacttgttgtagcgatttataaagaatacttagctaaaactaatgacggagcaatttctttaggcgctttttcaacaactaacgctttggataatggttcaaatcgtggaaaagcaatttttaacggatttatcaatgaagtaatcggtatgtttgtatttgttttcggaattctcagttttacaacgaacttctttggtgcagaatcaatcaaatggatgacaagctacgctcaacaacaaggagctgatgttacagcgaatgcaacagtaagccaaatttgggcttctgtttcaggcgcttcatcatctaaaatgattggtgcgcttgctattggtttgatgtttgttggtttggttacagcatttggtggaccaactggtgcagcattgaatccagcacgtgaccttggtcctcgtatcgtttatagcttcttaccacaatcagttgttggtgaaaataaagacgctaaatggtggtacgcttgggttccagttgttgccacaatcgttggtgcagtaattgcagctacagtctttaaacttatgtttaaataaaaacaaaaatttctgtcgaaaggcagattttttcttgcccttataacttaaaagcgctataataattataatttactgaaaaggacagacaattatgacacaatataatatcgccgtcgttggtgttactggtgccgtgggtacacgtatgcttgaacaattagaagaatctacacttcctatagaaaccgtacgtgcgcttgcaagtaaacgttcggcaggaaaaattgttgaatttaaggggcaagagcttgttgtagaagaattgactgaggagagttttgaaggcattgatattgctcttttttcagccggaggctcagtatcagaaaaatatgccccttatgctgtaaaagctggagctgttgtcgtagataacacctcatttttccgtcaaaaccctaatgtccccttggttgttccagaagttaatgcacatgctttggaaaaacacaatggaataattgcctgtcctaattgctcaacgattcaaatgatggttgctttagagccgattcgtcaagcttatgggcttgagcgagtaattgtcagcacttatcaagcggtctctggtgcgggtcaatcagcaattaatgaaacaaatcgtgaactccaagaagcacttgatggaaaagcactgacagaattgtcagcagaaattttaccgtctgctggagataaaaaacattatccaattgcttacaatgcgcttgcacaaattgatgtatttactgacaacgattatacttatgaagaaatgaaaatgacaaatgaaaccaagaaaatcatggaagatgattcaattgcggtttcggcaacttgtgtcagaattccagttctttacggtcattctgagtcagtttatgttgaaacgaaaaaagtagcagatattgctgaggttaaacgtttgatttctgaattcccaggagctgttttagaagatgatgttgctcatcaaatttatccacaagccattaattcagttggtcgtcgtgaaacttttgtgggccgtattcgccgtgatttggatgcagcaaatgggattcatctttgggtagtttctgacaatttactcaaaggagcagcttggaattctgttcaaattgctgaaacgctacatgaacgtggcttagttagaccaactcatgagttaaaatttgaactgaaataagctctgttaaatgagttatatcagtaaaattcgtgaaaaaattggtcatgagcttttgatttatctgggagctggcgttattgtctattctgatgaaaaaattctcttacaaaaacgtaaagataacggaacttgggctttacatgcgggtggtatagaagttggtgaagaacttgaggagactgctcgccgagaattatttgaagaaacgggactaaaagcaggtaaacttgagcttttaggaatttattcaggacaagaccgttttataacttatcccaatatggaccaagtttatatgccaggcatttattatatttgtcgagatttcacagggagtttaagaccacaaatgagtgaagttgaagagctgaaatggtttaaatttaaagaaattccaaaaaatattcatgagccaaatcgccgtgttatcaaagatttcatccaattaattgcgaaagaataataataaattagactgtataaaaataaaatttttgacctcgtttactaaagtatgctataatgggtcaaataaaattagaggttgcgaagacgaagaagttagtggagcggtgaacgcactgaagctgatggcggcgttctttgccgaaagaaaaattgtcacaaaatttttcttgggctgtgtggttaaatcctacagactgtctttctgtcagtactgacagaaaggagagctaatcaaaatcatttttgacgaacttttgagagcctcttttgcataaaaagaggttctttttgacctcttgacaagagcttgtcagtaagctcacacataaggagaaattatgtcagcaaaagaaacaattgaaaaattacaaaatgcacgtatcatcacggccctagtgaccccttttaaagaaaatggccaaattaattttggagcatttcctaagctcattgaggatttacttgctaatcatacggaaggccttatcttagctggaacaacggctgaatcgcctactcttactcatgatgaagaattggcaatttttgctgcggttaataaaatagtggctggccgtattccattaattgcgggtgttgggactaatgacacacgtgattcggttgaatttgtcaaagaagttgctgaacttggttatatcgatgcgggacttgcagtgactccttattacaacaaaccttcccaagaaggaatttatcaacattttaaagccattgctactgcgagtgatttgccaattattttgtataatattccaggaagggtggtcactgaaattcaggtagagaccatcttacgtttagcagaactggaaaatgtaattgccatcaaagaatgtacaaatactgataatctggcttatctcattgaaaagctacccaaagactttttggtttatactggagaagatgggctagcttttcacactaaagctttgggaggtcagggtgtaatctcggttgccagtcatatcctaggtcaagaattttttgaaatgtttgcagaaatagaccagggctctattcaaaaagcagcggctatccaaagaaaaatattacccaaaataaatgcactttttagtgtcacaagtccggctccaatcaaaacggttttgaatgcaaaaggatatgaagttggtggcttacgtttaccacttgtagtttgtactactgaggaaagtaaaacaattcttgaaaaaattggaaattaaaaaatacccttttagggtatttttctttataaaagttggtcaatattcaattgatttaatcttatcattcgattccaaaagactcattaacgaagcgacttcataagcttttggtaagttcaaatatagctctgtttttaaagaattatttgattttttttcaacttttatactaagaattttgacatcttcctctttcagctgttgttgcaacagttgaagaccttcaaaatcttctaattgaagaataagatgatcgcttgtcgctgattttatccatcgataattttggtgtaaaataatttgaaaaagtaaaataagtaaagtagctacaatacctataaaatataatccagaaccgatagccatcccaataccagaagttgcccaaattccagccgcagtagtcaatccattaacggattgatcgtgaacaaaaatcattccagctcctaaaaagccaataccacttacaatttgagccgcaattctggaaggatcaagattgactccatgggtactgatgatgtccataaaaccatattttgagacaataatcattaaagcagcactcaaagcaacaattaaatgagtacgtgtaccagcatttttggaacggctatttctttcataaccaatggcatatccacataccccagctaatattaatcgaattaaccaatcaagttgtgttaagaaagtaatctgcataaaatttcctccttgtcatttaaaacttaccttccattatatcgctattttgattagaaaaaaagtaagacccataaaaaatgaaactggcttgcttttttacttgctttgggttaaacttatattagtgtatctcggtagagattggaatgccaatctcttttattttaattctaagtagaattatcttttcaatatcgcttgtcccactcgaccgatttcgagagtgaatatggcaaggaaattgctaaaaacaggactgtaaatttactgacagaatttgtcaataacttacagattcttttatatcgaaaaaattataaattacactgacaagaaaggtttttatgtctaatattaaaatcactccattaggtggtgtgcgtgaatttggtaagaacatgtatttagttgaggttgaagagcaaatttttgtgcttgatgcaggacttaaatatgctgaaatggatcaacttggtgttgactttgttattcctgatattacatatcttttagaaaatgcggatcgtgtcgcaggaattttcttgactcacggacatgctgattcaattggggctttgccttatatcgtttctgaattaaaagttcctgtttttggttcagaattaacaatcgaacttgcaaaaattaatgtcaaaaattatgctgacagtcgcaaattcaacgattttcatgttgtaactgaagatacagaaattgattttggtaaagccgtcatttcattcttctcaacaacacatacaattccagaaagcttaggaattgtgatttctacaaatgacggaaacattgtttatacaggcgatttccgttttgatccagctgttgcaaaaggctatcgtaccaatatgcgccgattggctgaaattggaaatagcggagtccttgctttactttcgtcatcaccaaatgctttgtcaacaatgcaatctgctagcgagcatgaaatttatgaaaaaatttatgactatattgatgacaacgaaggacgggtcattattgcttgtaacgcaggtaatttaggtcgaattcaacaaacgattgatgctgccattaaacttggtcgtcgtgttgcttttacaggcgaagatatggaccaaatcatcgaaacagcaactcgtcttaacaaattacaaattgttgataaaaaatcaattattaaaccagcagaaattaaaaaatatgctgataatgagttagttattttagaaacaggacgaatgggtgaaccacttaaatctcttggagacatggctcatcgtcgtcataaatacgttaaaattaaagatggagatttagtacttgctgttacaagtccatctgtctcttatgaaacaacaattgctcgtattgaaaatgaaatctataaagctggcggagtcatgaaaatgttggcttcagatttgaaaatatctggtcacgcgaatgctcatgatttgcaattcttacttgatatcttccgtccaaaaaatttgattccaatccaaggtgagtatcgtgaacttagtgcccatgctgatttagcaatggaaatggacattttaccagaacatatctttatcgctaaacgtggtgaaacagtcagtttagaaaatggagacatgattccatctggtgttattcaagctgaaaatgttatgattgacggttcaggagttggagatatcggttcagttgttttacgtgaccgtaaagtgttatcagaagatggtattttcattgccgttatcacaatttctaagactgaacgtaaaatcgtcagcaaatctcgtgttcacactcgtggttttgtttatgttaaaacttcacgtgatttgatgcgtgaagctggtgagttggtcaacgaaactgttgataaatatctttctggaaaagaatttgattgggcagaaatcaaaggttctatccgtgatgctcttggaaaatttttatatgagcaaacaaagcgtaaaccagtgattcttccagtagttatggaagcgcgtcaacctcaagatttaaataaacgttacactaaaaaaaatcataataaaaaataaaagttacaaaacctccattttttcgtatagaaagttaggaggttttttatgtctcaaaaatcaataaagaaaataacgatgactgttggagtgggattactgacagccactcttaatcccaccttcttgaatcatcagttgctgacagaattgccggtggaggccacgacaagtaaaattacatatactgatgagcaaaaagttacttacaatcttgataaagtttcaatgacagctgaagtttcctcctatgctggcttagcgggagctgatattgtaattccagatatcattgtaaataacggtcaaacctatgcaataacatcaattggaacttatgcattttcaaatagtggaattcattcggttattatcggaaataatgttgtagatattaatacgagtgcctttcaaacaacaacagcttttcctgactattataagaaatcactgacagaagtagttttaggagcaaaagtccaaaatataaaaacagatgcttttgctggaaacgccataagtagtatagaatttccaaattctgtcctaaagattgcgacaagagcttttgcaaataataatttaacagaactttcattgggtccaaatatcacagaaattatggccaaagcctttcaaagtaaccaaattactacaatagaatttgctgatgaatcattgacaatagtagattcagcagccttttctgggagtcccgttcaaagcttgactttgggaattggagtgactttggctgatgacgtattcaataaaacgagtcctttatttggtcagttatcagatttaccgacagatggaattcggacaatttctgtcaattctagtggtcttttggataaaagttggataaattctgacagttcaaagtcggcttctgtgattacagaaaatgcagatacagcccctgtctcttcttccaattcagtagagcaagttgatgttgccagttcagaatcaacacaagaggcaaattcggcttcactctatccaatatctgaagcgagaagtgttacagataatactttaaattcaatctcttctttagacagtagtatttctagctcacaaacagagaatagtcagtcaggagcttccagtacagcagaaatcagttatgattcagaaaactcaaatagtttgtcttcttcaaaccaaatcaattccaattcaaatagtgaaaatgattcaaaccaatcctcattaggttcgagtatgtcctctaacgaagaaagtgagcattctaattcttccaatatcaacgaaacgaataatagttcagaaataaccaatattttaccatcatcaaatccggcagaaagtaattcagtatcagatcaaacaagttctgaagcttcaaccaattcaaatagtagtatcagtttatccccctcaaacataagttcgacttctgattcagaatcagcaattaattcgcctgatttctctaatgtagcagaagtagctaataattccttagcttccataaacaatagttcaagttcagttttatccagtacaagcacagctgataatttagaaatcaatcaatctagttctgataatcttacaaaggatagcacggaaatatctacttcaggagccgtttcgacttcaaatcaaacaagttctgaagcttcaagcaattcaaatagtagtatcagtttatccccttcaaacataagttcgacttctgattcagaatcagcaactaattcgtcagatttttctaatgtagcagaagtagctaataattccttagcttccataaacaatagtttaagttcagttttatccagtacaagcacagctgataatttagaaatcaatcaatctagttctgataatcttacaaaggatagcacggaaatatctacttcagaagcctttttgtcttcaaatcaaacaagttctgaagcttcaagcaattcaatgagtagtataaattcaccatcatcaagtatgagtttaacttccaactcagaattagcaactaatcagtctaattcttccgaagcaacaaaagtagataataattcatcaactcattcttcagatgttttaaatagtgattcaaatgatagtttaggttcagattcttcaaaccttagtagtatccctaatttggaaacgaatcaaactatttcgtccagaccaagtgaagtaaataatatatcagaaaaccctaagaaagtttcttcttcaaattcagttcaagaaaactcaacaaaccatgagatgtctactaacccaaaaagtagcataagttcacctgtcagcacaacttctagctcacaaccaaaagagagtcaatcgaatctacttaatacaacagaaggaatcaacaatccaataacttttaataattcttcatcagaaaattctgctgcctctattctaactagttattcaaataataactcagaatcatcagaaacaggatatttaaatatatctaataaggcacaaagagacaatcattcagaagtttctcatagtttgacaacttcaaattcaaatgaaaacaacgtgtcttcaatacaatcacaagcaattttagaaagctctaaaagctcaacaaataagagaagttcatcattatcaattataaactcaacttctcacccacaaaaagaagataatcaggcaaattcttctgatgaagtaaaatcaaataataatatagagtcaattataggtcaattaaattccataagtaacaaaactcatgtgaattctttgactagccaaaaactatcagtaatttacaccttaccaagcaaatcgaaagtgatgaatgaaaaaaataaaaattcaaatacaataagcgaagaaaaactcatcagaactcctcaaaaaaatgatgaaagtcaaaatttaggacaaataactgctcttgacttatcttttaacaaagaagcagagactatgaaagattttaaaacagttgcgactaaagttcctgataatgaaaatggtgatcgtagtcaaaataataaaacgaatagtattgataaaggtaaaggttttttcaaaaggtctgaatttaattataaattacttgatagcgacaatcatattttaaaggaaaatgttcttttaaaaaaacatggtcttataagtgacaattttttcattggtctaataacaattttaggagcttgttttattttcatatttatattatttaaaaagaaaaaaagagtgaaaaaagatatcgactagaacttttgatgtattcaattttagctaaagaaatgttataatgaagtaattgtaaaaaatagaattggattataaaatatggcatttgaaaacttaactgaacgcttacaaaacgtttttaaaaatctacgtggaaagaaaaaaattactgagacagacgtcacagaaattacaaaagaaatccgagttgctctccttgaagccgacgttgctctcccagttgtcaagaaatttattaaggcaatccgtgaacgagctgtcggtgttgaagtatcagaagcattaaacccagctcaacaagtaattaaaattgttgatgaagaattaacagctattttgggtggtggcgaagctgaattacttaaatctcctaaaattccaacaattatcatgatggttgggttgcaaggggcagggaaaacaacttttgctggtaaactagccaaaaagctcaaagaagagcaaaatgcccgccctttaatgatcgcagccgacgtttatcgtccagcagcgattgaccaattaaaaaccttaggtgagcagcttgaaattcctgtctatgatgaaggaactgctgaaaaaccagttaatattgttcgtaatggtctcttaaaagctcaagaagaacgtaaagactatgttttgattgatactgcaggtcgtcttgaaattgacgacactttaatgaacgaattgcaagagattaaagcacttgctgaaccaactgaaattttgcttgttgttgatgcaatgactggtcaagttgcagcacaagttgctaaaacttttgatgaaaaattggacattacaggtgtgattatcactaaacttgatggtgatacacgtggtggtgcggcattatcaatccgtgaaattacaggaaaaccaattaaatttacagggactggtgaaaaattaacagaccttgaagttttctaccctgatcgaatgagttcacgaattcttggaatgggtgatatgctcaccttaattgagaaggctcaagcaaattatgacgaagaacaatcagcaaaactcgctgaaaaaatggctgaaaatcgttttgattatgaggactttgttgaacaacttgatcaagtgacaaatatgggaccaatggaagatattatgaaaatgattccaggaatgtcacaaatgcctggtttagataaggttaaagttgatcctaaggatgttgctagaaaacgagcaatggtcttgtcaatgacaccggcagaacgtcatttagaggctgaactgtcaccagcccgtcgtcgtcggattgccgcaggttctggaaattcatttattgaagtaaataaattcattaagcaatttaatcagtccaaagaaatgatgcaaggaatcatgaatggtgatatgaatgctatgatgcaaaaaatgatgggtggagccggtggacaaatgccgaatatgcctgcgggttctggaatgcccgatatgtcatctttgggtgatttacaagggatgatgggtaatggttcagcaaatgggatgcccgatatgagttctatgtttggcggtggtttaaaaggtaaagcaactgagtttgctatgaaacaagccatgaaacgtgctcaaaagaaaatgaaaaaaggtaagaaaaaacgctaagtaaaaaaacaggagaagtcctgtttttttacttaaccgctttttctctttgagtatattcagatttaagaatccccataaaatagctatcatgatatctaccgccagcaaagaattgttccttaatcgttccttcaattttgaaacctaattttttatagatatgaacagcaggagcattatcaatatctacccataaataaactttatgcatatttagagtattgaaagcatagtcaacacctgtttttaacgctttttgagcgtagccttttccagaaaaacctgaaatgataatgatttgaatttcgcaggtacgatgaatgtaatcaatagacataagttccacaattccaataaaagtatcattggcttcaattacaaagcgacgttcagtattatcatggatatgtttatcataaagactgcttaactcgtctagtgattcataaggttcttcaaaccatagccgcattgtttcagctttattattgatgatatggatattttttaaatctgttcgttccaatgctctgattttcattgttggttcatttgttaatgtagtcattattctactccttgatgatatttctttataaaataaaaagccttgttatttaattataacaagacttaaatttttaagcgactatttgaaaatcccaaaaccgccgtcccaagaaattttttcagaagcagctaaagtaatttgcagaaaaccaatagcttctagttcgcgagccctttttagtgaaccagcgtctaatagactcaaaccactattttcaagaaatttaataatggtctcttttgcttcctgactatcactagcgagtaaaacggttgtttgatgttcatttgccactttttttgttgccaatgtatcggaaaaagtcgtattaaaagccttaacaatcattgaatttgggagttgtttagcaatgagagccgcagcagaagtatccgaaggcactaatagactatcaaatgttgtgaaatcaacgggatttgtaatatcgataattatttttccttgtaaatcagtcgaatattcttggatgattccggcaattgcgacataaggaacagctaaaacaacaatttcacccaattctgttttagctgagtttgataagatatagttgactttattaccagatgaactaaaattatcaccgattgcttttcccatttttcctttaccaaaaatactaattgttgccatagtcttcctcctctaagattgatattgttattaatttgattatatcattgaaaaaatgaaatctatagcaatataccttgcaaaaattaagtgattaataaatttttattgacagttagttaatatttatgtgataatggttagatacactcttttagaaagggagctaaggttatgaattcagaattgacctttaaacaaggtttaaaagatacattaccaacagtttttggctatattggaattggagcagcatttggaatgattgctcatagtgctggtttcaatctttggacgatattattactatcattaattgtttatgcaggatcagcacagtttataattatcaccatgttaacggttcatagcccacttttatctattgttctaagtgtatttttagtgaattctcgaattattctgatgtcaatgacaacagcaacctattttaaaaatgaaagtttactaaagaatatttttattggaactttgttaactgacgaaacttttgctttgggcatgaataagcaaaattatacggatggaaaattaagcttttcttggtttaatgcgtcaaatttactggcctattcggtttgggctttttctagtcttttgggaggacttttaggtaatttattaactgatccacaaaagcttggcttaggttttgcaattattgcgatgtttatcggattgctttatttacaacttattggtgataaaactttaggatttaaattacaattaatcatcgttggaattactatggttttattttattttggtttaaccattattcctagtaatttgctagttttgtttgttactttggtagtttgtgcaataggggtgggggtaaaacatgtattcttttaattttatcttattgacaataattatttgtggtttggtaactttactttcacgaattttaccctttattttactcaaaaaagttaacctccctcaaccgcttgtcgaatatttgagttttgttccagtcgttattatgtcagctttgtgggtttccaatctttttgttcaacatttggggcacttgccttcaatcaattggaataatttattcgcttcacttccgacaattcttgccgcaattttgacgaaaaacttattaatcatcgttattgtaggagttctctccctagcgtttattcaagtattaatgtaaaaaatcaatctttaaataatatttttttaaaataaaaataaccagagctttttgaactttggttatttttgtttttttgaatctgaaaatttgagcaatataatcgtcaaaagtaatcctatgatgattagaaggagaggtttataaccgtcacttcccgtaaatggaaggctccaatttgtatttgaaagaacgcttgtagttaatgcttgactaatcgttttatcgggttcaatttgagttgcactgataatatccttgggatttagacttatttctgatggaattgataggctaaatttaccattagtatcaacgcttgtttgagaagttgttccatttgggaaagtgacaataattgtacttccagtaatacctgttccagaaatagttgagtcaccaacacgtacagtatcgagtgttggtggggcagattgaagttgtgagctatttacaagagttgttacttgtgcactattttccaaattaggagaaatttgaatagctgtgagctggttacctgcgaccaagtttatatttccaggtaccgttactgaccaagttgaatcaggattaactgatcctcctacattatttccatttggaaatgtgacaatcacactgcttccagaaacataagaggggacagttcctttaatagttgttgcattaggtgaaatcgtatcgaaagttggactttgagcagtaccagaattatttggaataacagttattgttgaaattgtactgactgattcggcacttgctcctgttccaacaatttgtgttgcagatagttgattgccaacacttaatataagattaattgggagggctatagaccaagtaccgtcattttctacggtaattgtttggatactgccattcggaaaagttaccgaaacgcttgccccagttacaccagttccagagacgacagtatcagtagctttgacggtattgaaaagtggagctggagattgtagggtatacataaaactggcttttgaagttgtatcagcgattacagtttctattttcaaatatccagtaatcagaacactcatagcgagagttaggaaaaatatttttttcacgaagtacatctttcctttcttatggggctgatgttaatgtccaagttaatttatctattgcccagccattagtagttgtcaaaagagggcttgcaaacgagagtttgaagacgggcatgatattaacggtctcataacctgtatttgtatttccaccttgcggattagtattggtaaatataattgatggagtagttgataattgttcttgattggtattttcctgcccacttgaaatacctgctgatgaagttgcagaactttttatcaaagtaatgtttccaccaaataaatttccgctatctgatagtgataaagaccaagttgcaggagttgagcgggtatcatatatttgtgcgtagatattggggtcttctcttgtaactgctgtcccatttgaatttagcattggaatatttgtccagtcaggtggctgatttgctgtgctataaattccaaagttaaggtcgggcactgattttattgtcaaaagtcctgctggtaaaacggagagtgagaccgttgttgagataccatattgaagcgttgtgaatgtcaggtcgattgtttgggttgttgttgcggaaccatccaaggatttcagccaattaaaaacactggttgcatttgagagagaagttgttgcggaagaagaagcgattgttgctgaaacattagcaccagctgctcctgttgaggtgatagggttcattaggtcagtacttagggccgctgctgtagaattattagttagtaacgttttaacttgagacatagttaaagtgacattttgtgctgaaattgttcctgggataattaatatttgtactgtttgactatttgttcctcccataccatcaggagccgaaaaagtaagattaaaggtggttcctgaagggatgactgtcgcggataaatctgaaatgatttgattgtagagttgagtgttagtgtagttatcagagagcatgtagcttgctcctgcatcagcccacccactaatttttatattacttgaaatatcagtattagttgcgtcggttgcagtagctcctgttaattgaagcaaatctttagcgatttcattatcaaaattactgtcagcagcattttgtcctttgatagtattcatgtccttagcaatactattaacaacttgagtaactgtggttacattattggcagaaagacttccagcaacgaccgttattgtgcctgagaaaagaattccgtcggcggtaatatatttgatagtgattttagtaccaagtttttgatagttaatgccattattgattgtattgcttgtggtggaaagggcgtttgaaagatcggcagcaaactgactttgtaagttgtaaacgattggtgtgattgagtttgtaccattagttatatctgcttcagttgctttaacaatattgtttgaaccatcataatattgggcagaaggttttagataagcagctaaagccgagtagacgtcgcttgtactagcaattgcagtaagttggctgactgatatgtttggatttgaaatgtttgttgttgaagtttcaagtgggggtggtgtagtattaccattatcggttacagaatcattaggtttaacattataaattagaaaattagtccctgtttgtccactattactaatcagattgttccaatttgttggattaaggaaattgccagattgacttgttccatctgacccatcaaaccaacttcctgggaaaaatccccagttatgtccagcttgatttgtaaacatccaacttgaaatggaagaggtaaccggataatttaaggaaagactagagtctgaaatttggcttgctggtccatcacttccgccaggaacataagacgtatagagcgtattgctgttataaatgggagaatcattacttgctagaacagcattggtgcttggactggttgctgtatgatttggccattcccaatcaatataagaaggtgtagctccaacggttggtgtgcggacttctgcatggcggatataattccctgtgccaatggtaagaaaagaagcgggagaaatttgagcatttactgtccaaccaaatgttgaacttgcaggataaattaactctgcaagattattataagttgtgccgttgacactattgctaaaataagaggcataggcataatttttgtctaagctagaaccaataaatccatttgtgccactgcttgatgacaaactagggttaatattccattgtccggcacctgtcgaggtatttgttccattgatttggaattgacggatattaccaagaatacaaacaacttgattggcggaaataccgtttattgtggttggagaataatctccgatataggagagacctgtttgttggtcataaccattgatttcaacggggttaatctttgttgctgtttgacctgaaactggaataatcagcatcatatgttgaaaatttgaaccagttgaaccccaaattgccgttgttgatttaagattgttatcattgatatttagcccgcgactaataagtggttgccaagttagaatggattggctagtgtaatttccactagcgttttgtgtttcttggaaataggtagcttttgttaattgagaaaaattcgatgaaatgattggagcgtaattatttgcccaagaccaattgttactgaaataatagtctttgagataggtatttggagcgacattccatgcaccgacttgaattaagatatttgtgggttgtaagccagcagttggagtagttgaaatacctccttgacttttatcaacaatccctgaaccttcatacatgtttaagcttccaaaattagcatagttattttgataattgcttgcattcgtttgaattccgccaccattataaatgtagcctgtggcacttaaatcaagttcgttgtagggtaaaatatttaagttggtaaaattgtgaacaaggttggttgctagtatcacttgattggaacttgaagcagagctggagccaaggtttatcgttgctgtattttgggtggttgttgcgtttgtgaaattatcgtttccgtctgcaccagctgaaatttgtttcactcctgcagcattgatattcatgattgttgtggctaataagccgttggtcgttgccaagttatatgctgtggcgttaatatcattactgaaagtataatctgggctgttaacggtcactttgatgatacgggttgttgagagaggaggtggacttgcttgaccgtctccataaatggtgttcacgcttgtatttcctgaaattcctgagattccaacattgatatctcctgttattgctccacctgttgctgaattccccattagtgttaaaatgccgccatttgttccggtaacatcaacgttgacagttcctgtaattttatctgtgcttgtttgtccaccaccataaacttgaaaaataccgtttgtgctgtttgtattgaaggcgacgtttatatttccgttgactgtgcttgtattatttccaccaccgtagacattgagattgtttccagaagtgtttgtgaccgtcagggatgtatttccagtgacagttcctccatcagaaccgccatagatattaaaagtactcgagccagtagctcctatccaaatatttgtatttgctacgcttgcttgttttgccccgccataaagattgattgcaccagtgaaaaacgcgcctgaacgaatggcaagattatttccattggcatatatgctacttgaaccagcgagagtaatattacgaaaaacggttggaacggatagatttagaattgatggaagtgtaatttgattagcatttggatcaagattggcagtagaagtattaaggttatcggttgaatccgaaataaaagtgaggcttttcgcatttacagtggtcacttttgataattcttcttggtcagtactggttaagctatatgcagatccaaaataaataacatagtcaattgggtttgcaatagtatcatcgagagcagaagcaaggcttgaataattagttttggtgccattattgctgacaatggaaatgctcgttccagaaacttgtcctgaaattgatttactgtaaccaaaactattattggctaaaattagtccgggaatgtctgtggcagcatagactttgtttaaatttgataaattggaaattgcaggtttgaattgattaggaaggaaattattggtgattttttcaagtggcgaaaaaagctctaataaaaaatttgctggagttagaattaaaaatattaaaagaagaaaattgagaattaattttgattttataatttttttaggcatagaattaaatttattagtgtggatgctttttaaaaaacgtagaaaatagtgtattattaaaattacgttttttaagtttctttttcaattcattatatcacagaaaagaaatataaagataagaattgattatttatatttttaggaatttgattttattaataaaaatttatcaattatttgtaattccctctcgtatttgtcgacatatcttgctataataaatgattatgataagaaaaaatattttgaaagttcaacgaattgtagttaagattggaacgagttcgttgattttgccaaatggaaaaataaatttatcaaatattgacgagctggcttttgttttatctgatttgaataacaaaggatatgaaatgattttggtgacttctggagcgattggtgtcggtttgaatgtgcttggtatggataaacgtcccaaaggaattgctgaccagcaggctttggcttcaatcggtcaggttgaattaatgagtctttatacgcaaatgtttcgtcgttattcgcaaaaagtttctcagttacttttgacacgtgatgtgactgattttccaacgagtcgtgataatgctgaaaatgcactaaatgcattacttgggcttggaattattccaattattaatgaaaatgatgctattgcggttgatgaaatggatcatcaaacaaaatttggtgataatgataaattgggagcgattgtttctaaattggtgaatgctgatttattgattatgctgtcagatattgatggactttttgataaaaatccaacaatttatgatgatgcgaaaatttttaatgaaattcatgaaattactgatgaattacgtcaaatggctggtggtgccagttcgcgttttggaactggcggtatgacttcaaaattggcggctgcacagattttatttgaaaatggtcaagaaatggttctgaccaatggcgaacggattcgagagattaaagaaattatcgaaggacgtgagattgggacttattttcatcaaaaatcttgagaaagaaggataaaacgatgattgaagaacttggattaaaggttaaaaaggcgagcaaagaagtagcaaagctatcaactgctgacaaaaatgtttttttgcaaaatttagctgacagccttatcgaaaatactgacagaattatttctgagaatgaaaaagatttggctaacgctctggaacatggaatttctgagattatggttgaccgtttgcgtctaaatgcgcaaagaatttctgatatggcaacagggttgagacaagttgcggaacttcctgacccaattgggcaagtattgcaaggtttcactaatcttgatggacttaagattttgcaaaaaagagtgccacttggcactgttggaatgatttttgaaagtcgtccaaatgtgactatcgatgctttttctctttgttttaaaacaggaaattctgttttgctacgcggtgggtctgatgcgatttattctaatatggttttagttgaaattattaaggaaaatttgttgtcagcaaaaattactgacggagcagttgaattgttatctgacacaagtcatgctgaagcagaaaaaatgatgcaggcagataaatttttagatgttttgattccgcgagggtcagcgcgattgattaaccgtgtcaaagaaaaagcaacggttcctgtcattgaaactggggtgggtaattgtacaatttttgttgatgaatctgctgatttagaaatggcgacaaaaattgtgataaatgccaaaacgcagcgtcctagtgtttgcaatgcagccgaaagtttagtagttcatgcaaaaattgctgacgaatttttaccaaagttggaaaatgaaatcaataaagttcatgaaattgaatttcgtgctgatgagcgtgcgctgaatattctgtcagctggaattcctgcaactgacgatgattttgggacagaatttttagattatattctgtcagtaaaaacggttgataatttggatgaagcaattgagcacattaatacttattcaagtcgtcattcagaaagtattgtcactcatgattatttcaatgcgcaaaaatttcaagatgaaattgatgcggcagccgtttatgttaatgcgtctacaagatttactgacggttttgtatttggcttaggtgctgaaattggcatttcaactcaaaaacttcatgccagagggccaatgggcttagaggctctaacctcaacaaaatatctgattgatggcacaggacaaattcgttaaaaataataaaagactcggcttataaaaagtcgagtcttttaattcatcagtaattttataaattgacaagttctgtcagtaattaaatttcatattgaacatgttttttatgttcgtcagtagtttcatcaagttcaatggctgagcgacaaactttctcactttctaaaagcttacgaacagcgatttttgcatctgagaaatcttgattttcgggaatcacaatgtgaatcattgctgcattttgctcaccgtcaattgaccaaatgataagttgcgtgacagcaagtacttcaggaagttgttcaagggatcttagaagatttttgtaatcaatatcttcggggactgattcaagaagaatacgtaaagttccccagaattttggaatggctttggataagatgaacaaagcaattagaatagaaagaagtgggtcgagccagtaccattttacaaaatgaaggacgattgaaacaatgagaactcccagccaacctaaaacgtcttcgagcgcgtgaagatttaaaatactttcatttcgtgaggaaccacgagccaaaagccatgcaccaaaaccattggcgacaattgcaaaaatagccaaaccaagcatacctgttgcttctacaggttgagggttgaaaaatctaggaacggcttcgaaaagcacaatgaaactccccgtaattaaaatgacacttgtgagtgaggcgccgagtaaactaaaacgttgataaccaaaagagaagtgtttgtcttcttgttttttagagaatttttggaaaaaccaggctaaaccgatagcaacggcatcacctgtgtcatggacggcatcagataaaatagccgtagaattaaagagcaccccaaaaataaattctaaaatcgcaaagaagaggtttaaagcaaaaacgattgtgacgttttgtgagacaagtttatccagatgattatggtcatgctcgctttttatttgtttatttttaaggctcatgatttcctccctcttgttcatccaaatgttctgcaacatctttcaaaagatgtaaaatatggcggtcatagatactgtaagtgaccgtttttccaattttttcattcgttaaaattcgtgcattttttaaaagttttagttgttgactgacaagagattgagaaagttgtgttttttcaacaatctcatttacggttaggttatcagtggctaggctggaaataatttttaaacgtccgtcgttagagaaaagtttaaaaaattcagcaatatctttttcgttaatcatattattatattataattttataatatatttgtcaagctttctttaaatattttattttaagttatttttgttatgataaactgaaaggagaagttttgcaagattttatccaatatatttattctgcctttgaaagaatcgcagactttagtgaccagcaaaaaataattttattaggtttgatttgtgggcttttaatagctatctttctttatcccttattaagaattttagtgacgcttttacatgaatttggtcatgctctggcggcgaaaattacttttggtaaagtttatagaattcatcttaatcatgatagttccggcctcacccaaacaagtggtggtgggagaagcttctttgttttattgatgggctatccaatgcctttactttttggctgtctctttagctggtttttgattatcaatcatccagaattcattcttataagtctgttgatagtcagcctttctgttctaatcgtcgttaaaaattggtatggctttttgatttgtttgctaggaattttaattacaggggctttgctttattttggtcaaattcagatttttaattttatgggtggagctttaattggttttctgattttaggggcattcattgaccttaaagtaatttttcataaaaatgaagaactttctgatgcagatttactccatgagaaatttcaaataatccctgcttttgtttggaaattaatttttcttttaatgatgtcatcttgtctatttttgattataatcactttcaagactttattctctaaataaaaaataatttttgacaagtgacgagaactttgctataatctatctaacctttaagattgtccagagaggcaggcaaggtcagaaattaataatgtaataatatgatggatactgtccattttctgatacctacctgcattctcttttgagtgcaggttttttgtatgttaatggacaacttagaaatggaagctaaatcgccaaatgaaagatttgttagtttactgaccaattgatcatcaagaatgaaaggagccacaatggctagaaaagaaattattgacgaaatcacaatgaaacgtgcaattacacgtatcacttacgagattattgaacgtaataaagagctggacaaattggttttgattgggattaaaacacgtggtgtttatttagcaaaaagaatccaagaacgtttgcaacaattagaaggtttggaaattccttttggtgagttcgatacacgtccattccgtgatgacaaacaagctcaagaagacactacagaaattgacatcgatattacaggaaaagatgtcattcttgtcgatgatgtgctctacacaggtcggacaatccgtgcggcaattgatggaattgtaaaactcggtcgtccagctcgtgttcaattggctgtattagttgaccgtggacatcgtgaattgccaattcgtgcagactacgttgggaaaaatattccaacaggtcgtgatgaagaaatcattgttcaaatgtctgaacacgatggcaatgatagtattttaattaaacgtgaagattaaaaaatttctgtcagtaatttaaagtaaaaaatatgctgtcagttactgacgaaagaattaacaaatattcaacttagagttttaggagaaaaaagtgcacgataatgatattatcttaaaagttgatgagaaaccagctgcaagtcagtggtttggtctctcatttcaacatttgtttgccatgtttggctcaacggttttggtgccaattttagttgggattaacccagccattgccctcttgagttctggacttggtacacttgcacacatgagtgttacaaaatttaaagtgccagcatacatgggttcaagctttgcctatattggtgcgatgactttactgatgaaaaacggtggaatgccagccattgctcaaggggcaatgaccggtggattggtttatctgattgtcgctttaattgtaaaatttgcaggtaaaggctggattgacaaagttttaccgccaatcgtcgttgggccaatcgttatggtcattggattatcacttgctccaacagcaattaatgatgccatgtacacggacgttgcaaatttaaaaggatacagtttagcatatatcattattgccctcatcactgtgttatctattgtcatttacagtatctatggcaaaggatttctgtcagttgttcccattttacttggaatcatcacaggatatgttgcagcaatgattattggtaagattacagggatggacattgtttcattcactggaatctcacatgctaagtggctgaccattccaccaatggaaattccatttgccaattacaagtgggccttctatccgtcagcaattttgacaatggcaccgattgcttttgtcacaatgactgagcattttggccacattatggttttgaattcattaactaaaaaagattactttaaagaaccaggattagaaaaaacattaactggtgatggtctagctcaaatcatcgccggatttattggtgcaccgccggtgacctcttacggtgaaaatattggagttatggcaattacaaaaattcattcgatttatgttattgctggagctgccgttcttgctatcgttgtctcattcattgggaaaattacagcactcttgcaatcaattccagcacccgtcatcgggggagcatcaattgccctttttggagtaattgcagcttctggtttgaaaattttagttgaaaataaagttaattttgatatcaaacgaaacttactaatcagctcagttgttcttgttatcgggattggtggaatgattattaatatcactcaaaatttacaaatttcatcagtagccattgcaacaattctcggaattgttttaaatcttgtcttgccaaaagatcctagcgaaatttaaaagattcaaaattactgacagaatcgtcagtaattaaaaaagtgaacttataactgatagaaatcctatcgagatttccatcagtagataaaaattttgtcagtttactgacaaaacaatcaaatatattgtcaataaaactgttgtgacagagagcacacagtcagggtaaaggagacctcatgtcagtaaaaaatggattagttcaactcgaaaacctcacaagtatggaaaaattgagtgttgatgaagtcatgggacttatcaaaagagcctcagctttcaaagcaggaacagcagaatttgatttagaaaaacaaacttttgcttcaaatcttttctttgaaaattctacaagaacgcaccatagtttccatattgctgagcgtaaattaggcttggatgttcttgaatttgatgcgcaagcaagctcaattagtaaaggggaaactctttacgataccgtcttaacacttgatgcacttggcgttgatatctgtgttatacgttcaggagtagaacattactatgaagaattagtgaattcagataatattcattgtgcgattgttaacggtggagatggttcagggcaacatccaagtcaatgtttacttgacttgatgaccatttatgaagaatttggcaaatttgaaggtttaaaaatcgcaatttccggagatttaacccattcacgtgtcgccaaatctaatatgatgatgctccaaaaattaggagctagactttactttacaggcccagcagcatggtatagtgaagaatttgatgattacgggcattatgccaacctagaccgaattttgccagagcttgacgttcatatgctcttacgcgttcaacacgaacgtcatgatagtggcgaaagcttttctaaagaaggttaccataatcattttggactgacagaagaacgagcaaaaatgttgaaaccaacagccattatcatgcacccagctccagtcaatcgggatgttgaaattgctgacagccttgtggaaagcccacaaagtcggattgttcaacaaatgagcaatggtgtttatactcgaatggcaattcttgaagcaattcttgctggaaaaaagctaaataattcaaagcgctgacaacaagaaaaaataattgctaaagcaaaattcaaaggaaatatttattatgagcaaaagacttttaattttagaagacggaaccatttttgagggagaatctcttggtgcaaacttggatgttacaggtgaacttgtctttaatacaggaatgacaggctatcaagaatcaatcactgaccaatcgtataacggacaaattttgaccttcacttatccaattgttggaaattatggggtgaaccgagatgattatgaatcaattcatccaacctgtaaagccgtagttgttcatgaagcagcgcgccgaccttcaaactggcggatgcaaatgtcttttgatgaatttttaaaagcaaaaaatattcctggaattacaggtgtggatactcgagcgattactaaaattgttcgagaacacggcactatgaaggcctcacttgtacaagcaagagatgaagtagagcatcaaatgagccaacttcaagcgacagtattaccaacaaatcaagttgaaacaagtagtacgacgaccgcttatccatcaccaaatacaggcagaaaagttgtcgttgttgactttggcttgaaacacagtatcctacgtgaactctcaaaacgggaatgtaatctcaccgttgtcccatacaacaccagtgctaaagaaattttggaaatggaacctgatggtgttatgttgactaatggtcctggggacccaacagatgtaccagaagcaattgaaatgattaaagaaattcaaggtaaaattccaattttcggtatttgcttaggtcatcaattatttagtcttgcaaatggagcaaaaacctacaaaatgaaatttggacaccgtggatttaaccatgccgttcgtgaaattgcaacaggacgaattgacttcacctcacaaaatcatggatatgccgtttcatcagaaaacttacctgaagacctaatgattacccatgttgaaatcaatgacgactcagttgaaggagtgcgtcacaaacacttcccagctttttcagtccaatttcacccagacgcagctcctggacctcacgatgccagctatctttttgatgatttcatggatctcatgaataacttcaaaaaataaagtgttgatataactgattttgagtgtgtgacagtatactgctcattggataataaaaaaactcagaactactgagtttttttattatctatttttgtataagattgttactgctgaacttattattatgattccgattagtacaaaactaagatcagtattgctattaacaccagtttctggtaatatttttatatttccttcttctgaagcttttgtgatcttgttatccaagacaatagaatcttttgaaacatttaatgtatttttatttatagagtgagcaggttcaggatttggagcaggttcaagatttggagtaggttcgggatttggagtgggttcagggtctggagtaggatcaggatctggagtgggttcagggtctggagtaggatcagggtctggagtaggatcagggtctggagtaggatctggatctggatctggatcgggcttaggtgcctcattaatctgaatcatatttgttattgaatagggagttacatgccgatcattttcaggaagtgcatctgtaacgttaagttgaaattggtttccagaactaatattagaagtatctatgataatatcaaaggtacccgtatgggaattattatcaatagtgatatttgaaataactacatagtcaaggttagagttcacaattatgtcttgagttgtaagggagtcaccaccataataaccgaaggtagccctcccagtgataatgtcaccttgtgttacatcaacaattccagagtcaagtcccatattgaaaaattcaatcgttgaaataccataccattcttgttcggcttttgcagaaatatccgatgatggagtatcaagttggtccgccattgaaggtgaagtagtgaatagtatacatgttaaaagagtacatgtagataatgcaacaattaattttttcatttttaaaactcctgtaagatataaaatacattttaacacattatttcaataattaaaaagacacttttacaaaattgtctattattttactaaaaatactttgaggttattgaaaatatagtcttaaattagagaagttcagttatagggaacttggattagttgttaatgattcttattttctccgaagccgaagattcaaacaaagtataagttattaaatattttttattattcatttaagaaataagttctataataaatctatttcaaaaaaataaactttttcataaatacttctaaagcgcctactaatctaggcgttttttcatcgtctcgtttacaagttttattacttcagaaagtgaataaaatatttttagaggcattatcaagcatacaaagtaattttagaagttgaggttcaaagttatactcaaaatattaataataaaaaagcataatgataggttttttctaagttagtttttatcgagaagaagatgttcctcacttatttactggtaaaataatcaaatttcctcatgaatttttgtttataaactttaaatttcaaccatctattgattacgcatttctataattatatgtagcatgcacttataaaaagtgaattctttttgtaagtttaaaaaatacgcaatatgttataatctagagatatgaaaattaaaaaaatagtattttcacttattattcttataatatgtacttttataggagtcttttactacgtttttaaagttgaaccttatcgtttagtagtcaatgagcatcaagtgaataatacaaattctaaagaaaatttgaaaattgttcagttgtctgatttacatataaaaaaagattttaatgctgatcgattagataaagtgattcaaaaaacaaatgaacaaaatcctgattttattattttctcgggagatttatatgataattattcacaatacaatgaaaatgaagccgttatttctaagttaaaaagtctgaaagcaaaatatggaaaaattgcaatttggggcaatcgagattatggtgggggagctgtcagagaatatgcaaatattatggctgaatctgatttctctcttttaagaaatgaaaatcaagtttttactttggataatggtaagaaaattttattcacaggtttggatgatgctttgttaggaaatccgcaatttccctcgccaaatcaaatggctgaaacgagttatgatatattattgactcatgagccggatgaagttagccaatatcaaaataagggttatgaattaattctttctggtcatagtcatggcggtcaaataaacatcccacttattcctcaaattcaaaagaaagctacggcattgatgagccatgcgaataactatactggtggactttatcagttaggagcaaatgaaaaactttatgttaataccgggataggaacgactcatttatcagccagatttggtgtagctcctgaaattgccgttttaactttttagatatctagattactaaatgaaatcgcttgacattttaggtgacctattatagagtttaaatagaatacattagtttagatagcataaggctaggctaaaatggaggatttggatgcaaggaaaaaaggtttttttgctgcttggtattataacagcagtgggtgcttggaatatcgctaatggaactcaggtgagagcaagttcgaaaagcccagtttatcgactttataaccctaatagtggggaacatttttataccacaaatttttatgaaggaaattctcttaaaaatttgggttggcgtgacgaggggattggttggcaagcagcaaattctggtgaaccagtttatcggctttataatcccaatgttaaaggtggggatcattattataccttgagtaaatatgaagcgcaaactttggtcaatctaggttggcgttgggacaataatgcaaatcctgtcttttattcagctggaacagtcaatctttatgtttcttataatcctaatgctcagtcaggtgcacataattatacaacgaatatatttgagcagaatagtttattatctgtaggttggaaatatggagctattgcttggaaaacaatgccttctgacagtttgcctggaactccagcgggttggacgattgatagaccaatgaatattgataattattcaacccaaacttatgcttataaacaatgtacttggtgggtctataatcgagcgaaagagtttgggattaactatggccaatatatggggaatggtaaggattggcaaaatcaagcaggttatcaagttacatcaactcctcaacttcatagtgccgtaagttttaaggcagggcaagacggagctgatgccacttatggtcatgttgcctttgtagaaaaaattcgttctgatggttcaatattaatttcgcaatcaggaacaggttatagtactttattttcttatcaagttttaagcaaagatcaagctagtcgcttacgttatgtaattggaaaataggtttctttaaaaaatcaactaatcaaattacttgagggcatccttttatcaaggtataatagatatatctttatttcagatattaattgttaattctagaactcatcggttgaacaatcggaaatcaacaattaatatctgattcaaatagggaaaagagaattctccttcgggaggattttttaataaagaaattttttgcattctaagtatgaaaggggagaatatgagactttggcatgaagctttaatcaaaaagcttccaagacagcaacttttgggacagcatcgtgaatgttgtgcccttcgaggaaaaggctgggggaaaccacattcaacagttaattatgttttttattattcgccctataaactttttcaatatcatttacaagtcatgactgaaatgagaaaaagaggctatcatccggatgaaaaatggctaaatcctttatatcggggacaaacttctaaagtatatatagaactagaagaagtggttcaaaccttcccgatctatcctgaacataataatgattatcttgaagactgtaaagaaaatttgagagaaaagggaataataatctagaaaataaaaagaggatttcctttgaaaaggctaaaatgatatgataaaatcatgagtataaaatgagaaagcgagtgactcatgattatcgatttaggaaatgtctgggatgccttgagtgcgattggaactatagctgtagttattgtttcgctttatttggcaagaagagactatcgaaaaaaattagaagttgactattggatttcttataaaatattctctggagaaaaaatatctttgtggtctattgatcttgtaaatactggatccgttcccgtaaagatttatgaagtcggtctttatcaaaaaagttggttaagaaaaaggcggaaaaaaataatatttatgatgcctagagatttcgagtacgaaagtgccaaactaccaattttacttaatccgcaagaagatgcaacttatttcatagctaaaaatgagtggataactaaaataaaagaactcggaattaatcaacgtaagattggactttatgctagagatactactggaaaatattattatagaaaatttttattggagtaaatttactttttttaagaattgaaaagtttgtaaagtttttttcttgacaaaagaaaattttaacttgaaatttatctataaatttgatagaatatttaagtattcgtacaactttggtctggcaaacagtccaaggcagaaaggaaattctaacgatgaaacaaaatatccatccaaattaccaaccagtagtcttcatggacactacaactggattcaaatttttgactggttcaactaaaggttctaaggaaactgttgaatgggaagacggaaacacttatccattgatccgtgttgaaatctcttcagattcacatccattctatacaggtcgtcaaaaattccaagcagcggacggacgtatcgctcgtttcgaaaagaaatacggtaaacaataatagaaatggtcattcgaccatttttatttttacctgtaaaagttgtcatttgacagctttttattatgaaaaaatatagaaataagataaaataaagaaaaataattaaattgtgggagaatattaaaagatgaaatggtctttaaatgaattaacgaaaaaaaaacagattagtttcaatgaagaattagatctacgcgaagagttgctcaaacgttcacaagaaattttggattgtcaagcaattgaggttaaaggtgaaattgcttatgatgatgatttattctatttagattataaaattaaaacagtattgacattgccttcgtcaagaagtttaaaaccagtcgagtatccaattgatcttcttgtcaatgaaatttttgcgactgaagagagtttgagagggaatcaagaattattagacaatgatttgattattgttttggataaagatttaatcagtttagatgaatcaatcactgataatcttttattggaaattcctttgcaaatttttgctgaagatgaagaggcagaagagttgccggctggtaaattctggtctgttttgagtgaagaagattatgccaaacaacaagaagaaaaattggaagaaaagaaatccccttttgatggtttgaatggattatttgattagacagctctcattttcaaaggatttcagccttaaagcataagaaagcgaaaacaatttaaataaagcgtcaaatagtttgtacataaattaaatttatcttataatagtattataagaaatcgaattatacagtttttttaacaaaggagaatgatatgacttcaaagaaaattttgattattgaggatgaaaagaatttagcgcgattcgtctcattagaattagaacatgaaggctatgcgactgagattaaagataatggtcgttccggtcttgaagaagcaacttcaaaagattatgatttaatcttgcttgatttgatgcttcctgaacttgacggttttgaggtagcccgtcgtttacgaaaagaaaaagatacaccaatcattatgatgacggcgcgtgattcaacgatggaccgtgttgctggtcttgatattggggctgatgattatatcactaaaccttttgcgattgaggaacttttggcgcgtgttcgtgctttcttccgtcgtgaagagcatggtcatgccgttgaacgtgctgaaaatacttctttccgtgatcttgtgattgataaaacgaatcgcacagttcatcgtggtaaaaaagtaattgatttaacacgtcgtgagtatgacctccttttgacattgatgcaaaatgttggcgatgttgtgactcgtgaacatttagtttcacaagtttggggatatgaagaaggaacagaaacaaatgttgtggatgtttatattcgttatcttagaaataaaattgatgttgaaggtcaagatagctatattcaaactgttcgtggcttaggttatgtaatgcgtgaacgcaaataaaaaataatatgaaaaaattatttactttcaataagaaaaaagagacggttgaggaaagttcggctaagcggtctatcatgcttaggtgggcttttgctaacaccgttttttgttttattacttttactttgtttgctactttgacttatcaattgacaatcagttcttttattaaagaagaacaacaattattaactcgctctatggatagtgttgaggaagtcttagaaaaagcagatgctcctttgaattcatcgaatttgaacacatatattgaagcgacatcaaagattcaaaatggtgagtctgaaggaatgagtttgggtagtatcattggcacacggaaagcattttatatttatgatttaaatcataaattattgtattcaacgaatcgacatacttttggttttcagaatcaggctaataatgaaatgaaagagattcggggagagaatccaggttatttagttcagagaaaaattatttctaagtcaacaggacaagttgtaggatacttacaggctttttatgatacgacgacttatcatcgaatttctaatcttcttttgattgtcttgttaattttagaaattgttgccttgattatcgctcagttgattggttatttcatggctaattactttatgaaaccattggaaaagctttatcagggcatgcaagaaatggcaaatgatccaacaaatgattttgaaccgattgaaattcaaagcggagatgaaatcgaagagttggctcacgtttacaatgatatgatgttgaagatgaaggcatatcttgaacagcaaaatcgctttgtttctgatgtttctcatgaattaagaacacctttagctgtcttggatggacatattaacttgctgaatcggtgggggaaaaatgatccagaagtactagatgaatcattgcaggcaagtttagatgaagttgatcgaatgaagaaaatgcttgaggagatgttggctcttgctcgtcttgaaaatgttgatttatcaagtgaagaactggattgtgatgttggaaaagtttgtaatcgggcccttaagaattttcagcttttgcatgatgattttgaaatagtgcttgataaccggcttatttatcccactcatgcgcgaatttcagaaaatcattttgaacaaggcttaagaattctgttagataatgctgctaaatactctcctgatgatcgtaaagaaatcgtgattactgtttatgaggatgaacagtttgtgattacgagtgtatctgacaaaggaattggaatttcagaagaagatattgatcatctttttgaacgtttctttagagcggacaaggctcgcaatcgagaaattggtggaactggtttaggtttaccaattttagctcgattggcagaaaattatcaaggggaaattgaggtaaattcagaactgggtcttggttcaacttttacactaaaattcccgaaaataaaataaagaataagagaattgctaaaaggcagttctttttttgtggcatatgttatattttataacatcaaatataaaaacaattgacttgtttagaaagttgtgttatattttattacatgattaaattatcagaaaatattgataaatattctgttttaatctcgaacttttaaaggagaaattttatggacacaggctcaattgcatttattttaatttgtgcggcattggtatttttgatgacgcctgcattagcatttttttatgggggacttggacgccgaaaaaatgtgttaaacacaatgatgatgtctctcgcaccaatggctctggcttctattttatggataattattggcttctcattttcattttcaggaagcaatagttggattggtgatttcaaccatttgtttatgaatggtgtggatatggctaaaaattcacttttccctgctaatcatattccagatggacttttttctggttttcaaatgatgttctcgattatcacagtagctctaattacgggatctgttgttggaagaatgagatttacaccaattttgatttttatgactgcttggttaattttagtttattatcctttggctcatatggtttggggcggtggatttttggctcaaattcatgcgattgactttgcaggtggagatgttgttcacatttcaagtggggtgacaggacttgtacttgcgttagtgcttggaaagcgtcgagattatgagcgtttagattatcgtccacataatattccttttgttgttttgggcgctggtctcctatggtttggttggtttggctttaatgctgggtcagcacttgctgccaatggtgtggcaattaatgcttttatgacgactaatacagcagctgcagcagcaatgttttcgtggatgattgttgaaaaaatattgattggtaaaccttcaattgtgggtgcttgttctggtgcggtagttggtttggtggctattactccaggagctggttttgtttctttatggtcgtcattgattattggtcttttggttagtcctttgtcatactttatgatttctgtagttaaaaagaaattgggatatgatgatgctttagatgcttttggttgtcacggtattggcgggatgtttggcggaattatgacaggaatttttgcaacgccggctttggcaccagaaaaaggatacgctggtttgatctatggctctgggaaattacttttggctaatgtatctgcggttgttttcacagttattttcactgctcttgtgagttgggtcattattaaagtaattgccttgtttatgccaattcgtgtatctgaccgtgctgaagctattggacttgacgacagtgagcacgaagaaactgcttatccaaccttcttaggtttggattcttaagtttaattttactgacagatatttcttatataaaattgtgagtttgtcagtaaaatcaattttgaatgatgtctttgaagtatgctgacaagtctgtcagtaaaaatgtaagatacaaagagagaaaaaatatgaaaaaaattgaagcgattattcggacagataaattagaagatttgaaagcagccctatcagataatggcttggtgcatgggatgacagtttctcaagttttgggttatggtgaacaaaaaggatttacagaatatgttcgtggtcaacgaattgaaactactttactttcaaagttaaagatagaaattgtatcaatcgatgaaaaagttgatgatattgttaatgtaattattaaagcagttcaaacgggcgaagtgggagatggtaaaatcttcattcaaccagttgagcgtgtaattcgaattagaacctcagaagaagatgctcaagcgctctaagtctcatactttataacaggataaagtgtagatgcttggagactacctttccagattcactactgctgactctcggtgtaacaaatagtatatttgtaagtcagcaaagctaacaatgacttttctaggttggaaatgattcttcttgatgagttctatattattaaaaattaagctgacaaataggtcagctttttgtgtttttttgaaaaaattactgacagacttgtcagtaaataagactgttgaaaaaaagcccgattaggggtaaaatagattagataaagtcgtcagtgaaatattttactgacaacttaaaaaggaatagaaaatgaaaaaaataacgaaatttaaagatcaaaaaatcttagttcttggacttgcccgttctggaatggctgctgcccttgtgctcaatgagttgggtgcgattgttacggtcaatgatggcaaaccttttgaagaaaataaagaagcgcaattacttttagaagaaggaattaaagtcatcacagggagtcatcctattgatttattggatgaagattttgcactaatggttaaaaatccaggaattcgttatgataacccaatggttgaacgagctgaagcattgaagattcctgtaattactgaggttgaacttgcttatcttatcagtgaagctccaattattggaattaccggaaccaatgggaaaacaacgacgacaacattgattgctgatattttaaatgccgatggtcagtcagcaaaattgtcagggaatattggttttccagcgtcagaagtagccgaaaaagcgagtgcttctgatacattagtgatggaactttcaagttttcaattgatgggcattgatagcttccgccctaaaattgccttaattacaaatttattttcagctcacttagactatcatggttcgcaaaaggcatatgaatctgcaaaatggcgaattcaagaaaatatgacctcagatgatttcttgattctcaattttaatcaagaaaaatgtcgtaatttggctgacaaaacgaaagcgactgttcttgctttttcaacaaaagaaaaagttaatggtgcttattctaaagatggaaaaatttattttaatgatgaatatatcatggaagtttctgaactttcacttcctggtgagcacaatctagaaaatgctttagcagccattgtagcttcaaaattacaagggacaaaaaatgaagcgattgtagaagtgctgacaagttttgctggtgtaaaacatcgtctgcaatatcttggtgaaattgagggtcgtaaaatctataacgacagcaaggctaccaatattttggctactcaaaaagcactttctggttttgataatagtaaactttggcttttagctggcggacttgatcgtggaaatggttttgaagagttagaaaaagatttgcaagatttgaaaggaatggttgtttttggtcaaacagcaaataaattacgtttgactgcagaaaaattgaatattcccgtttttgatagtgaaaatgttgcaaaagcccttgaagaaattctacctcaaacgcaagcaggagatacaattttacttagtccagcttgtgcaagttgggaccaatataaaacttttgaagaacgcggtgatttattcatcaaagcctttgaaaatttgaaaaaataaaagtactgacaactattgaattaatttatgttaaaattaattttactgacagaaagaataattacgattcatcttgctgacagctatcagttttaatttgtactttatttctatcattattttcttgtttattagagaacaggatttaatgaaacttgggtacaaaaatatttgtcagagaatccccaaactattggagaaaaacaaacatgcgaattatcattacaggtggcggcacaggcggtcatatttatccagcgctagctttccttaagtatttggaaaaagtagaaccagatacagaagtgctttatattggaacgaaaaaaggcttggaggcaaaaattgtccctcaagcaggaattaaattaaaaacagttgatatccaaggattacgtcgttcacttagtccgcaaaatttaaaaacagcttataagttttttaaatctgtctcagatgctaaaaaaattatgaaagaatttaaaccggatgttgttttgggaactggtggatatgtggcagggccagttgtttatgctgctgcgcaattaaaaattccaacaattatacatgaaggaaattctttcccaggaataactaatcgttttcttgctaaaaaagttgaccgaattgcagtaggttttcacgcagcagaacaatattttccagcgagcaaaacgacttttactggaaatccaagggcacaagaagttgcagatgcagcggctcaagtagaaaaatttgaagagccaacggttgttatttttggtggctcacgtggcgctttaaaacttaacaatgcttttattgaagcccttcctgaattagcacaacgttcatttaaaaccgtttatgcttcaggagagatttattatgatgattacaaggaaacttttaatcaatataaagaaaattctaatttagatattcgtccttatattaataatatgacagaacttttggcaaaaagtcagctctttttaggacggtctggttcaacaactattgctgaagttaccgctttaggcttaccagccgtttatgtcccaagtccaaatgtgacagctgaccaacagactaaaaatgctcaagaatacgttgaccaaggtgcagctattatcatcaaagacgaagacctaacgggtcaaactttggttgaagctatttcaaatatactcgaaaataatgagaagtatcaagaaatgcaagcagctagtctaaaagcgggcgttccagatgctagccaacgcctttacaatctagtgaaagaaattagtaaataaatgagtgaaaaagataataacttaaccccttggcagcaaaaacatcttgaatatcagaaaagaaaagcagaagaagccaaaaaagaaaagaaagcaaatcaacctaaaaaggttcatttttcttcaccttttcttaaaagtctcccaaaaactgaaaaaaactttgatgacactagagacgaagctgagtcagctgagttgttagaagaaggctttgagactaataacgaagaaactcaatcaagcgaagctccgattgaaaatgaaaaaattattgctcagttagaacaactttctcaagagaatgaatatgagtatgaagaagagcaaatcaaaagaccttcgagattttcttctttatttaaaggttcagctccacttttaaagaaaatgtggccagccttagcaattgttgttctggtattcgttggctctctttatttgatttcacctttaagcaaaatatcaacttttagtgtttctggaaatgcgaatgaaagtagcgaacaagttgcattagcttctggaattcaaacaagtgatagtatttttaatatcctaaataataaggaaaaaattgaagcgacaattgaacaaaaattccctagaatttctgccgttacaatcaattaccattttcctaatcgctttgaggccattgtaaaagaacatacaaacagtgtctatgtcaaacgtaatgatcaaacttaccttgtcttaaataacggttacgtgattacaacaccagttgatgcaactaagcttgagaaattgccagttttacaaaattttaatgatgaagaagttaaaacttttgtaaatgcttatgaaacgcttaaaccagcaataaaatcactgatgactaatgttactaaaactcctacagatgcgacgaaagatttcattgccattgatatgagtgacgggaatcaggttcgagtttcattgagtcaattagctgaccgcctgccatattatccaagtgttgctaaacaagttcaagcaccacaagttgtagatatggaagctggtatttatacgaagccaaaagctgcttatgatgcttatctttcaaaattatctacctcaaaatcagcatctatttctgctcaaaatgcgaaaaagactgatgcaagtagtgaaaatactgctcaaagcacaacaacaagttcaaattaaaaataaaaaaagtgataatttaggattgtcacttttttagcacagagtaagctataaaaaaagctgataaaatgctataatagatagcacgcatttttgtggaaaaataataaataaactatataaagaaaatttagaggagaaactgtatgtctttgtttttagatacagcacgaattgaagtaaaagctggtaaaggtggcgatggtgcagttgcttttcgccgtgaaaaatatgttccagatggtggacctgccggtggtgacgggggaaaaggcggttctgtaatctttaaagttgatgaaggaatgtcaactttaatggatttccgttataaccgtattttccgtggtaaaccaggtgaaaaagggatgaacaaaggaatgcacggtcgtggagccgaagatttgattgttcatgttcctcaaggaacgactgttaaagataacgaaactggtgatgttttagttgacttaatcgaaaaagaccaagaatttacggttgctaaaggcggtcgcggcggtcgtggaaatattcgctttgccacaccacgtaacccagcacctgaggtagcagaaaatggagaaccaggagaagataaaattctacttttagaacttcgtgttttagcagatgttggtttagttggttttccatctgttggtaaatcaacattattgtcagttgtttcaaatgcgcgtcctaaaattggcgcttaccatttcacaacaatcactcctaatattggaatggttcaagtaggttatggagatagttttgttatggcagatatgccaggattgattgaaggagcgcactctggtgcaggactgggaattcaattcttgcgtcatattgaacgtacacgtgtccttcttcatgttctcgatatgtcagaacttgaaggacgagatccatacgaagattacaaaacaatcaatgatgaattagaatcttacaatttacgtttgatggaacgtccacaaattattgttgccaacaaaatggatatgccagaagctgccgaacgtttagctgaatttaaagaaaaattagctgctgatttaggttttgataaagaaatgcctgaaatttttgaagtttctggcctgactaaaacaggacttcaaggtttgcttgcacgcacaagtgaattacttgcacaaacaccagaattcttactttacgacgaagatgaattagcggatgaaacagcttattacggctttgaagaagaagaaaaaccatttaaagtttctcgtgatgatgatggtggatggcgcttatatggtgataagattgaaagactctttatcatgactaattttgatcatgatgaatcagttatgaaatttgctcgccaaatgcgcgcgatgggtgttgacgaaacactgcgttcaatgggagccaaggatggcgactatgttagaattcaaaaatttgaatttgaatttgtagattaaaaatttcaatattttcggagattaaaaatgggatttaaaattattggtgaccgtgacaaagacggaaattttattgcctcagccgattattggaccgatgaacggattgatgacttgttaaagaaatacaatcctcatggtaaattgactttatcaaaggctaatcaaaagaaaaacgatgaaaaaaagactgattaattcagtctttttttactgacagctagaatagtgacttctgtcagtaattttaggttcaattatttcttgaaaaataactttattgaccgttttggattggtcagcaactttataaagtgcattacgttgaagggtttgaacttgaaaagttggagtgatattcaaagatttattcagattatcagtaataatttgattggggttaaaagaaatatcatcgggaatcaaagaaagaattgccgatttttcatagtagcgttccgaaatgttttgatttgcaacatgaaaacttaaagctttagggactttgggggtttcaataggaaatcccgcaatgacagcattaaaagaaatatgttgaccaaaattaacttgcttacttttatatttttcaagctcagtcctaagcaaaagttcagcttcctcaaaatttaaattaggttgataataaaatttcttgcgaatattattggtaatcaattcaaatccggtaattccaacaacgaacccatttggattactttcaaattttttaaaatgactttgggtaagaacttcattggttgtaatttgtccatctgagataatactgatgaaatcaggcaacataacaatatttataaaactcatggcataaaatccttaaaaaattctgtcagcaaagtgttcagtaaattttactgatagaagaggtcttgattttcaaatgtttcttatcattgtatcacttttggtaaattttgtactatattttctcataataaaaaaacaatttataaagtaataaattgtttttttagtaaacataaagatttatggaaaaaaacagcagaaaattcttttttattagcggtgttctttccgaaaaattgaagtttttctgaaaattacattagaatttatagagaaagagaggtcttttattgattacaaagataaaaatttgtaaatgtaaagattaagaaaggaaagaatattgaaaaaattagtattaattattttattgctattctcatcgtcaaatttattgacgaccatgggttcagcagatacaacaagttatgatacaaaaggtcaagtaggatttacgggaaattgggtaggaccagaatcaagttcaagtagtaaagagaatcctaaaaaagaccttccaattactcagaccatactcccaaaaacaggagatatggaattctcatcaatggtaactagttatgttggcttattaattttggcaagcataatagtttataaaaaagaaagagggaggttaactttataaaaaataaataatagtcgattactgcaccttttttaaggataaaacaaatggagaaacttaatggataaactaattttaaaatcaacaacacttcttgccggcatactgatttctgcccctatgataatcacaaccgctagtgcggcgactacaggtggggattacacttcaagtgcaaatttgactttacaagcaggaactggtccagtcgaccctcttgatccaacagacccaactaatcctgtaacaccagtagacccaggtactccaggtgcttctggaaatcttactgtcgattatggttcaaccctttacttcggaacccaatcaatttccactcaatctaaaacttattatgcacatcctgatatggtaaaagatcaatctaacgctgtaaaagtagtgcctaactatgctcaagtaacagaccaatcaggtgagctatcaggttggacattaagtttaacacaagtttcagatcttcatatgactactggaacatcaacagatcctggatatgcacttagtggtgcacaaattagctttaccggaggcactctccttggaggaaatggtattaccgctgggaagccaagtgatgttgtcgcttcaggaacgctcacaccaggagtagcaacaaaactagtttcagctgcaaaaaatgaaggagcaggaacttggttatataattttggtgatgtagatgcctatgatgcaagttcagttgatacagccaataccacagatcatactaaagtggcaacaaaatcagcaattagtttggctgttcctgcaggtttgattgagaaagcggcaccatatactacagatttgtattggagcttgcaagccgttccaggaaatgattgggatggaaatacatctgcggttacaccagcaccataagtctgattttgataaaaggagagaataaatgaataaaattttattaaaatcaacggtactactaactgctgcattaatcgtgggaccaataattgccagtgaagccgatgccgcaagcaccggtggagattatacatcaaatggttatgttaactttgctgaaggggacaatactggaattaaccccgttgatcctttagacccctctgcccctgtaggaccaacaaatcctgatggtaccgacccaacacccggaacaggaggagcactttcaatcgattttgcttcaagtctaagttttggaacacaaaaaatttcttcaaaggatgccacatactttgctcatgcacagtggattagcaaagataaagatggaagtgcagttgatatgacacgtcctaattatgttcaagttactgatacacgcggaacctgggatggatggaccttgactgttgcagaatccgatcaatttcaaaatacttcaggagaaaagctaaccggagcagaactatcttttagtaaaggttataccgatggaaccactgctgcaaaacccggttatatcaataacactaattttgttgttagtacagctgctagcaaaattttaggagctggtccaaatcaagggatgggaacttgggtatatggtctaggagctaatgcagattaccaagaaaatggtggagcgcatctgggtaatgaagcagtttctacagcatcaccaatcagtcttaaagttattgctggtacaaataaagcgacgtcatatacgacacaattaatttggtccttaacgaataccccaggaaattaaatgtttataatttctaaactatgaaaaggagggtactgtgaaaaaaataagatggttaagtatacctctcatcttaatgacattaggattggaaattcgagttaatgcagcagaggtccaaagctataattcgcaaggaatagttggttttggtccaggtagcggagttcaaccccctgttaatcctaacaaacctgatccaactttacctgtatttccacaaaatccagatggttcaaagcctaatccagggggaaatggctcactgacaattgattttgcttcaagttttgactttggaaatcataaaatttctaataaagatcaaacatatctagctaaagcccaaaagtattttgattctgaagttttaacaccgaattatgttcaagtaaccgatcgtcgaggaacatttgccggttggaacttaaaagtagtcgagaaaacacaatttactcaaattgactcaggccctcagaagtacaaagtacttaaaggagcaacgattaatttaaaaagttcagaaacagcttcttttactaatgaaaaatctcccaaaacacaaacaattttgggacttattcccggtgttgaaactcaagtagctcttgcctcaaccggcgaaggagctggaacttgggtaattcgctggggaaacgattcaatggtcactgaagatggcttaacaacagcagtttcattatttgttcctggagatacccccaaggatgcgactgcttacactacaactttaaattggatattgtctgatttaccgacaaacgtgccaaattaatttgtaacacacattattatagaaaagaggacattatatgtctaaatcagtaacaaaatatctctctctagcaactttagggatattagcaacatcagtaactccacaacttgccagtgcagctacaacacaatcatatggcacgcaaggagaggtgacttttaccgccggaacagataccacaggtccagttgacccgcaagacccaactgttccagtaaaaccaacggagccagatggtgtaaatccagtaggaccgacaatgccagatagtggtttaactattgtctatgcttcaagttttgattttggaagtcatcctataagcaataaagcagaagtttacaacgctgctgcacaaaaattagacgataatacgacacgtaccaactatgttcaagttgcagataatcgtgggactttctcaggttggaatttaaaagttcaaatgaccgacttcacaacagcagatagtaatttagtagcgaacggtcatggtacattaacaggagcaacagtgactctgggtgatgctgagattcaaggagctggtacagcaaacccagcagatatctcttcagctactacagttttgacacctggagtacaatcagcaacaatattgggagcgacggctggtcacggctctggtaatagtttacttgactttggggggaaagatggagctacaaaagacacagccatcaaactttctgttccagcaggtgtggcaggtgcagccaagtatacagcagatttaacctggacacttgacgatacaccatctaattaatatttttagtggtgagaaacaagcaagggagatttcatgcaaagaaaatataaatttaaacttgtgacttttataatgttgctatcactgttaccgactataaattttaatggattttcttcagaaagtaaaaaagaaaatgttaagataaattctcttgaaaagatgctttcttctcaaggggtgtcagcagcaactcagacacttataaatcgtcaaagcgtgagtcccagtggcactactttcaatggaaattcagtttcacaaccaaatcgtactccacttccacaaaattcagttgaagatgcgataatgcctaatagctttggatggcaacaaactatcgctaatctaacgttaccaaccaatcaagttactgctgtacaaaatggaacaattataggaagttatccaactacagatgctggtgttcaacaagcgctttatgcaatgtatagtgcaactaatgctagcacttcggattttgtcttatactatggagctaatacaacactgagtaattcagtcctaaaagcagtagtttctaatccaagcgcgactaatatgacattttgcacactaaaagggcatgctaaaagtttaacctggatttcaaatccagccgatctacttacgagctcaaatagttctcagccctcaggaacaaattatactgtaaccttaccttcaaatgtctattttggagttccaactatttttcgcaatgtaactgtggctgcaagtggggataatatttatgcccaagggaacgcatttgcaacgacaaatggctcatggataactggtgctcctaacatttatggtggaacggacaatagtgatatatctggaaatacaaacctatatattggagcaacaggaagtactgcgggctggaatatctatggtggtaatgcatcggctggaacaatatctggtaatactcatgttacgattgcccagtcatcatctactataaatagtgtaactggtggaagtgcatcaggagcaacaatttcaggaaatacaaaccttgatataagtggagctattgcttctcagataacaaatatctacggtgctggaattggtacttctaattctcctgttaatatgaatgggaatgttacaacttatgttaactcaacaaatggaagtgcaagataccaactttatcaaggtggaacagtttatggaaatataagtggttcaatctataatactttaagtggggcaggaggatggactggcgcaactagtaatataaatggtgctggtggtccagcatcaacttttaacggaggttcattccaagggaatatagggacatctggtgccggaaatgttatctcaaatagttacaatacatcatccttcacaacaggtcaagctttatttacaggtggtaatgctggaacaggcgcttcatatgctcaggcaaccaacgccactaccgcggctcaagggatattatatgctaatattactaactatattaaatctgcttttacaactggaacagctggggcagtttatggaatagttggtggtaatggtcatgattctctaaaaatttctccatcacaatggggacttggaagtcagactggtcttgatagtgcagttggtgtaacagatgctaaagcttatgcacagattccatctactactgtagtttcaaatgcccaaaaaattactagtaatgcaatttatggcgatgtttatacttggttacaatcaggtgttatgtcaacaacatcgggtggtggagcaaacgattggacaggttattcatatggtgcaagttcaaatgggtatctacaaggacaatcagttttagaagctggaacggcaaatgctgataattctgttggaggtgccggagtagtatattgtagtgcaatgggaggtaccgcagaaacaactcttgcagcccaaggaacagttgcttatggtaaaactgatacaagttctgccattaattccggctgggatttatggggaggcggaggaacggtatggacctatcgtcaagcctttttacaaaacggtaattcctatcttattcacaataatgatattgcccgttggacctatggaggtcaatctaatggtagtcaggtcggaaattcatacaatattttgaatggggctattgttgatactcttgaaggtggtggttataccgcaactacaaaatggggaaatactacagcacaagtcaatcaagggcaagttaattggttcttgtcaggcggttcttggggagatttgtataatactggaagtgcaacagtaaatgtttacaacggatatatcaacgctattaccggtggaaactatggtcaagctggagtagagacaattgctggtgattctacagtcaatgtttatggaggtgatttctcaggttcgccaagaacaggaacaaaacaactttgcggaggtccgttctttaatggggcatcctcgattttaggaaatacagctttaaatgttgatttgacaggttcaactggctcaagcttccaacttccttctggtacatatttatcaggaggagcaggttataacaatactgtgactcacgttggttctggagtaaataacagtattagtgtcaatatatcagcaaatgctgcatccggaaatgtcttaaatggtgctgttatttacggcgacgggcagtcaactggttcaaatagtacatatacaaatgttggtacaatcaacatgaccattaacgcagatggcaacactgtaggttcggtttatgcaactaattatgtagccatgccagcttcaggtcaaagatacaatacgaatataaaaattggggatggtactaccatttctggtacgataacatccggaggaagtagtgataatctaactgatgcgattgccgcagctaataacaataaatcggctattacattaggaaatagtacttcacataacccaattaccataaatggttcacttatcaattttaacagtgcagaaattactgaaaaagcagtagtgaatgtagcaggttcttttaaaaatggaggtggagctacagcagcaaaccacgctgcaacttactccaaacatggttcgattcaaatggatactgattctactcttggaattacttcaacatcatccgttgtatcagcaagccaattagttgcctatccaaatgcaatactttctacaccctatgtccaaacatctggattgattaatttatccgatttagatctttcaaccaataagggtaatctattttggaagccgatcggtaatccaccaacaagtattagtaatacctataatggagcctattggggaacacaagcggcattcccaattttgacgtttaatggtggagatacttctacaaaatctggtgcagtaaatattagtcctaataatttttctggtgtagattcagccaaaaattatgcatttttaggggattatacaatgtcttccctctccaccccaagtaatccaacttggattggttatgttgttccagggcaggtacgtgtatataatacaactggtgatgcagattcaggaaattggcaacatcatttaaaatctaatgttacaacagggaatcccgttgctggtcaaacgatgcaagcatgggcctcggtagcatctgatactgatgcaagttcgatcaaagtaatgtatgtgatgggatatagtgatagcacaacagctccctttagcttcaccgctaaagcaccatattacataaaatctagaacagccacggcatttgatggaaagattttaaataattatccatcaactaatcctaattttgatgtcaatgctggaactactggtgctacacgtaactttggtacgagagactattttgtaggaaatcaacaagatggcacaaacgatcaagcaatatatggaagttatattgtacaaaatgtggttactgataacaccactagtctaagtgctggaaactatatcctaccgaataaaggttcggcaataaatgcatcatcattgactcaagcacaactccaaaaaattgttggtttaaaaggagtgggtgtaatgacagatattacgacgagtggtgatccattaagttcaataaataatgcaggtaatacgattcaagatcctacaactagtgatactaatgtaaaagataaatcatatgcagaaatacctgtgagctggactttgggaaaaagttcaactaatagtaacattgttgttgtaccacaggcagcagttatttcatcagatagtcagacagctcttaatgtttatgatgcaagtatgacaagtgatgatgcacacgatttaaaagatcaaaaagatttggatggtaattggacctatgctttagcttttaaagcggatggaacgatagaagaaccagtgattagcagtccgtcaaatttggttacaaccttgcaaactatacaagccaataatccaatcattgatggagatggtaatattcgtcctgttacttatacttataatggattatcaaaagatattacacttaatttaacttttggctctataagtctttctacaccaaattcttacgactttggtacattagacgtaagtcctaaaccattaatttcatgggccacaagtcctgccagtgatgtgattgttacggacacacggacaggttctgccttgaagccatggtatgtgagtgtcgcacaaactcaagatttaaaaggtttgacaaataataataatttggcttcatatcttttcttcaaagacagtacaggaagtaaagtaattacaagtgatgccttacagatttatgccaatacttcaccaactactggtacttttaagttaaatcaaaactggaattcaacctctggtgaaggaatccaattgaatattccggttgatcatcaagagaagggaacctatgagggacaattaacttggtctttaaataatgtaccttctaattagttgcgtatagcaattttatacaaagtgggattagtcctactttgtataacggacttattttaattttattataagattttaatcaaaatactacagagatgtagttctagaaagagtacataatgaaaatttatcaaaaagttttactgatcattgccactatatttactttagggactgtcagtaaagaagttcatgcaaatgaatttaatttttctgtgaacccggttcttccagaaaaccaaattggcgagagcggatactttaatttacaaatgagtccaggacaatcgcaaactttgacgattactctaaaaaatactactgacaaaacagtagtggttgaagaagaaatagctagtgcgacaacaaatattaacggtgtggttgaatactcaccaaataaaattaaagcagattcaacactaaagtataatctagtagactatgcctcaattccaaaagaagtatcactacaaccaaactcttcacagcaagtaaaagtgagtgttactatgccaaaggaaaattttaatggtgtaattgctggtggaattacttttaaagaaaaggactcagagaaaacaaattcaaattctaagggattaagtattcaaaataaatatgcttacgttgttgctttactgatgcaacaaaataaaaatactgttgcgcctgacttgaaattaaatagtgtagagcctagtcaggttaattatagaaatgtaatcaatgccaatttacaaaatccaatggctggatatctaaatcaaatgtatgttcaagcagaggtcaaaggtttaagtaattctaaattatcttataaggcaaacaaagagatgctgcaaatggcaccaaatagtaattttgattatcctgtttctattggtgatggaaataagcttgaagcgggtaagtatcgtctgtcgatgacagtatatgggcaaaaaaataatgacggaaagttcacttatgttgattcaaaaggaaaaaaacaaaaatttgattatcaatggaaatttacaaaagactttacaatattaggtaaaacagcaagtaaattgaattcaaaagatgtaactgttaaaaagactccatggtatgaaaattggcttatctggttaggtttattattaattcttttagctcttttcttcttgttctttattttatggaagagacgtaaaaaagaagaagaggagcaagatttagaaaaagaaaaattaaaagctcaacttgaagaaatgagagagcaaataagtaaagaagataattctgatgagatagatgtttaggttctacttagatttttgaatcatgattatttacatttattaaagttaagtaaaagtaaaataaattggaggaggttttttatggccgagaatcagctattctatccacggttagaagaattaataagaatatcaaaaaaatcttttaatcaagttgaaagagatctaggatatcctagaaatgcgcttcataattataaaaacggtgtggaaccttcgggaattcgattgattgaattggcacattatttcggagtaacacctgagtatttgctaggaataaacaatgacccaaaaaataacggaaccagaattatttttgaaagtcttaatgattatcagaaaaaagatttatgcattatttgtcaagaatggttgttgtcttcaaaatagagtaaagaaagtataaactataaataaaaaaagccttataaggcttttttatttataaaaattaattagaatttaattattttttggggcgaacgaacattgcatccccaaaactgaagaaacgatatttttcatcaatcgcatgttggtaagcgtcaagaacaaaatcacggccagcaaaagcagcgactaacatgaccaaagttgattttggtaaatggaaattggtgttaaaagcatcaacaactttccattcatagccaggtttaatgaaaatgtcagtccagccagaatcggcttggatatccccatcaaatttactaccgatggtttccaaagtacggattgatgttgttccagaagcaacaattttgtgtccactagccttaacagctctcaattgagcagccgcctcttcagttagacgataaaattcgctgtgcatttgatgctcatcaacattatccacactgacaggacgaaatgttcccaaaccaacatgaagtgttaattcaacaattttgactcctttgtcagcaattttttctaacaattcaggtgtataatgtaggccagcagttggagcagcagcagaaccattctcttttgcaaaaactgtttgataacgttcttgatcctcgagttgttcgtggatataaggaggaagtggcatttcgcctaagctttccaagatttcaaggaaaattccatcgtatttgaattcaacaattcgtccaccatgatcaaggacttctacaacgacagctttcaaacgaccatcaccaaaaatgacttcctcaccaactttcattttgcgagctggttttgccaatgtttcccaacgattttgccccatatctttaagcaagaggagttcaatatgtccacctgtttcagcgcgttcaccgtggagacgggctgggagtacccttgtgttatttaggacaagagcatcgccagcttcaagttcatcaataatattatagaaatgtctatcttcaagctcttcagttttaggatcaagaatcaacaaacgtgattcagaacgtttttccaaaggagtttgggcgatcaattcttctggcaaatcaaaatcaaaatcatttatattcataagttgtttttattttactccattccgtaaaaggattctaaaatacatttatttcaaattagtttagttgatttataggtaatttttctctcaaatcactaaatcaattggttgataaaaaaagcaatgcatattgttttattatatcattttttggatagactagctttaggaagaacgagatttattgtatgatcaaaacaccgtttttgtaagattattactaaataatataagaagttgtaaaaaataaattttaatattacaatggtaaaataaaaattaaaaggaattttatgaaaaaaaggaaaaaaatgattgcttggattttagtagttttatccgttgttttggtcggtggctattttgcaataggaaactatttttatgacttagctgttaacgcacgtaccaataaatcttttttaactgccgggagcaaacagaaacctctttctaaaaaagaagaagaaagaaaaaaggaaaataaaatatttttagcggatgtaaaatccgacgcttggtatgttacctcctctgataagttgaagttgaaactctatgctgcagattataagcaaccaactaaaacaaataaatgggctattgttgttcatgggtatggtggacaatcgaccgatatggcaagttggacacgtcatttttacaataagggttataatgttgttacaccagatttaagagggcatggtaaaagtcaaggggattatatcggtatgggctgggatgaccgtaaagatatgttgctttggattgccaaaattattcaaaaagatccacaggcagaaattgtcctattgggcgtttctatgggaggagcaacggtgatgaacacttcaggcgaaaaacttccctctaatgtcaaagcaattgtggaagattgtggtttcacatcaacaggcgatgtttttgcctatcaattaaaacaattatatggattaccaaaatttccagttctttatgcggcaaataccgttgtcaaaatgagagctggttatgatatctttaaatcttcggcaattaaacaagtagccaaaagcaaaatgccaattttgttcattcatggtgataaagatactttcgttccatttaaaatgttaaatcctctctatgatgcagcaaaagttgataaagaaaagctgattgttcatggagcgggtcatggagaatcagaaaaagttaatccagacttatattggagccatgtttggaattttgttggaaaatatatgtcttaattgattacaagaaagtccttttttaaaaggactttttatttttgttaatgtattttttgaagacaatttttagttgacatggagataatttatgatataatgaaagtgtagaaaaattgatatataccaatttagaaatggagcatataaaatgaaagttatcgtagtaaaaaatcaacttgaaggtgcaaaaatcggacttgaccttcttaaagaatcaatggctaatggcgctaaaacattgggacttgcaacaggctcaacaccagtagaattttacaaccaaattgttaactcagaccttgattttacagacatggtttcagtaaacttggatgaatatgttggacttgacggttcaaatgatcaatcttaccgttactttatgactaaacatttgtttggagaaaaaccatttaaagaaaacttcttaccaaatggtaaagcagctgaccttgaagcagaagcaaaacattatgaccaaattatcgaagaaaatccaattgattggcaaattcttggaattggtcaaaatggacacattggttttaatgaaccaggaacacctgctgaaattacaactcatgttgttgaccttcaagaaagcacaatcaaagccaacgcacgtttctttgaatcagaagcagatgtaccacgtaaagcaatttcaatgggacttgcttcaattatgaaatcaaaaaatattgttttgatggcttatggtaaggaaaaagctgaagcaatcaaaggaatggttgaaggagaagtgacaacagagcttccagcatcaattcttcaaaaccacgataatgttactgttattgctgatgaagcagctgtttcattgttgagcaaataaaataaaaaaagtcctgtcaggactttttatttactgacagaaattctgtcagtatttttttatctttttttatacttacggtgattatcaacgacttctgaaacggagtaatctgtctcatcattgaaagaaatattatgattcaaatctaaatattgattgaacatgttttcgtattcaggaattgatagacgtgttcttgcatccaacattgattgatgctcgattttaagtaaatgattttcgtaaccttcaacaagttcaccagagaaaaattcagcaacagtaccagaaccataactaaaaagcccaatacgctgaccagcactcaatttatcagagttttccaaaagtgaaatcaaactcaaatagagagaaccggtatatagattacccacacgacgattataaacgataccatgttcaaattgttccattaattcttcagcattggctggcttttctgattcaagcattggcaataaagcttttttacccattttagtgtaaggggtatgaaaagcgatagctgtaaagtcttcaaactttaaatttgttctatggctatactctttccagattttagcaaaagcatcgatatatgtttcgtttgaaaacttaccatcaacagaaggataagcctgaccaaaaggacgccaaaaatcatagatgtcttgagttaaagcaacgttatcattatttaaggccaaaattttaggattggccgtgataagcattgcaacacttccagctccctgagtaggttctccaccagtatttagcccatatttggcaatatcagaagcaataactaaaactttagtatcaggattcaaaagaacatggtcgcgagcaagagcaaggccagcagtagttgcataacaagcctctttcatttcaatgcttcgagcaaaaggttgaatgccaagcaaatcgtgaacaacaacggctgaggcctttgattcatcaagacttgattcagtaccaacgatgaccatgtcaatggcatttttatcttcctcagtcaaaatacttgctgccgcgttagcagcaaaagtaataatatcttgagtagcaggattgactgccatttcatcttgcccaataccaatttggaattttgcagggtcaacattacgagcatttgctaaatccctcatatcaacaaaagtatttgggacaaaaaatccaagtttatctataccgactttcatattttaaaaatttcctcacttattattataaaagaaaggaactcctttcaatgtctttggaatgctttaattttatcataaaaatacgttaaattctttgctaagatgttttctttctataaaatacacacatttaattttttgtttaattaataaaaaatggaattaagtaaatagtatgtattttaaatagtacaaaaaatgcttgaatagagtcattgattagatattgtttattaatttaatgtaaagagactttgacaaaagtagtttaaaatatgctataatggctttcggaggttcattcgtgaaagaaattgtaatcattgacgccttaagaacaccagttggaagatacgacggtgctcttgctgaatattcagcagcagaacttggaacacatgttgtttcaaacttattgtcaaaacatgaaaatataaaatcagatgttgaacaagttatttttggaaatgttcttcaagctggtaatggtcaaaatatagcacgtcaaattgcgattcatagtggtttatctaatacagtgcccgcttcaacaatcaacgaagtttgtggttcaggaatgaaagcagtgattttagccaaacaacttttacagcttggtgaagcagaagttgtaatcgctggtgggacagaatctatgtctaatgccccaattataaagaatcgaaaaactcaagaagaaacattaagtatgttaaatgatggcttagttgatgccttctcaggaatttctatgggaattattggtgaaactattgctgagcaatttgatataagtcgagcagaccaagacgcttttgcacaaaactctcaagaaaaagcggtcgctgcaagtcaagctggaatttttaaagaagagattgttgcgattggagaagtcggagtcgacgaaacaccacgtccttcttctagtttagaaaaattagccactttaaggacagctttcaaagaaaatggaactgtgacagcaggtaattcttctcctgttaatgatggagcttcagctgtcattcttgcaacaaaagactatgctgaaaaacatgggattccgtacctagcagaattagttgatagtacagaagttggaattgaccctgctattatgggagtttcaccaattgaagctatcaaaaaattaattaatcgttcagagcttgaactttcagatattgacctgtttgaaattaatgaagcatttgcagcatcaagccttgctgtcaatcgtgaacttggtttaaatgaatcacaagttaacatttatggtggtgcaattgcactaggtcatgctatcggttcaagtggttctaaaattctcacgactttgtcttatgccttaaaacgtgagcaaaaacgctatggaattgcaagtctttgtatcggtggaggcctaggtttggctgttcttttaaaaaatcctaacctttaaaaatgattgtggtttaaacaagtaatttttaagaaattaatggaggaattgcccagcttatctgggcatttttggaaaatatgagaaaaaaattttatcaaatgtcgcccaaagagcgattagattcattgaatctgtcaggagatactcaggaaattttgagtgaaatggctttagatacaaatattttaaacaatctgattgaaaatcaaatttccgaatttgaattgccgatgggacttgctcaaaattttgtcattaatggaaaagaatacatcgttccgatggttacagaagaaccatcagttatagctgctgcgagtaatggagcaaaaatagcggaaagttttacggctaaaatagatgaacggttaatgcgtgggcaaattgtattttatgacgtaaagaaaccagaagaaattattaagaaaatatctgaatgcaaaaatgaaatatttgaacaagctaagctttcgtatccttcaattattaagcgtgggggcggtttgagagaaatttcgagcagacttttttcaagtgagaaatttatttcagttgatttcaaagtggatgtcaaagatgcaatgggtgccaatattattaattctatattggaaggtgtagcagcactttttcgtggctggttttctgaggaaaaaattctttttagcatcctttcaaactatgcaactgaatctttagtaaaggtgagctgtgaaattccagttgatgctctttcaaaaaaatcaaatggtttagaaattgctcaaaaaattgcagttgcttcacaatactcaaaaattgacccttaccgtgctagcacacacaataaaggaattatgaatgggattaatgctgtaattcttgcgacaggaaatgatacgcgagctatttcagcagcaattcatgcttatgcagcaaaagaagggacatatcaaggtttggctaaatgggaagttcatgccgaaaagttatttggagagttagaaattcctttacctgtggcgaccgttggtggtggggtgaaagtcttacctaaagcacaagcggcaatggaaattttaggaatcacagatgctagagaactggccaaagttatcgccgcagttggtttagcacaaaatttagcagctttgcgcgcacttgtttcagaaggaattcaacaaggacatatgagcttacaggctcgctctttggcattatccgtgggtgcaaaagcagatgagatagcagtcataagtcagcaacttcggcaggaaaaagtgatgaatcaagaagtagctcgccgtttattaaatagtctcagaaactaaaaaagaactgtcaagattttttcttgacagggcgaaattagtctgctataatattaaatataataaaaatagaaataggaaatataaaatgtctgtaaaaattcgtttgactcgtatgggttctaagaaaaaacctttctaccgtatcaacgttgctgattcacgtgctccacgtgatggtaaattcatcgaaacagttgggacttataacccacttgtaactgaagaacaagtaactcttaaagaagaacgcgtattggaatggttgagcaaaggagcacaaccttcagatacagttcgtaaccttctttcaaaagctggcgttatgaaaaaattccacgaatcaaaactttctaaataatttttgagataagctgctttttagcagcttttcgtgaataaagaaatcacatatattgaacttgaagatttttcaagttagagtagaggtaagaaatgcaaaaagatgtgaaagaattagttttaacaattgttaaaccattggttactcaaccagatgaagtctctttggaactcattgagggtgaggaatttatggaatatcaccttaaggttgcagagggtgatatcggtcgaattatcggacgtcaaggtcggattattcaagcaattcgcacagtggtttactttgttcctgtagaagggaaaaaagttcgacttcttgttgatcaataagaattagaggctcacttagtgggtcttttatttttgttactgattcggcttttaattattttaaagtaaattaaatattaaaagagttggaagagtgaggttttttagattaaacgaatatttctaataataatcaaagacttctttaagattcactttaattgtatgaaaaattatgttagaatgaaaaatattgattaacaattgtagaaacaatcggttataaatataaataaactgattttttatataggtggaataatggataagaaaaaaggaatcttattagtagctttgggaactccgcgctcatgtgaagcagatgatgtgagggattatttaaaagaatttttgggtgaccctcttgttatacaaaaaccaagatggctttggttgccaattttaaatggaattattttaaaagttagaccgcaaaaatcagcagagatgtataaacaaatctggacagatgaaagttcccctttgatgatttacacagtagcgcaagcaaaacaactacaggatatgcgcgaagattttgatgttcgttttgccatgacttacggagagccacgcattgataaagtaatcgctgagatgaaagaatctggtgttgaagaaattactgttcttccactttaccctcaatattctttaacaacagttgaacctgtaattcaacaagttaaaaaaattgatgataagataaaagtaattagagatttccacaaagtagaatcttatagcgatttactggcagagtctattagagaaaagtggcaagcaaatgactatgataaactggtccttagctatcatggaattcccttgtcctacgtgaccaagaaaaaagatgcttatgaagagcaatgtaaagaaacaacacgtttggtagtaagtaaacttggcttgagggaagaagaatacgagcatacttatcaatcaaaatttggtcctgaaaaatggttagaacctgcgactattgatagagttgctgaacttcccaaagaaaatgctaaaaaagtattgatctgttcaccagcattcgttgcagattgtttagaaactttatttgaattagaaattgaaaataaagaagtatttgttgaaaatggcggagaaacatttgattttgttcatccttttaatgactctttagactttactagagtattaagtgaagtagttgagcaaaatagactctgagaaataaaatcattattttattagttttggcctttaaattttataacattactaaagagaaataggatttgttataatggttcataatatgctaaaaatagtaaggaaatccaatgaaaaaacagtatgaaattgtttcaatgaaagaccattaccgaattcgccttggaatttttgagccagaccaaaaagcaaaagcggtagtacaattagttcatggatttggtgaatacacaggtcattatctctatttaattaatgaattagtcaatgctggttttgtttgcctaatgcacgatcagagaggacatggcgttttagcagctgctaacccaaaacttcaaggacgagctagagcttacgagagcctaattagtgatgccttagaagtgaggaagataattggtaaaaagtatccaaaacttccggtttatctgtttggacatagcatgggtggaaatatttcactcaatgttcttctgagaaatattgaaaatcaaaaactttaccaaaaagcagtaattgaatctccttggctagcgctgacaaatccaccagccgtgccgcttcaaagactggcaggttttttaggaaaaataagtccaaaaattcgagttcgtacaggtttaaaagttgaagcaatttctcaccgaaatgatttagtagatttagtaactaaagatggaatctaccacgaacttctttctttgcgactcttttcacagattatggaagcggggcgttttgcacaaagtcaggctggaaatttgaaaataccaactttattattctgtggtgagtcagatcagatttgttcgcccgtggtcattcgttcatttgcaaacaatgctgggaaaaacttagaattaatagagattgcagatggttaccatgcactccatttagatacagaggcagagaattttattgaaagaactaaagatttttttctaaaagaaaatttttaattagtatcaaaataaatataataaaagagtcattcaatttgattggctcttttattaattaaactaagggggaatttttttcattcaaggaaaagatagctttccttgaataatagacttaaaaaatagttttatttaaatcaggacttattaggtatggtataattgtagaatggaaaaattttacaaggtaggaacaattgttaacacacaaggacttcaaggagaggttcgcgtgatgccatcgacagattttgctcaagaacgcttctcaaaaggttcagttttggcacttttcgatgataaggataattatattcaagatttaaaggtgaagtctggtcgcccacaaaagaatttttatgtcgttaaatttgaaggattttatcatattaatgacgttgaaaagtataaaggatatattgtcaaaattgcagaagaaaaccaagaggatttagatgatggcgaattttactatcatgaaatcattggcagtgatgtttatgaaaatgatgtcctaattggtcaaatttctgaaatacttcaaccaggggctaatgatgtttgggttgttaaacgtaaaggaaaacgtgatttattattgccttatattccgccagttatcttaaatgtagatgtgagtcaacaccgagtggacgtatctattatggaaggattggatgactagaaatatgagaattgatattttaagtatctttccggaaatgtttggcccacttaatcagtcaatcgtaggtaaagctcaagataaaggtattttggagctacatacacatgattttcgagaaaatgcaacgaataaacaacgtcatgttgatgatatgccttatggtggtggtcaagggatgttattaatgccacagccaatctttgacacaatggataaaatacctcagaagtctgaaaaacctgcgcgtgttattcttttagacccagctgggaaaaaatttgaccaaaaaatggccgaagaattatctcaagaagagcaattaatttttatttgtggacattatgaaggctacgacgaacgtattaaaacattggtgacggatgaaatttcattgggagattttgttttaactggtggagaagttgcagcaacggtgatggttgatgcggttgtgcgtttaattccgggtgttttaggaaaagtagctagccatgaagatgattctttttctagtggacttttagaatatccgcaatatactcgcccagaagattttagagggatgaaggttcctgaggtattaatgagtggtcatcatgaaaatattcgtaaatggcggttaaaagaatctttgagaaaaaccttagaacgccgtccagatttattggataaatatcaagctaatgaagaagagttaaaaatgctacaattattgcgtgaaaatgttcaagatgtggtagaatgaagtagtgttaagattttagttgaatattggggaatatcctttaaatttggatgatgaaatctttgttcttattgttcatatctggatataactaaatttataataaaaaaataggggattttaaaatggctttaacgatcgaacgagaacaagaatttgttaaccaatttcattatgatgctcgtaattatgaatgggaaaaagaaaatggaacacctgagactaatctaaatgttcaatttcaacttgttcccaaagaacaacttgaaaaacttggtgaaggtgacactggtattcacgctgttttgacttacttgattgtactagataatattgtactttctggttttgtgagtcaattgaactatgtacgtggtcaaattattaaggaacaagaagaacttgaacaagaggaattagcccaacttgcggcgcctttgtttgaacttcttaaacgcttggtctatgaaacaacagaggttgccttagaccagcctggaataaacttggaattttaattaatagaatagaatttatgaaattagctgttattactgactcttcggcagattttgctgaaaaatataaaacttacgaaaatctttttgtcttagatattccaatttccattgatggagtggattatgatttgcaaaaaatttctcatgaagaatggtacgatcttatggcggaggcccaagaagtacctaaaacttcgcaacctagagttgctgaacttgatagacttttaaaagacttagaaaaacaagggtatactcatgttttaggtctgtttttgccagcagcaatttctggattttaccaaaatattttttacttacaaagtgaatatgagcaaatgaaagtagtatttcctgaaacttttattacctcaagtccgttgggctatatggtggaaacagtattggatttggcagaagctgatgtcgaatttgaagaaattatcgcaaagtttgaagaacaaagagacggtgaccgtgcttatatgcttgtcgatgatttgcattggttagcaaaaggtggacgtttgtctaatggtgcggctgtgcttgggactttattaaatattaagcctgtgctaacttttagtactgaaggtaaggttgaagtttttgaaaaagttcggactgtgaaaaaaacgatgagccggatgaaggaacttttgttaaaagatgccaaagatcctttggcatacaaagtttatgttattcatactagagctgaagatcgggcacaagaattatatgattatgcattatctcaaggttttgatgatgtggaaatcgtcacttttgggcctgttatcgcaactcatttgggcttgaatacagtggcttacggtatttcaccaaaaaaataaagcacgtttttacgtgtttttatctaaaaataaatattctgaataataaaaataatagctacttctataaaatactaatttctttataaatgaatgggggatgaaattgaataaaattaaagtgattgttgctggatttcgtggaaaaatgggagttactgcggtacaaatgattctgaatgctcaaaattttgaacttgtggctttattaggaaagaaagaagaagtctcagaagcgtttggagttcctgtttttagtcgaaaagaggatttgattggatttgatgctgatacttggctagatttaacggctcctgaagtggcttatgagaacactcgttttgctttagaaaatggttttagaccagtggttggaacgactgggtttaccgatgatgaagtagcagatttaattaaattttctagagaaaaagaattgggtggtcttattgcaccaaattttgccttgggtgcggttttattgatgcaattttctaagcaggctgttaaatatttcccagatgtggaaattattgaattgcaccatgacgggaaaaaagatgctccttctggaaccgctgtgaagacagcagaattgatgtctgaggaacgtttggctcatcatcaaggggcagtggatgaaaaggaagctttagctggtgctcgtggtgccgatcttgaaggaatgagaatccattcggttcgtttacctggtttggtggctcatcaagaggttatttttggttcaaaaggtgaagggctgactttacgtcatgattcttatgatcgttcaagtttcatgactggtattgctttgggaattcgtaaggtaatgacggtgtctgagttaaaatatggtttggaacattttttggatttataatatttactgacgaaatagactgtgaccgaatgattagtgagggattttatgagtgaattagagattcgtagattagaattaagtgatgcagaagcttttatggtttatattgccaattgggcaacagatacaagtccttttaaaatcgatgctgttaaagcttatgcggagctttctttggaaaatttttcggactatgtggaaaaaactcatagagaagaaacttttgctgaaaatcccgattggtcaacagcaactaaatattttgcttttattaatgggcaaatcgttggtgaaatttcttgtcgttggcaaatcgaaaaaggaattttgttagaatggggtggtcatattggttatggtgtggctcctgattttagagggcatcattttgctgaagaaatggttagatttgttcttcctaaatatcggaaacgtaagatttctcaggtaatgatttctgctgacaaagagaatttggcgagtcgtaaaagtattgaagcaaatgcgggtattttggaaaatattgtagatattgatggtgatgaaatttgtcgttactggattaatttagaagaacaataggataaaattactgatggattgctagggttaatctggcagagcgtcaagacaaattcacaggtgaatgatacagggcaaagcttaagaaacagaaattgatgagagctaaaagtgctgacaggtctgtataaactttctgtcagtaaaattttaaggtgtacaatggggctatgccccgtttttgtttaaaaaatgataaaataatagatatgaaattagaaaaattacccgaggagtttgtacaggccaagccggttttagaaaaaataatcgagcatgggtttgaagcttattttgtgggaggttctgtacgtgatatattgcttgggcgagagattcacgatgtggatattgcaacaagtgcatatccagaggaaattaaagatatttttccttataccattgatgtgggaatcgaacatggaacagtacttgttttagcgggaaaatcagaagctgaacattatgaaattactacttttcggacagaatcaaaatatacagattacagacggccagatcatgtggattttgtcagagatttacgagaggatttaaaacgtcgtgacttcacggtcaatgcttttgcttgtgatgttaacgggcaaattattgatttgtttgctggactgacggatttgaaggaacgcaggctaacagcggttggtagcgctttggaacgttttaatgaagatgctttacggattatgcgggccatgcgattcgcagcaactttagactttcaaattgaaaataatactttcttagccatgtgtgagtcggctcacttactggaaaaaatctcagttgaacgaatttttattgaatttgataagttgttgttaggtcaggattggcgaaatggtttgaccttactgcttaaatcaggggcttataaatatttaccagatttgcaagattcggccttgaaaaaagtactgacagacttgtcagtagatttccattttcagaattctgagcaagcatgggcagctttactgactagattttccaatgttgatgtgaaaacatttttgcgaaaatggaaagtgtccaatgaatttgcaaaatttgtagcagaccttgtatcagcttatgaacttgactcttgggatttgatgagtctttatcattttggtttagaaaaagtgcttttggttgatgaattgaaagtggcttatggtttgaagattgatagagaacaagctgtcactattaataaccaacttcaaattcatgataaatcagagattgtcattgctggaaaagatttaatggaagaattttcgcttgaacctggtccagaacttggtaaaattttaaaaattattgaagaaaaaattgtcaaaaatgaattgaaaaatgagcaggctgctatttttgcagaagttaaaaaaatgctctgattaaattttactgacagaaattttggcaaataaccaattgaaatttagtatttattataaatacaatttcttggtttctaagtaatgtattttatagattataaaggagaaataaatgaaaattgaaaatcgccgtaaaggctcatgtacaacagttcttgtgggaagaaaagcatcaattgatggttcaaccatgattgctcgtaatgatgatggacacgaagctttggatccacaacgctttattgtgattcaacctgaagaacaacctcgtcattataaagctgttttatctggtttagaattagatttacctgaaaatccattacgttatacttcaacgccaaatgcagttttaaaagaagggatttggccagcggctgggattaatagtgctaatgttgcgatgtctgcaacagaaacaattactactaatccaagaatcttgggtcttgacccttatgtggaaaatgggatgggtgaagaagaccttgtaacacttgttttgccatacattaaaagtgctcgcgatggggttgagcgtttgggacaattacttaagacttatggaacttatgagccaaacgggattgcttttgctgacaaagaagaagtttggtggttagaaacaatcggtggtcatcattgggcagcagttcgtattcctgatgattcttatgttgtagcgccaaatcgaatgaatattgatgaattcaaatttgataatgatgattatatgtgttcaaatgatttgaaacaattaattgacgcaaatcatttaaatcctgattttgaaggttatgaaagtcattataatttgcgtcatatctttggttcatcttcaatcaaagattctgtttataataatccacgaacttggtatggtcaaaacttcttggggaatccatctgaagatccacaaaatcaagaacttccattcatttgtgaagccagtcgaaaaattactgttgaagatgttaaatttgttttatcaagtcattttgaaaatacaaaatatgatccttacggcagcacaaatagtccagaagaaagaaaacttttccgtccaatcggaataaatcgtaatcatagtgttcatattttgcaagttagaaataatgttcctgatgaattagcaggagttcaatggcttgcttttggagcaaacactttcaatcatgttgtaccattctacactgcaattaatgatacgccagcttcttatcgtgatgctaagggagaatatgatccaacaaatatgtactggttgagcgcaacaacagctgttcttggtgattctaattatgatttatttgttgatttacgaaatacttttgaattaaataccatggcaaaattccatgaaattcaaaatgagacagataagaattttgaaacagctgaagataaaattgcttatttgactcaagcaaatgaaaaattagcagaggtggcgtttaaagcacaaacggaacttttgggacgtatggtcgttcttggttcagctaatatgaaattgcgttttgattttaatgactaatttattttaaaaaaaattgtaaaaaagtagttgaaaagctactttttttagttttctttaaagtacaaaatggtataatactaaataagtctcaaaaatagaaaagggaaagaaatgaattctagaaaaagtaaaaaagtgagaaaaggccgaggaggtaaaatttttgcgattttattatccattgttatattttttgctttaattatttttggagtagtcatgattggtcggcaagtcatttcaagtcaaacggataatattgctgctaaatttttaccaagctcaggaagctcagaaggcgcagatagtgtgactgatgcagtgagtcaaatgggatcggcaacatcatcagctattgccacaaaattaaatgaaaatgcagatgtaattaagagtcaatcgcaaggaatgataagttcagcaaaagcaacgagcactggctctaaagtgacttacaccttggaatcctctaaactcaataaagcaaccgttggcgcccttttattagcaagtggtgaccaagttgaagaagtagcggataaggtgttagattcaatgaaaaaagctggggttgctcaacctaaattgcaagttgatttgactgatgataaggggaatgtcatcaaaacgttgaattatagtgcttaaaattggattttacaataaaaacaacatttattcagttaaatgttgttttttggaatcttaagtgatagaatattctaataattacttaattaggaggaaaattatgaatatctcagaagaagtacgtcccggagccaatagatatgtgagtggtcaaggaattttgcaagatttagaaagctatcttgcgtcttttaataaacttgcgataattactggggaaaaatcttttcaggtttttcaagatttttatcctaaagacttaagttatcctgtttttcattatgatggctcggcctctatcgaaaatgggaaaaaactggccaaagaaattggtcaatccgatggccttcttgcaattggcggagggcgtttgattgatacctgtaaagttgtagcacaggagctaaactgtgagttaattattattccgaccttggtttctaattgtgctccttacacaccggttgcagctctttatcaccctgaccatacttttgataaagtgggttatttaaataaagtgagctatttaactttagttgattatgattttttattggcaacacctcatgattattttgttgctggaatcggggatacactcgccaaatggtatgaaatggaaggaatcgttcgtcaggtttcacaggaagaacttacagcctcagttcgtttgggatttgcgagtgcaaaggaaatttttaaaatattatttgctgattctaaagcagcacttaatgatttggctgaacagaaagtgacgccagcttttgggcgaattgttgatacaatcattgaactttcaggaacagttggaggttttgctgggacttatggacggatgtcaggggctcatgcgcttcataatggcctatcactttgctcagagacacatcctattttacatggctcaaaagtcgcttatggagtcttggtacaattggcttatacgggagatacttcagaaattgaaaaactcttgccattttataaggaaaatcatttacctgcttctctagcagaaattaatttgccatttgatttggaaaaattgcaagcagtagcaaaatttgcagccagtcctgtagaatcttatcgtttgattgattcaaaagttactgacgaaaaaatcataagtgccatcaaagccttagaagctcttgtcagtaaaaataaggcttgacattctgtcattgaatctaaaagttactgacagaaattttgaaaaatagaatcaaagtttcaaggtcaaaaatgaaataaggaaaaaggaatgacgataagtttacaacaactcaaatattttattgaagtagcaagagtgggttcaattaatcaagctgctgaaattctttttattacacaaccttcattgtcgaaggcgattaaagacattgaagcggaagttgatttgtcgctttttcaacggtcaagtaaaggaatttcgctgacagcagatggtgcagagtttttgggatatgcacgacaagttgtagaacaatctgatttattggaaacacggtggttggaccgaaagccctctcgaaaactttgtgcgatttcgacccagcattatgcttttgcggtgaatgcctttgtcaatatggtcaaaaaaacagaaagtcaggggattggagaatacgaatatactctgcgagaagctagaacttatgaaattattgaagatgtaaagtcactgcgcagtgagttaggaattctttataaaaattcatacaatgcaaatgttatggataagattttaaaagaaaatcgattaacttttcatccgcttttcttggcggagccgcatatctttgtcagttcaacaaatcctttagctcataaaaaatttgtaacattagaagatttagaagaatttccccgcctatcctatgaacaaggagaacacaattctttctatttttcagaagaaattttatctacggtttatgctaaaaaagacattaaagtaggagaccgagccaccattttcaatttgatgattggattaaatggatatacaatttcaactggaattgtcagtcaagacttgaatggtgacaatattgtagccattcccttagcagtggaagataatattgagattggttggatctcactaagtgaacttcaattgaccaatcaggctgaactttatttaaaagaattggaaaaaattgtacatccttttgatgttcgtgaaggtaaaaaaaatactgacagaaataagtagtttactatccagcttttttatcagtaaaaaattaaagccgtcattactgacaggcttttttgtggtataatcaaaggtaatataagagaaattaggacgaaaaatggcagacttcatcgcacaaaatttaagtaaatcagttggagaaaaaacggttttcaacaaaatcaattttatcattcatgatcttgaccgaattggtcttttgggagttaatggtacgggtaaaacaacgctcctaaatgttatttcaggactttcaggatttgatggagaccgcacgccctttgatcatccacaaaattataaaattacataccttactcaggaacctgattttaatccaaaagctacaattttagacaccgtcttagatgattcgcttccgcaaatgcgagcaattaaaaattacgaagcagcccttttagattatgaaaatttatttaagttagaacgtgcccaatcagaaatggatgctttgaatgcttggcaagtagaagcagatgtcaaaacaattttgactaaacttcaacttcctgaccctgccactctaatcgaaagcctttcaggtggacaaaaaagacgggttcaattggctcaagctttagtcaatgattccgatttattattacttgatgaaccaaccaaccacctcgatgttgaaaccatcgcttggttgcaacattatctaaaaaattctcgaagaaccgttctttttgtcacgcacgaccgctatttcttagataatgttgcaacacgaatttttgaacttgaagatgcggggcttaaagaataccaaggaaattatcaagattatcttgcaaaaaaagctgaagatgaagaaagagaagccgcagcaagtcacaaggcaaaacaactttatcaatctgaattaacttggattcgtaaatcacctcaagcgcgtgctacaaaacaacaagcacggattgaccgctttgaagaccttaaagattctatgaaaactagtaaaaatctaggagatttagaactcaacattgcgagcagtcgcttaggaaagaaagtaattaattttaaaaatgccgctttttcttatcctgaccgacaaatttttaaagattttgaattaatcgttcaagggcattcgcgcttggggattgttggtgataatggcgtcggaaaatcaaccttactcaatatcattgatggtgagctagcattaactgacgggattttggaaattggtgaaacagtaaaaattggatatttcagtcaagaaattcgaggacttgatgaaaataaacgcatgattaactttcttgaagaagttgcatctgctgcacataacagcagcggtgaaaatatttcaattgttaatttattagagcagtttctattcccaagaagtagtcatggaacactgatttctaaactttcaggtggtgagaaaaaacgactctatttacttaaaattttattattacaacccaatgtgcttttgcttgacgaaccaaccaatgacttggatattgcaaccttaaccgtacttgaaaatttcctaggctcttttccgggtgctgttttgacagtttctcatgaccgctatttccaagataaagtgagcaacgaattacttgcctttgaagatgggcaaattaatcattattttggggcttacagtgactatttagccgtcaaaatggaagaaaaatctgctgacaaagctgtcagtaaaattgaaagtccaataagtactgacaaaactgaaaatactgacaaaacgaaactgacctatatggaaaagaaagaatgggaaaccattgaaagtcaaattgctgaaatcgaagagcgaatttctgagattgacacagaaatgaatgaaaatggttcaaatacagaactcctactgaacttacaaaaagaattagacaacaaaacaaaagaacttgaagaaaaatatgaacgttgggaatatctatcagaaagggccgactaaaacattatgacaacgcaagaacttattgaaaccttacaaaaatttccggcagaagcaactgtaaaaatcattcaaaacgatatcagtggtgaccgcttttttgatgttaatacagtagaaaatctggccagagtccgtgttaccactgaaggagttgaaaccgtagataccgtgattattggtatttaaacccagagacgaaagaaggatccaaatgttaaaaatcggaattatgggtgccgctaaaattgttccaagatttgtagcaggtgtaaaagagagtggtcaagctgaagttattgggattgccgccagaaataaggaaaaagcacaaaaagccgctttggaattagaaattccacaagtttatgatgattatgcaagcttagtaaatgcagcagaaattgatttaatctatattccactcatcaataaacaacattatcctcaagcaaaaatggctttagaagcaggtaaaaatgtacttctagaaaaaccatttaccttgactcttgaagaaagtcaggaattattcaagatagcaaatgaaaaaaatctttttttgatggaagctcaaaaatctgttttcctacctgtgatggcccaaatcaaaaaatggcttgataacaatgaaattggtaaaatatctcgtcttgcaataaatgatttcagaccccataccaaccgggagagctgggccttagacttaaaagaaggcggtggcgcttttatcatgcatgccagctatccactctctgtcttacaattcttatttggaacaggttttgatgcagcaaaaggaatttattggtcttctgaagaaaataaagcagatttagattacgaaattctcttaaaaaaagcagaaattatgattaatatttcacttagcacgcgcttagataaaccaaatacatttatcatttacggtgaaaaaggagaaatttcagttccaaattattggaaatcaaaccaagccagtcttattaaaaatgatggaacggttgaaaaattttctcatccaatgccaagtgaattcagctatgagattgatgaaattgctgaactgatcaataagggcaagaaaaaaagtgaaaaactttccccagaaatgacaatgacgacagtcaaaattgtggaagacctataccaagaatggtttggtaaagagtggccaaatataaaataaaaacactagttatctagtgttttttcttaaaaatttaaatttccctttaaaacgttgtaaggctaaataacgttcacgtgctttgtgcatcgcttggtaacgtttaggatcttttttatagtattgttgatgatattcttcagctggccaaaaagtttttgcctcttcaatcggaacaacaattggtttatcccaaattccagatttctctaaggcaattttacttttttgagcagcaattctttgttcttcactttcaacaaaaatcactggacgataatttgcacctcggtcataaatttgtccgtcagcatcagtggggtcaatcaatgaccaataaatatctaatagttcatcataagaaatcaattcattatcaaataaaatttcaactgcttccgtatggccagaagcttttgagaggacttggtcataagtagggtattcgatatgtccaccagtataaccactagttacagccaaaatacctggacgttcttcaaaaggttcaaccatacaccaaaaacaaccaccagcaaaaatagctcgttctgtactcattttacacctccatttgctctaatttaattatatcatgtgaaaaaaatgccacctcatcatttgactcgaactttaaaaattttgaatttgccttttttgtgatagaatagttaaaaatagaaaaggggaacgattttttaatgctaaaaacaacttttgcaaatgcggaattcgctaatccattcatgaacgcttcaggagtccattgtatgacaactgaggatttagaagaattaaaagcctctcaagcaggggcctatatcaccaaaagttctacattagaaaaaagagaaggtaatccactcccacgttatgttgacttagaattaggctcaattaattctatgggtctgcctaacctaggttttgattactacttagattatgttttaaaaaatcaaaaagaaaaggttcaagaagcgccaatcttcttttccattgctggtatgagcgcagccgaaaatatcgctatgcttaagaaaattcaagaaagtaatttttcaggaattacagaattgaacctttcttgtccaaatgtccctgggaaaccacagcttgcttatgattttgaagccactgaaaaactcctaaaagaagtttttaccttcttcacaaagcctttaggtgtaaaacttcctccttattttgacctcgttcattttgatatcatggcagaaatcctcaatcaatttccgttgacttatgttaactcagtcaatagtattgggaatggactttttattgattcagaagcagaaagcgtagttattaagcctaaagacggttttggtggaattggtggagcatacatcaaaccaacagcgcttgcaaatgttcgtgctttctatactcgactcaaacctgaaattcaaatcattggaacaggtggtattgaaacaggacaagatgcctttgaacacctcttatgtggagctacaatgcttcaaattggtacagctttacacaaagaaggccctgcaatctttgatagaattattaaagaattaaaagaaattatggataaaaaaggctatcaatcaattgctgatttccatggaaaattaaaatcattataaaaaattatcataaaaagctgaatttaaacagcttttttcttatcttataaaagaaatttaaaaattactaaaagagatgatataatgtaaaagattaaacaaacaaggagaaatatatggaaatttttatgacttttatcgtttattcttttattggttggatatgggagaccttttattgctcatttaaagaccggcattttgtttttagaggttttttattaggcccttattgccctgtttatggttttggcgtttctgccgtcttacttttagttccagataccggaaatttattcagtctttatcttaatacgattgtgattgtgacagtcgttgaattcattggaagttggattttagagaaattctttaatatgaagttatgggactactcaactctccctttcaatattgaaggaagagtagctgttcccgtttcattattttggggtgtaggttgtattatcttaattaaattagttaatccacctgttcaaaattggattcatgattttaatgaattaacccacagttggggtgtgattttgatattaattatctttctggctgaccttgtttcaacatttatttttacgatttcaaccaaaaaagaagtcttggctacgattgatgattctgacaaagaaaatgcagcaatcaaagaatttcgtcttaaacatctctttgcaaaccatgaaacagcagcaaatcggataaaagtattagaattacttaaaaataaacctctaaaattaaaacattataatttgcgcagaattctcaaaaactatccaaatatgaatttgaccaaaaaacgataatttaaaaatcgtaagcgtttttagtagccttagaaataaattcgtggcataatgaggtcatgaataaaacatttgaaaaagaagaaattttaaatgaactctataatcttatattagaccgaaatattcgtgaatgggaacgccagtgtttacttcatacgaaagatcaattagaaaatcaaggtcaacttgcagatgagttagcaaaattagaagtgaccttaagaccactggcattacgctataatcttacaccaaaggtcgctgaattttatcaaaaaatttccaacagcaaactctttggtcgaggagttggtggcattatataagcccttagttctccttatgctttaaaagcataaggagtttttaaaaaagtattttaaaaaaagtaaaattcattttataataaattcaataaaagaaaaggaagtaaaaaaatgaaatcagcttattttgtcgaaaaaaataaaatggaagttagagaatttcccaaagcgcaacttgtaaaagaaacagatgctatcataaaaattgttcgtgcctgcgtatgtggttccgatttatggtggttccgtgggatttctgaacgtcagcctggaccggtagggcatgaagctattggtctgattgaagaagtaggcaccggagttaaaaactttaaagtaggagattttgtcattgttccctttacgcacggttgtggacactgtccaatttgtttggcaggctttgaagccaattgtccaaatgcaaaagatggtgtgaatggcggctatcaaggagaattctatcgggcgattaatgctgatggtgcacttgtcaaaatcccgggtcaaccaagtgattattctgatgaccagttggcttcattgacgactttagctgatgtcatgcctacaggttttcatgcagccaaagcagcagatgtccatgaaggtgatacggtggttatctttggtgatggagcagttggactttgtgcagtgatttcagctaaacttttaggagcaaaacggattattgcaatgagtcgccatgaagaccgtgcagcacttgcgcgtgactttggtgcaacagatattattgctgaacgtggtgaagtagcgattcaaaaaattatggacttaaccgatggttatggtgctgacgctgccttagaatgtgtcggaacaaaacaagcaattgaatctgcttttcaagcggtaagagcaggcgggcgagtaggtcgtgtgggagttcctcatgatgttaattataatgaatggattgattctctcttttggaaaaatattcaacttggaggtggagtagcctctgtcgcacgctgggataaggaaatcttactcgaagcagttttaagtggagagattaatccaggccgtgtctttacagcagaatttatcttagatgaaattcaagaagcatacgaagcaatggatcaacgtacagcaattaaatctctattgagaatttcagagggataaataagaaaatagtaaataaatcaaaagtctaccaaagttggtgggcttttttgtattctaaaagtcttgtttttaaattaagttaaaacagagacttctatatcattctcttggttatttgcatcatctggatatacaattggtttaagaagttcgaccatatagcctttgagttgttcgagacttggtttattatcagaatagttcataccatccgttgtataagtaatttttatgtctcctttagttgcttctggataagataaaaatttgaaccaagattttcctgatgaatcctggtttataaaggacattttccatttatcaattcttccattaaatactatcagtgtctgtttattatatacaaccttattcttcgttaaatcaacagttgtaggttcaacaaaatgattataaaagtcagaacccaaagtataatagtctgatccatctgcagaaacctgcagactcttactcgaaactgaaccttgagcgtatacttttccaactccaaatactgctattattgatgtaaataacaataatataaataagtttctgattaatttttttgtcatcatcttctccattttggcttttttaatcataataaataaactccataaaatctgtaaaatattttttcactaaaagtaatgcttctcttaattttgagattgctccttttttaactcttgcaacatccaaatttgcgaaaacttacatatttcaagtttttgatttttatcaagatttttaaaaaggaactcagcaaaatttgctttttcctgtttttttgagtaaatactatccattcccaataaatatcttggtgttacatcaaaatactctgctaattctaataaacgaatggctgaaggaatcgtttgtgttttataattgcttagggcattgcgagaatatcctaattctttttcaatttgattgaacgactttcctaactcatttgctagttttttaattcttttataaaatatactttcttccatcatatttcctttcaaaatatcagaaccttattttcagaaaaattaagatttttccgaaagtactgtgattattctgttataatcacttatggaaaattcactaatactaacatttactaaaacagtatgtaaaatacagcatttaaaataacatactttagtaaataaaagtcatgatataagaacgttaaagaattataagtggcttattaagtgtttgtcggcataaaaagactccgaaaaatcttaatttttcggagtctttttatagtattttacaaagcatcatggtgtttaaacaacagactgtttatatacctactttatcagactttctttttaaattataaaaatattacattagttacatgtactctttattatacatttttttattatttttgccaacatgttttttatatacattaattccgtcaaaacacctttattccgtttcatgtcccaatccactatttttttcgatagaaatttcgaaaactgtcaatacttcactagtatttttgtaggttctttgaaagtgttctataggataatccccaccaatatatttctcacaaaccaaggccattgattttcttttagtgatttcatctattatttccttaggttttccgtgaattataatcgatttataatgcaaagtaaaattatccttatccaattttattgcatcaacaatatttaatgatactttcacattcttttggagatatttaacaacattctttttactgaagtatggagatatataacgtttttttccttatcccaaacatacatcatcggaatcgtttctacctctttatccaagttaagaagtcctaaaactaaataagtaccatttaaaagcgtatattccaagtcactttggtttaatttgtaactcatttgatacccctttcttttctttatactactgtcagtatatgcttatttttaaaagtttacaaccgaaaaagtattttaaaaatctttcaatagagctttaataatgaaaaattatctacaaaaaaactataaattattatgatttatagtttttctttttttacgttattaatcacttttttcacttaattgattgtaaatttcaagattaacttttaatacattgactgttttttcacctagaaatcctaaagttttattttgagtatttttatcaataatttttttcaaattatctacgcttatacctgtagacttcgaaatttgaggaatttgaatcagggcactctgttggctaatgctaggatcaaggcctgaacctgatgatgtcaataaatccgtaggaatatctttcttatttatgctcggattattatttagaaagttttttaattcactctctacacgtttttttagtaagggattactaggtgataaattttgagaacctgaagccactcccaaatatttaccctcagatttttcttttgcagtataagtattataattaacagctgaaggacgtcccttcatgaattcttgatcagaaaactgttgaccaattaattcagatcctatcactttccccttattaacgataagactaccattagcctgatagggaaagatactttgtcccagacctgttatgagcaatggatagaaaagaccacaaatcactgtaaaaaccactgtaactagaaaaggtgtttttaattctttaaatatttttctcatcacttctccttttagcattaaagaccaatcatgtgcaataatggagcaatgattaagtcaataatttttattccaatgaatggggcaataactccccctaaaccataaactaacatattatgtgtcagcaatttatccgaatgctgtggtttatattttacgcccttcattgctagagggattaaaagtggaatgattattgcattaaaaattaatgctgataatattgcactggaaggcgttgcaagattcatgatatttaaaacatgaatttgtggaatagcaagcataaacattgcgggaataatcgcaaaatatttggcgatatcattggcaatagaaaatgttgttagtgctcctcttgtaattaaaagttgtttaccaatctctacaatatcaagaattttagtaggatcactgtctaaatctaccatatttgctgcttctttggccgcacttgtccctgaattcattgcaataccaacgtcagcttgtgctagtgctggtgcatcattagttccatcccctgtcattgcaacaacttttccatcgttttgttcaacttttattgctttgattttatcttctggtttacattcagcgatataactatcaaccccagcttcttgagcaatcgttgcggccgtcaaaggattatcaccagtacacataattgttttaattcccatttcacgtaaacgagcaaaccgttctaccaatcctggctttattgtatcttttaaatagataactcccagaatctttgaatcttctgaaactaccaatggggtgccgcctaccgaagatatttcatcggtaattctcttcaaatcattaggaactccccctccttgttgttgaatataatcaatcacagcatctgttgctcctttgcgaattgtctttcctgtcggaaaatcaactccactcattcttgtttgagctgtgaactctacaaaagtcatttcagctggagtcataaagtccttatcttcttgttcttctgctaatctaataatagacttgccttctggtgtttcatctttcaatgaagttaaaacagcattttctgtcaattcttctaaagaaacaccgtttactggaagaaattttgcggccattctattaccaaatgtaattgttcccgttttatctaaaatcatagtatccacatcaccactggcttcaactgctttaccagacattgcaatcacattaaaacgtgtcactctatccattccagcgatcccaattgccgatagtaagccaccaattgttgttggaattaagcagaccgttaaagcaatgagtgtcgttacacttaacttcacatgaacaaaagaagcaatggggtagagtgtcacaataactattaagaaaataatagttaaactcacaagtagagtatttaatgctatttcattcggcgtttttttccgtgaggctccttcaacaagagaaatcattttatcaagaaatgattctcctgaactagaagtgatttttatcttgagccagtcgcttgaaacagttgttcctcctgttactgaggcaaagtcaccaccagattcttttacaacaggagcagattctcctgttattgccgattcatcgacggaagcaattccttcaatcacttctccatcacttggtatcaattctcctgctttaactagaactatatcatctttttttaactcaattgcatcaataatagtttccttaatctgattagtagctttatctttattaataattcttgctttcatatttttttgcgtttttttcaagctctctgcctgagcttttcctctgccttcagcgacagattctgcaaaattagcaaaaagaattgttaagaataagattaaagtcacaattatattataaatttgacttgacgattgaactgtcccaaataagttaggaaaaatagatagaattaatgtaatagtaaatccaacctcaacgacaaacatgactggatttttcatcatatatgctggattaagtttgataaaagctcctttgatagaactttttataatctcttgattcaatagttttttatttttagaaatcatcataagcctcataatgttaaagattcagcgattggtccaagaaccaaaactggtaaaaatgttaatgctgatattacaatcactattacaagtagaacgacggtgaaagttccactatctgttttaagtgaacctacagaattatttaccgaccttttcatcattaatgatgaagcaatcgcaagttgaataattaaagtgagatatcggcctaaaaatatagcaactccagtcgtaatattccaaaaagcggtattatcttttaacccctcaaaacccgaaccgttgttcgccgccgaagatgtatactgataaacaatttgcgataaaccgtgaaagccaggattggatactccagcaatacccgcggaaacagaaacggctagtgccgtaaaacttaaaataattaaagggtgaatgataattgctagagcagtcaatttcatttcttttccttcaatttttttccctaagtaaacaggagttcgacctatcattaaaccacagatgaatactgtcaaaagaacgtagagaatcatattcattaatccaacgccttttcctccaaaaacaagattaagcatcatattaatcatggcaataccaccacttaatggtgtcagactatcatgcatgttatttacagaacctgttgtgaaagcagtagtaatttcggtaaagaaagctgacatatttgtgccaaatctagtttctttcccttccatgttacccatagcttgacttaagcctaggtgctgtaaaataggattccctttggactcagcccaaataattattgtaagcccgattaaaaataaaacactcatcacgataaataatggtcgagcctcttttcctaagaaaagtcttcttttactttttaatttagaatttaataatttattttcttgatgactatctgaaaccatatatccaaacgcaaataatatcgaaccaggtaataacatcattgatagcatttcaattatatttgtaataatatttggattttcaaaaggcattgctgaatttgctgcaaaaaagccaccaccatttgttcccaaatgtttgatgatttcaagtgctgccactgggcctagagcaatatcttgcattttcccttcaagggttgtaattgttaaattatgtactaatgtctgaggaatgccttgtgatatcaataataaagcgccaataatagaaaatggaagtaatacacgagtaattactcgtacaaaatcataatagaaatttcccatatctttgtattttccagacagtcctcgaatgaaagccattgaggctgcaaaaccagaagctgctgatgtaaacatcataaaggtaatgacaatcatttgactcatataggaaagggcagactccccagaatagttttgtaagttagtattagtgataaatgaaattacagtattaaaacttagactttgctccattgccccaatgtggttaggatttagaaagggaatttcttgaattctcaaaattaaataaccaataaacaccattacagcatttgttaatactagagatagcgcgtattttttccaagtcattggctgttttttcatagcaatcaatttatatataaagccatcaaatttatccatgaccggatctgcaaaggtcttttgatctgtcgctatgtgataaaggtatttacctgtaggtatcattaataatatggccactgccaatacgaaaataatttgtaacatctgttccccctaaaatttctctggataaatcagagcataaaagagataaatcgccaataacatgataataatccctaaaataataaacattttaaaaacttctttctaattttctttaatttgcttgtcacaccaagctattagagccagaattagtagaaaacttactactagtcctccaagcatcaataaatccatcaaaatattttcctcctccttgatgttgaaattattttaacacttgaaaaataaaaagagtgtaaagatttgattattcgtataaagataatctaaagattttcataaaaaaagtactgacgaatctgtcagtactttttagtcaatttttatcattcgatagccgacaccaatatgtgtctgtatcatctttggataattggaatcaagttcaatcttcttacgtagcgtatttgcaaatactctaagtgctgaaaaatcttcctcataatacccccaaatttctttgacaagatagttgtaggtcatcacacggtccaaattttctgctaataaacaaagaagtttgtactcaatcggtgtgagatgtatctctttttcatttacgaaaacacactttgataaataatttattttcaaccagccattagtaaaagttgttacttctgtcagtaaattttgattatttccagaaaacttagctcttctcaaacttaccctaagtcgagccaaaagttcatcagtactaaatggttttgtcaaataatcatccgcaccagcatctaaagctgctattttatcagcatcttctcctctggcgctgactacgataattggaagttgagagaatccacgaactttagaaataatctcttttccgtccatatccggtaagcctaaatctaaaattagtaaatctgggcgctgagagataatctctcttaacgcttccttaccattttgaacagctacataattataatcttcaacctccattgtcaaagataagagtttattaattgacaaatcatcttcacaaatcaatatttttatatcatcattgttcatcagaaattaaaacctcctctaaaggtaatttgaaaccaaaaatggctccatttggctgattatctttaacataaatttgtcctccatgtgctaaaataatacttttacacaaagaaagtcctaaacctaaaccacgcttagaatcaacttgccgattttcgtcagtataaaataaatcaaatattttttctttggctttatcagtaatgccaggcccattatcagaaacttcaagaactaactcatcattaatttttttggtttgtagttctattttagaattaattggtgtatatttcaccgcattattaatcaagttaacaatcacttgtatcataagagccacatccatttttgccattaagagttcatctgctaaatttaaactaaattcatgctgttccaaatgcctgtctacatgtttaagtgcttcttcaactacttcatcaataatatttgcttccaactttaattctattttttcatccaatcttgtgatagataaaagattttcaactaaattaatcaaccacattgaatcatcatagatataagctgataattcttgaatttgaagtttgtttattgtgctatcatttttcatcagtaattttgcatgtccagaaatactagtaagtggagttcttaaatcatgtgaaatagcacgtaacaaatttacacgtaactgttcttgctcaatttgaatttcgtttttttgttggacttctcgaagaatttctttttccaaagctaatcctgcttcacctaatatagccagaattatagatttttcaaatgtttccaactcatttttgtccttcattaggataccgattaccgcaaaagattgatctttcccacgaattgacaaatataagtaattagcagctgataatgtattggtcgttgctcctgcacgtttattattgtgcattacccactcagctacacctctctcattaaaattctggtatttttctaaattatacttagaagactcagttgaaaaatatgattcatctcctaaaactttatctttgattggataaatcacaatatctcgatcaagtaatttttttaactgttgaacagttccttctagaatttctgctaccgaatcaacctgtgctaaatctttatttgtttgtaaaagtacttctgttcgatatgatttttccgcagaaactcgaacttgttcttgaattcttttgattaatgttgacgtaattaatccagcagccaacataattaagaaagtaattggataattagagctaaaggctacaaaagtgtaataaggttctgtgaaaaaataattaaagcaaagtacagataagactgaggaaatgagactaaaaattcttccttttgtaaaaatagcattaatctgaactcctaaaatataaagcataattatattagcaacattaaagttccagtatttgaaggctaaaccacatgaagtgacaataactagcatcagtattgttttcaataaatcacttaatgaaaaccggatttttttaaaattatacaaagttccagaagtatttttttgttgtccccttgcatttggaatgacatagatatcaagttctggcgcttcctgacttataagatctacaatattttccctactccaaaatgcactttgtacacttttaccaattaccagctttgacatttgactaattttagcatattcaacaatttgcttagaaatattatctccataaaggacagatagttttgcgcctaactgttcagccaaacgtaaattctgtctcagtctatctttttcttctttggaagaattttctaaatcaccgatatataatgccgtaaattctgctttaaatgcaactgcaagtctcgcagctgcatgaataacatgagaggctgagggtgaagctgaaacacatactaaaacatgttcttttgcataaatactttttttattttgagctttacgaatagcgctcttattgacttggtcagcagtttttcgtaaagcaatttcccgaagggcgataagtttttctaatgtaaaaaaattttcttttgctcgatttactttgtttaactgataaatttttcctttatctagtcgttctaataaatcaacgggttcgatatcaattagctcaatttgatcagcctcttcaaatatgtaatcaggaattttttcatttacaataatcccagttattttttcaattacatcatttagaccttcaagatgctgaatatttattgttgtaaaaacatctattcctgctttcaaaagttcttcaatatcttgaaatctcttcttatttcttgaaccatggcaatttgtgtgggctaattcatcaactaggataacctgaggtctacgaatcaaagcttcttctaaattgaactcttttaattgaattcctttataatttattttttttaaaggtaaggtttcgagcccttcaattaattttgaggtctctggtcgattatgaggttcaatgtagcctgaaacaacatcaattccagatttctgaacctcatgcgccccttcgagcatagcaaatgtttttccaacaccagcagcatagccaaaatatatttttagttttccctttttcattggttgcctctaaattttcttgtccatattatagcataaaaaacgtagtccattaatgacataaactttctggccttcctaattttactatcttataaaattattttttagatttccacttaactaaatcactaagcttagattgataaataaatctgtttaatttttttgatagtgcacgaaacattttggcttatgttactatttttctatagtaaattcaaaatataaagttatcgcaaacatacataatatatcatgggttttgacataaatataaatataaatataattatattttatgtatatgagtgatgttaagtacatatttattttacaatacctacatattatattaccttcaattctttcagccgataaaaaatttatctgtttatactcatcctcttttgttgttttccacatcctctaaaatgggtatttggctaatttgaagcatcctcttggagtggtaaaagggtattttattcggcaattataggcaatttttcacaaactaggagctagtttcagacaactcattgtcaatttcatttgatttatttcacgaaaaaagcccctgaacgcttaggtgttcaagggcttcttcttttatttttgttatttcacaaactgcttgattgtaatcaataaaattcttcaggcaataatttttctgctaatttaatgttatcagaatagtccaaaggaacgtcaattactactggtccagtagtatctgggattgatttaagaatttcagcaagttcttctttgctgtgtgcacggtaaccttttgctcccatcgcttcagcatattttacgtaatcaacatagccaaaatcaacggctgctgaacgaccatatttcatttcttcttggaatttaaccatatcataatggccgtcattccagataatttgaacgattggaagattcaaacgtacagctgtttccaactcttgccctgtgaaaaggaagccgccatcaccagagtgtgaataaacttttttacctgggcgcaacaatgcggctgtaattgcccaagggagagcaactccgagtgtttgcattccatttgagaagaggaggtgacgtggttcgtatgatttgaaatgacgtgccatccaaatgtagagtgaacctacgtcaacggttactgtttcatcatctttgacgatttcttggaaagtgctgaccaaatcaagagggtgcattctaccttcttcagtattttcagtatcaaattcgtgttgctcagcaacttcatgaaggccatcgagataatcttttgttccttttggaattttgtatccacgaacagctggtaaaagattatccaatgttgctgcgatatcaccaattaattcacgttctggttggtagtaagtatcaatttcagcaatggcattatcaataacaataattcgactatcaatttctgcattccagttacgagcttcatattcaattgggtcgtaaccaacagcaataacaaggtcagaacgcttcagaagcatatctcctggttgatttcggaaaagaccgatacgtccataaaaagtatgttctaaatcatgtgaaataacccctgcaccttggaatgtttcaacgacaggaatattaacatgagttaatagattacgcaatgatgaagcgactttagcatctgaagcaccagctccaaccaaaattactggcaatacagcatttttaattgcttgtgctaaatagttaatgtcatcaatagaggcattccccattttagggtctgaaagtggttgaatggccttgattgatacttcggcatccgttacatcttgggggattgacaagaaagttgcacctggatgtcctgattttgcaatacgataagcattggcaattgattcagaaagtgtatcagggtcaagaacttctgctgaatattttgttgctgattgcatcattccagcattatccattgattgatgtgcacgtttaagacggtcacttcgtttaacttggccaccgatagccaaaatagcatcaccttctgatgtcgcagtcaaaagcggagtcgcaaggtttgatacaccaggcccacttgtaacaactactacaccaggttcgccagttaaacgaccaacagcttgagccatgaaagcagctccttgctcatgacgagtcacgaccattcgagggccttcttcattttctaataaatcaaaaatccggtcaatttttgctcctggaatcccaaatacatacttcactttatggttaatcaaactatcgacaaccaagttcgccccaaattgtttctcagacattttttattttacctcaatttgttctaattcatatttcataatctcttggattacttcacaatcattttatcagataatagaaccttttacaattattttgacgcaagtttgtgaattttctagcttacaataaaaataattactgacagctttgtcagtaattattttttaagtctgtcagtaaatttctcatattttcatcatccggaacaagttccaaatattgttcaataattggttctgttttagaaatttgaccaatttctttaagaaaatcaatatagtcttctaaaaactctggattctctgacagattggtttgaatgagttcttcatacaaagcagccgcttcagaatcattttccaaagctttatgtgctcctgcaaaaagccatttagctaataaatgttcatcttctaaaagctcttcgagattaatgacggcttcaaaatcttcttcgttgaagtataaattagcaagcaaaaagactgtttcgtcatgtaattctggtaaatttaaagcatccatgagataacgttccgctgcagctttgtccttaagtttgaaactaatttttgaagcgaagtgtaagagaggaacggcattaggattttttttcatccctttctttgccatttctagtgcagcttcaaattcttgattagcttctagggtttgggcataggctaattcatagttcaaaaattcgacatccattttttctaaccgtttgaaattagcaatggctcttgtttcattatgagtttctccataaagtagagcaattttatacaaggtttctggtttttcatcaaattcaagtgatttttcaagaaatgatatggcattctcaaaattacctaattgggcataagagtcaccaattctttgataaatagaaatttttgtttcatgtaaaattttgcgttctgaaagttttgcatattcggtaatggcagctgaataatcaccttgttcaaagtaggactcagccaaagcaaaagtaatcagaggagaatccgataattctcttgcttcttctaatttagaaattgctgtttcaaaatcaccttcaaattgatataagtcagcaattttgactaaagcagcaatataattttcatcattcaccgggatttgataaaggtaatttaatgcttcatccaaattaccattatcttctgcaatttctgctaagttaatcaggtaatcagttgtttccggatcttctgacataatttggtcataaattttttgactttcatcaatgaaacccatcatttgcaaatattcggctaggtcagccaacatttcactattatcattttttaatgctttggcaagtgaattttgcattccaatcagatctccctgatgtaagaaatcaattgtatcttctgaataagacatttttctccttatttttttattctattaattacttatttgcttcttctgtagccgtttcttcacgataaagaactgaaatttcacggtaccattcgtaaacatggacaataataactttcaaagttgcatagaatggaatagcaagtaatactccccagacacccagaatttgacccgctgtcagtaaaacaaataaaattgtaattggatgaattgacatttgttttccaagaactaaaggagaaataaatcttccttcaagtgtttgctcaataataaggacaatgattacttttacaagcatcaaaggtccaccaattgctaaaccaacaattaccattggaatagcagctaaaaatgagcctaaaaatggaactaaattcaaaaatcctgcggtgattgctaaagcaactgcataacgcaaaccaataataggtaaaccaatcataaacatgatagcaaccgcaattgcgaccaaaacttggccacggacataatttgaaagctgactattaatttcgtgcaaaacttttgaagtttctttacgccaatcatttggcaataaatgagtgacaaatccatttaatctttgaccatctctcaataagtaaaaaagaacaaatgggaatacaattaatgaaattaagatacttgtggttttactgatgagatgtgaaagggtcgtaacagcattaacagagaaagcttttgaccaatcaatcaattgattaccaattgacttagcaaactggtcaacctgtggtcgaaattgttcaaaatgtggattttttgctaaagcattaatctctttttgagcagtatttacatagtgagggactgacgaagcaaaattatctactccactgatgatattaggaatagcaacaattaagccccaagcaatcaaagctgcaattattaagaaaagaacaataattgtcagaacccgcggtactcttttcttttccaaaaaatcaacaattgggttaagaagataataaaatacagctgccaaaataacgggcagcgagataaccgttataaattctcctacaggtttaaaaataaatccaactttattgagtaagagaatattcagtaataagagaaggacgattgctaaagctgcaactactttattattaataaaccacttgaaaaaccaagaggctttgaaacctcggtgttgttcttgttccatatttttttcctaattctttttttagaattactgacagatattattcaaagtcatttagtgttctgtcagtaatttttttctagttcataatattgaatctgtaaaaaaatctttttgtcagtaattttccaaccattgtgattaaaaattcttgtcagttcttttggctgatagacttttacatctccttctgttgaaaatttattaagtcgccaattatagacttttgtaataaatggaatatgaatctcagcgatgaccaatttcccctccggtgccagtagtcgtttagcttctgctaaaaaagcttcaggtgaaggaaaatgatgaaagctcgctgaacaaataatcaaatcaaaattagcatcctcaaagggaattttttgagcagagccttgcttaaaagtaaaattaggatgcttaacttgagcaatttttatcatttctgacgaaatatctaagccacttccaaaaaatttctcttttcgatttaacattgccaaaagatttccattagcacaaccaacatctaagattcttgaatttttttcaacttttaaacgttttataataaatctcttgaaaaaactggctaaaaatccatcaaaactatgatcaaaacgacgcgcaatatggtcataaaagtcttcagattctctttcgtaatcatgagtcttttgaaccattttagtcctccatcaatggtttagcgaattctgcaatcatgctctcagcacatttcaaaccgtcaataccggctgagacaattccgccagcaaaaccagccccttcacctgaaggatagattccttttgtcgaaacagattgataattttcttcatcacgattaattctgaccggtgaagatgaacgagattcaacccctgtcattacagcatcagaaagggcaaagccatgcatttttttatctaatccaacaattgcttcacgcatagattgtgtaacatagtctgggaatagtgattcaagattagttggtttcactcccaaagcataactaggttcaactgttcccattgctttagaggcttttccatcaagaaagtctccaacaagttgagctggtgcttgataattagaaccgcctaattcaaaggctttatgttctaattccttttggaactctactccagcaagtggatggtcagttgggaaatcttctggaaaaacttggactaaaagtccagaatttgcatttttttggtctctagcatgttcagacatcccattagtcacaaggccaccttcttctgatgcagctgggacaaccagtcctcctggacacatacagaaagtataaacgccacgccctgatgatgccttataagttaagcggtattctgctgctccaagacgtggatggtcagcaaattctttatattgtgctttattgattaaagattggggatgttcaattctgactccaacagcaaagggtttagctgtaatcgttacccctttatcataaagttctgagaaagtatcacgtgccgaatgaccaatggctaaaatagcctgatttgttttaataatatttccgtcagcaagttttacagcctgtaattgttcatcttcaattaaaaattcttcaacttgagcatcaaaatgtacttccccgcccaactcaataatttgttttcggatatttttaacaatgtcacgaagtaaatcagttccgacatgaggatgtgccttataaagaatatcttctggggcaccagcttgtacaaattcttccaaaaccttacgaccacgcaaatcacgaacacgactcgttaattttccgtcagaaaaagttcccgctccaccttcaccaaattgaacattcgattttggattaagttttccttcaagccaaaacttatcaattgattttacacgctcatctacagcttggcctctttcaagaacaattggccgataaccattttgagccaataataaagctgcaaacattcctgcgggaccaaatccaatgactacaggccgatgaagcatttttttacttcctataactggattgacataatccaattcaggtgccaaagaaacattttttatttttttagacagaattcttgcttcatctttaagtttaatatcaacagtatagataaaatcaatttcgcctctatgtcttgcatcaattgattctttgtaaattcgataatccagtaagtcagattcttgtagtcttagttttttcaaaacaagacttttaaccttactgacaggttcatcaattgaaattttgatttgtgttatgcgaatcatgattttctttctatgaataggatttattatcctcttttattttttattaaaactagcaactaattcaatatgatgcgtttgtgggaataagtcaactggttgaactttatccaacaaataaccctcagcttcaaagcgaacaacatcacgagcaaaagttgctggattacaagaaatataaacaatacgtcgaggattcatcattgctgctgctttaataaagccttcatccaacccttttcttggtggatcaacaaaaatgacatcgggttttattccttctgaaagccatttaggcatgattttttcagcagttccaacctcataatgtgtattttcaagttcatttaattgagcattacgtttagcattttcaacggctgctggaacaacttccatgccatagacttttgcaactctatcagccatactaattccaattgttccaataccagagtaagcatcaataacaacatcacctggttttagacccgcaaagtcataggcagtttcataaagcttttcagcttgaggtgtgttaacttgataaaaggcaggggccgaaatttgataagttttatctagcatcaaatctgtgatgaaatctttgccgtataataaaataaattcttttcctaaaataaatgaacctgttccagaattaatatttaattgaacagattttatatttgtaaaacgttcaaccaaatgatcaatcacaagttcaaccttttctggaagttttttacttgtaacgactaaagtaatcatcatttcacccgtgtgaaatgctcgacggacaacgatatttcgcaaccaaccttttcttgttttctcatcataagcttgtagattaatctttcgaaactcatcgcgcaaaaaaagaaccacagcatcaatctcaggatgttgaatataaaaatcttccacaggaatcaaagtatgagaattctttcgataaaatcctgtagttaaaagcccgtcaatcatttggacaggaatttgtgctttatttcgataattaattgttttaattgcttcaactactggtaaaactggataatcagacttaccagctgtttttctcaaaatatctactacttgcttatgtttaaatttcacttgttcatcataagatagatgaccaaaatctgcgattcctgtgcgcaaataatcaaggttaagctgagtaacacgatgtttactctgacttataaattcatccacacgcccaaatccaaaagatttcccaaccttaagcacatgcattttgatacgttccccaggtaaagcattatccacaaagaaagggaaagagtcgattttaacaaccccttgtccttcatgtgttaagtcaaggacttctgcttcaaatatatcgtttttcttgaaatttgtcatgtccatattataacatatattatcaatcgggttctataaatgaagagtttttaatttttttgaaaaaatatactccataattccaagcttctttcacgtaaaatgtagttaaaaagtgtaatcaaattttttcaacaataaaaaagccactcacaaggtaagtagttctaatttatctaataaagaaagtgtagtctttattatgaatttacattaacgcaaaatctctattctacgctgagcacttgcatgaatgagttttactttattctctccaaaaagttttactaatctatcaaattccgcacttttagcaaatttttcattgtgctttaaattttttttaccattttttttggctttcaatgtaatataaatttcttgtcctttttcattgtgtggaacaaaattagtctgttctaaaactattttttcaatttccttttttgattttgccattgagacaatactcccttttcatttttattcaataaatatcatagcataagattccgaaaaacttaaatatttatcattttcttactatatttttaaaaaagcacttaaaaatttatgtcatttgacaaaaatgtaagcgcatgctatattcgttgttggagaatatctccattttaatttttattggaggaaaatcgtagaatgaaaaaagaagtatttttagacaaagtaaaaaatggaattattgtatcctgtcaggctttacctggtgaagctttatattctgaaaaaggtggtatcatgcctttgatggctaaagcagctgcacaagcgggagccgttggaattagggcaaattctgtaagagatattaaagaaattcaaaaaatagttgatttaccaataattggtattattaaaagagattatccaccacaaaaaccttttattactgctaccatgaaagaaatagatgagttagtagccacttcttgtgaagtcatcgccttggattgtacctctagagaacgttatgatggcctaactattaatgaatttatcaaatcaatcaaagaaaaatatccaaaccaacttttgatggcagattgttcaacctttgaagaatgtaaaaatgcatatgaagctggggtagattttgttggtacaacgcttagtggttacacagatgaaagtccaaaacaagatgaacctgattttgccttacttgaaaaactagttgaggagaagattccagtcattgcagagggaagaattcatagtccagaacaagccaaacgcgtttatgatattggtgttgatgccatggttatcgggggagcaataaccagaccttttgagattgccacacgatttataaaagcaattggtgaaaaatagtagcccattcatcggaataaaaaaaagacacctccaaaaaggatggtgtcttttttttatgcttatctctcgtttacattttctttattaacctgagatctttcccaattatcgactaatatcttcttatattgaggtctttcaatcgctgcttttgcattatactgtcttaatttggtaaatgagaatccactgattaaggctaaacctacaagaagtataacaattttctttgtttttctctttatatttttagagaataaagctctaaccataagaatcattaagatacagataattgttggtataacaaatctgaaacttttgaaaggtgcaattcctaaaaatttagttactggtgaaataaagtaagttccataaaagagtgctgtcattccgacaataacaatagctctaaagcggcttaacggacggcataagagatagagtgaaaagagttgaacactaccaataaccaaagttacatcactgataaactccttataatgagtcacaaagtgtccatcagtaaatgtcgtatagattgggaatttataggccaagctgaacattacaaatatagcaatcccaataatgattcccgtaggtagagcgttgtctctaattttttggagaatatcatcttcatttcttttttcatctttttctagcacaagtagagcactaggaattccgacggtaaagatacccatcatcattaaatttattgattctaatgggaagagatgacgtgtaattaacaatagaactgttaaggtaaagatgtatatcactcttagaagattcatactagcgacacgtgtaatattattaattacctttcttccctctttgagaatatttggaagaacagagaaatcatttttcaatagaataaattgagcaactgactttgtagcttcattaccgcttcctaaggcaattggacaatctgattttttaagggcaagaatatcattaattccatcaccaatcattcccacagtatgaccatttgcttgtaaggcagcaatgatatcacgttttctttctggagttatgcgaccgaatattgtcttttcttctaccacttcctgtagttctttttcactttcaggaagttctgatagaccaatataatccgcttctaaaccgacctcttttgcaataagtgagaccgtttttggatggtcacccgaaataattttaatctgagtcccttgtttttcaaagtattctaatatttttttagcttcttttttaggtctatcttttaagaaaataagacaaagaagttggcttttttctcccgaaacattatgagagagagcgagaattctataacctttttccaaagcttcctcaatatcagcttgttgtttaggagtgacatcttttgctactaaatcaaaagctcctaaaatataatttcctttatttttgatttctacagattgatatttagtttctgagctaaaaggttgatatgaaactaattcaaaggtattttgttgaccactagtaaaatattttgtcaaagcctccattgaggaattttgttctttatctaaggagataatatatgaaatgatatcatttgtttcagctttatcattatagtatagaacattttcaacattcatttgtccttcggtaattgttcccgttttatctaaacataaaacatcaaccctagccaatgtttcaattgctgataactcttgagtcaaaacatccatttgtgaaagtttaatgacacctaaggccaaagcaactgatgtaagcaagactaatccttcaggaattaaacttgtaatcgttgttgctgttccaacaatcgccatctttctttgaggaatcactgacaagtttaatgacgaaaagacgaactgattcagcaaaacaagaattgaaataggaataattcctattgcgataatttttaaaattttatcaatttgttgttgtatttttgattttgatttttttaaaactgaagcttcttttgtgagtttactgataaaagtatgattcccgactgcctgaacttgtgcttttgaagcaccttgcatgacaagactacctgaatagatgaaatcacccatatgtttttcaataaaatcagattctcccgtaatcatggattcatcaacatctagtccttcttccaaacatatcgcatccaccggaacctgaacaccttttttcagacaaataatatcatttaaaacaagttcttctttttcaatacttacttgttcacctgctcttatcacttctactttatcttgttttagaatagaaagtttttcaataattcttttggctttaatttcttgatagataccaattgaggtattagaaataattgagaaaataaacagcatatttttataagaaccaatgataaataacacaaccgcaagtactagattgagtaaattaaataaggtcattgagtttttaatgataatatctttatttgaattcccaactttaaccgtcatgatattcaaattcccaagtcttttttgttcttcgacttctgcatttgacagtccttcggtcatgtttactttattcaatatctgcttttcctcctaaactaatttctttaattattatatctaaaatttttcctttttttcttacatttttgaaagtatttgaaaattattttatcaaaaaagttattagaaggctaataattctaataactttttagcttttaaattatttattgattataaaagatttttttttgttcaatattgaacaaataaaaaagtcatctcatgcagtggctaaaaaaacatgcattaaaagacgtttttcaactaaatttatcttttggagattaaccctctggtctgatattaataaaaaatgctctcataagttcagcaaaccttttgacttttaatagacaatcatagccttagtgagtatgaatgatttgtagcatctattactctactcttgaacaattgactttcagttgaatataggaagaattactccaaaataaaaaccactaaaattttcaagtggtttttatttttcaatattcatgtgttttaaagaaatcaattcatccttattaagccctttatatacaggaccatttataatatcggactaagtaatctcgaaaagttttgcttgattttaagccagatagattgttgggcaatttcttcatctgtaagtagctttgattttattaagtctcgctcaaaggtcctgctcatctcttttgctacagtttcatcataacaaaaggcacttatctcgaaatttaattcataactgcgaatatcttgattagttgtaccaaatacacctaattttccatccattacaagggttttagagtgtatgaagccatttgtataattgtatattttcacaccgtgtttatgcagataatttgcgtaatattgtgttgctctaaaaataaacggatgatctggcatattgggaatcatgattcttacatcaacaccagaattcgctgctgctacaagcgccgttatcatagagtcatcaggtatcaagtaaggcgattgaagccaaatatagtcttccgcatccataatcattttaataaaacctgttcttaaggttttattatcactctctggtccgttagcgacgatttgaatatcaatgttgccttcttcttctggtaccacaaaatatgaatcttttcgttcgagcttatctttaggatctctgactgaaacattccaatctcgaataaatgtttcttgaagaccaaaagctgctgtaccaacaattctaccgtgtgtatcacgccagaagccaaactttttactgttataaatatattgatcaccaacattaaaacctccagtccaaccaatttgaccatctatcactacaattttacgatgtaaatgatagttaagtcgggtttttgttagtgtattacgcgatgtgataaaggctgtaaccttacctcctgcctcttccaaaggtttaaagaaatcctttctcgtttttcctccccatggatcgtaaactactctaacttccaccccttctttagctttttcaattagatggtcgcgaaaagcagtcccaattttgtcattaaagaatgcatagtactctacatgaatattatctttagcattctttatgtcgtcaaacaaggctgagaatttatcttctccattcagataaaaattcactttattcccacgacaaagtggtgtacgttccatattattaaaatatcttttcagtaatttttcatggggtgccatttcttttggctcaaatttttcattattttcacgcactctttgggcaagaatagacagattatatttattttcttcttcaaaacgatttgttgtcgttcgatcaagccctcttcctaaaaaaagatagccaaggaaaccaacccctggtaaaaagaacaagaacatagaccacgcaaaaatactggcaatagacctaggtttccgaaaaattgtcacaagggcaagcaatgtgttaatcgttattagtgttcccatcaaactatagattgtcgcaagtgacataaaatatttctccataatctccataaaataatattatttatctaattatatcaaaatttattggatactttatttattttatctaagcaaaatttaatgttatttttataagtattattgattcattaattcttaatgcatttgtcttatctataccatttaaataaaccaactctgaaaaaaactatctcagcctcttctttgtcacgcgcccttacagtagcaaaagaaagcctatccgcaatacacacatcttttctttcagtatcaaattttcaaaatttatctcattgattttttctcctcaaaggaaatattatatgttatcagccatgcggatgcatttcttgaacaagaactaccagtaattattttaatcattttttctcctatttttttctttttaacgtgtgatatatgattcaatcaaactgaataacatctcctaaattaattgttccatttctatctgcttgttcattttcttcagttaaccctgagttattgatataggatggaaaacttcacataagaattccaataaggtagaatccgggccatccattaagtcaaaccgagagtcattaaaaacacacccaaaattccaagcatcattgttaatgatatgttgccacatctcttcctctacgttattaaatctttcatctgttgttaccatattttctaaaggatagatccttttcaagaaatctatttctttaagtcgtccataatatggataaaagtattttttatcacttccaaaatagatctgttcaatacatctattttcaaataagtcgaaaatatcatgacgtatcaattcagtaattttcatcttttcaatcttttttatatttattctaataaaattaattgatgactttcaaatataataacaaaacagtacttcattaatactgttttattaatacttatgtagcacatttctttcaaaacataatatagcaaaatacaaaaatatttacgattaaaagttttaattattctaccggattcgttaaatttgcatgttctgcaattaattatgaaacaatatcgttcgttttcgaaaattattgtctcattgaatccgttttagtgatagttgattttgccacccaagtcccactattaaatggattttgagccattgtgtttgattttcaagataaaaatttcttgccattttactcaacttaaccgagttaacaactgctctttagagctcagtagagccgtttgtctcatttcacccaacattcacaaagataatgttagccgtatgtcaataataaagaataaattatatatcttttaaataggaaaatgtacttattaagtgcttttattatctctataaattaaaccccaaataacgagtgtttactttgctgtctttattctctgacaactcagttttgaggttttattttacataaaaaataatacaagaaaaggtacgtaacaccaaatttcaaacagaatcatcgttgtaaaaccttgttaagctattgaattgccgcttgagaattcgagctggtctaaataccaatatcataaatagaaaattccctaatccatgcatcaagtcaaagggaagaccagcaatataataaatttcaaatgatgaaatttgtaaaacaaaaacctcaaacattgagattacaattccataaattaaccccagtataaggcataatattgcttgcataattaaaaacttcataatatcaatttttataaccagccaatataaaaaaattattagagaatatgctagtaactgaccgactacccagtagcccattcctagataaacggatgttgctataatcgtcatgtcagcaataataattgcttcgctcaatccaatatttaaacaaatgagtaagtagattgttgttaaaggagtaatatttggcagatatgaaaatggaaaacgaattacggagcacagtgctattgtcatcgcaattagcgtaagcttacgaactgtcaatttagtatttttccaaataaaatctgattttttcaccatttattattttaacgccccccgcgccaatcactgatctttttccatttatatcaaacattaaataaattgattcttttgtattctgccttaaattaccgacagaggtaataaagccctcgtcctcttttgcattcaactgagagattgcaaatgaaagtaaggtagtgcctttttttacttgataacgctttgattttccctcaattattacagtaactgtgttctctttatttgagtgtgcatttgacgtatttcttggtagttcactctttgaggtgaaacaagctgataacatcaccaatgcaaaaactagagcgactatcacttggagatttttaactatttttttcatacggtctcttctgtcctatcaatcatttcgacattttccattttttcaacagaaatgcacgaaagcctcttcctatttctttccaaaatgcaaaacatacaataactataactaaaatattattgatgatatatgtgacatcggctccaatagctgatgctaaaaatcctgtgtacaggattccaagagggacgatcaaatttgcagaaaaagaaaggagagcaaaaaatcgactttgaatatttaaaggaacttggctctgaaaaaaagacgtcattggtacattcactaaaattgtaataaacccaagtaacacttcaaagaaaagcattagtccaaagaaaacaaaagcattaaaagagattaaaaaaactgatgaaaatccaattaaaaccatgaccaaactgtttagcacgaagagtttggaaatatgctttttgaactcaatttttgagtttttagcaatgaaaatccctgataatattacacctattgaaaaggcaattgacaccagtccaaaaatagaagttggaagatgatatttttgaatggcaatccctgggttcgtcacttcttctgatgaagcaacaaaaaagttaagtgccataatgagcaaaaaatattttaatatcgctttttctgtccgaataaaatgaaggcctatcctaaatttttggacaaaactttcttcaacaatttgatcatttcctccgttcttactttccaatggaataaacgcaatgaccacagctgccaaaacataaagtatagctaaaattaaaataacacttgagaaaccgaacactccatacaccaaggttccaagcatcggtgcaccgaaaacagaaaggttatctaagatacttttaataccattatatttttctaattctgattcatcaacaagttcagtaaatagaacttttgaagataaatcaagcatcatagaaaaaattgcaactaagattgcaaaacaaacaagataaataaagtcataacgcccaaactttaagagcatagactcaatactacataagattgcaagggtcaaaactgaaaagaatgttactttcttcttttcatatttttcaatccacactcccatagctggagtaagcaaaacactcggtaacattgtaatcgtaaaaaataaacccgaaagacttaaagaatgggttgttttcaaaatgaataacgggaatactacgggtaagattgctcctgcaaactcagataagcagcgagaaataaacaaatatttaattttagacaagacaactccttaaaatatgaataagaccagaaaaagagaaagtctatcactttccccttatcaaaagattagcaatactttgtgttcatctcagaatctactgcttgagcagaatattttgtggattgtacttccatcacttcagcaagtgatttaattttttcgaaatccatttttcgctctcctttattaaaatttgtattttttctccggtgaggatttatacataaacctcatatcatgactttcaatacctttgattccaaagcgtccacgatcagtttttctaacttttcaacaggtaaatttaagcccgagcgtgttatctcagtaaaccagtcctgaatcttatgcgaaatcgtgaagtattttaataactcatgccccaaaacattagtctgtatcacttccttaaacatcttgttgtatatcaacaaatccgttgaattatagtgctcaaaaaaataatcgttcaggcataatttatattttccttcaaaaatttcatccatagtagaatatttttcttgtgaattttcaagttccaaaaaatcataataggctaaatctgatttaatattatctaaagcaaaggtaatcttagcatttcctatctgcaaatctgaagtaggataagaaagaaatattccatgcttaacattatacaaaagagtcatctgcgtttcttcatctataatcaagctaacatagcgatttattttaagactttcattctcaaaacagaatccataaaccttataagaacgttctgctgcccttttttcacgttcgttgattaaatcaatttctgatgggagaatagacttagggaattcaatatcaaattgttgagcatcaaaagaggtttgcagagaaattttagagctacgcatcgtgctcacaagttgtttggcctcatctgatgtcaagccttcgtgaatattataatcccgagagagccttaaatcttcatcatcagctggttctaaaatttcaatattaaatacttcgggtttctcataaacgcctgcgcccacttcaagtccaaacgtgccaaatccctttgtagaataaggaaggccataatcctttttggatttcaaaatcatttcatttgcaaaatgataggtattctttgcttcttctaaggtttctgtcggaaatcctgtcataaaaaagaggtgaaccgaaattcctgcttcaaaacaatttataatattgggttcaatccaagcaatatcaatatttttatccatcaggtccagtaccctttgattataagattcaagcccaaattgaatattagaacatcccccttttctcaagatttgtgtcgtatctgcggtaagcaactttgaaaagcgggtttcgcaataccatgaaatgtctttctgctcattgtcaatcagtaactttgcaatttgcttcattttaggcacaagaaatgtttcatctacaaatgaaaaatgagaaatgccgtatttttccttcacaacttccatgttttctacgacttttttagcaggcatatgtctaaatttcccccctgaagcgttaggaattgtacagaaggtacacttatttacgcaagctcttgaggtataaatgggaatccatagattatctgtgaagtatttggaaatatcaaatccatcaaaatctggcggtaagctatttattgttttagactctacgatctcatttcgtttcaaatttctatgatcatccaaataatatagattaggaatgtttgagtaatctttattgttttccaactgctgtaaaaaagatgataagttttcttcaccatcataaagaagcatagagtcaatgtagttccaaaaaggatgtagattaccaataagtgatgaaatacgagtaataaaattaccgcctaactggatgtgttttacgcttggacataattctttaattgccttacacattgttaaagttggaatgagttgggtatttcctgtgacagagaaaccaatatattcaatctctttatttttaatttcttcaatggttgaacaatccttttcaaaatattcaatgagtggattggctgctctatctgataatgctttcattatctctgaagtggaatcgtgcgaatatttgaaatgcatgctgttaaaatcgatttcgaatcctttataaacttttcctgcaagataattcaaattggataaaacattccaagcaaactttctttgccaagactttgaatcttttgagcgtattatatcttttgcttcttggatatgtaatgttgaattgaaataaatactcttttttagagttgaagtttctctactcatccgcttgaaaaactgttctgagaagaaaaagtcataaaattcaacattttcatcacgaattaaaacctcttgattattttgttaaagataggcttttaatacaggcaaagataaatagggcccccgtggatcccaacctggcggaaaaattaacattgacttcatcatgagtactcctaaaataaaatctcaataactaaactaagttatcgagattttatcattttatcttaaatattttttaaacttttaaatatatgaaaacattacaattctcctaaatcgtaaatctcttcataaagctcctgagctgcttgagtatatccatatttttcgatgtctttagcacaatcttgcatcattagtttcccttttgggtcctccaatagatggagataatgtccttccaaatatcttaatgtaatggcttcttcaaaaaactcaatcggtattccgattgtcttaacacgattaagacaaaccaatgccttctctaatttttttcgattaagccaggtgtctgcaagattcaacattgtccgaatgaccatttgttggttctggtgaacatttttatagtaacttgacttatcaaatatttctgtaccataataatccaacatattatcgtcaagataatgctgacaaacactgaacacccaaatttcatacctcccccactgttctactaaatccaaataactcatcaaaacatcaatatcatctttggtggggttcccaccagcagtagaagcgagtgataccttagatacaatgtaatttaatttgaaatattttttatccgaatttttttctgatttctctttccaataatgcaaccattttttgatttgattcaagtctttgatacgatgggcttctcgaagctcatcatgaaaagtatagtcttcagagaaggaataattatcataaaaatcttgaaattcatctaacgagagttgagtgttttggagcaaaagtaaaaatttatcaatcgtgagtgaggtttctccacgttcaaactttgattcctgagccaaagagaattcatttgctgtcacttctctaagtgttaagtgcttcgcctctctaagaatcgaaaatatcttgccagttttatttcccattattttttcgctttctcatatattcaaacaaattataccaaaaatctctgtaaggtatgaggtatgtgctcagagtgatattatggaacaaaaaaatggagcttatactccatttttacgctagtcttcatcctttgcagtcccaatgtgtggttccaaacgattagctggatttagtcataatgcattgtgaaacttctcgcttgctttgttgcgtatgctgttgtattttctgagacaattatatgcgctcaaattcttgtaccactgtacccattcaaatttaaattatttcttatttatatatactcgttgtttatttacgtccaagcatttttcttcaaattagactaaatcactctaaatatcactttttatttattcatcttaaattctaaatataaatcattataaattccagtccaatatggattaaggtttttgtaggcttcatcgtctttgatggttgcttcatctggataaaaggatttattatctcgaatttctttgggtaagagggctttggctttcaaatttggggttgcataaccaatccactgcgcattttgggctgcatttttgggttcttgcatgaaattgataaatgcgtaagctgctttgacgtttttagctgtttttggaatggctaaattgtcataccaaatgtttgttcgctcggggataacgtatttcaaatttttattttcagaggtcatctctgctgcttgtccgctataaacaacggccaaaggtgtttcattattaatcatgtaattcatgatttcatcacccagaattgcttttacatttggcgtaagttttagaagatcttgataggctatatctagctctttttggttggttgtatttaatgaatatccatgtttactaaggaccattgccataacgtcacgcacactatctgtcagtaaaattgagtttttgtaagttggtgaccagatatcattccacgtttttggtggccttgttactgtttttgaattataaacaatccctaatgttccccaaaagtatggaacagaatattgatttccttggtcaaaagccggattgaggagtttagggtcatcatcttttaaacctttaattttactatggtctagcttaatgagcaaattttctttggccattttttcaatcatgtaatcagaaggaacaatcaggtcataagctgttcctccttgtttgacttttgaatacatggcttcattggaatcaaaggtcatatagtttactttataacctgtttctttttgaaatttactaatcaggtctgggtcgatatactctccccagttaaaaatggtcaggctattattttgagttttgactccatcagcagctttcattctattagtaatcagtcctaacgaggcagtaataatcaaaattcctacaaagaagtataataattttttcaagtttctcctttctatactttgagctacaaagtatcagtaaaatagttttaagtcagatttgaagattttccaacagtttctgaatctctcataatataataatagcctataactaatagaattgaaaagagaaatacaagggtagaaagggcattaatttctaaagaaattccagcgcgagctctggaatagatttcaactgatagggttgtgaaatcatttcctgtgacaaagaaagtgacagcaaaatcatctaaagaataagtaaatgccataaagaaaccagcaataattcccggtgttaaatagggcagggtaatttcacgcattatttggcttgaatttgcccctaaatcatttgcggcatcaatgagtgaactatccatttcttgataaagcggcattaccatcagaacaacaatagggatagagaaggcaatatgactgagtaaaacagacataaaaccaagtttcattccaacaattgtaaataaaatcaggaaggaagctccgatgacaacgtctggggaaaccattaagacattatttaagcccagtaaagtttcacgacgtcttctcttgaatttaacaaggttcaaagcaccaattgttccaataactgtagcaatcagtgagcttaaaaaggcgagaaagaaagtctgaacaacaatcagaattagacgactgtcagcaaataacgttttgaaattatctaatgtgaaacctgtaaatttactcatatcacttccggagttgaatgagtaaaaaataaggtaaaaaataggtgcatataaaaggatgaggacaatggtgaggtaaactttaccaagcgaatttttcttttgcaaatcaatctctcctttctttcgtcattctcatgacaatcaacatggctacaactaagacaacagcaatggttgaacccattccccagttttgtgtcgttaggaagtgttcttcaacggccgtaccgagtgtgatgactttattcccaccgattaaacgcgtcagcatgaagagtgacaaactaggaataaagacagcctgcactccagctctgacaccgtttagtgagagtggccaaatcacttgagtaaaagtttggaaacgtgaggcgcctaaatcggcactcgcatttaccaaattatcatctaaatcatttaaagcattaaaaattggtaaaaccataaagggaatggaaatgtatgatgcgaccaaaataaaacttaggtcagtaaataaaatctgtgtccgtccaattcccaaaaactgtaaaaagttattaactgaaccatatttaccaaaaattccaataaaggcataagctttgagtaacaagttaacccaagtcggtaaaataatgagcatgagccaaaattgtttcatttttagtttggtcaaaacataagctacggggtaggagatgacaagggttgctacagtaataatcagtgcgtagagaatagagttccatgtcattaagaggtaagttccgctagaaaaatagaggatataattgttaagggtaaagtgaccatttaaatcaaaaaatgattgccataaaagcatggccaaagggacgataacaaagaaaagaatccagagaaaatagggaacagaataaattcttttggtcacttattggccccactttctttattttctgactcaggttcattctcttgcttttgtaaaatttcattcactgtttcagcaagttctgtcaattccatcgtgttttcaagcgcttctttaacggcttcttgaatggcagcttcttcttcggcattttcttcttcgacagcattagctaaaccgaccgtttcttcttcttcaacatattcttcaatacgtgcatcaaattcttcttcggtttcattaagacgcatgatgtgaatggcttctgggtcaaaatcgagtccaactgtttctccaacaatggctttatgtgttgaatgaatgagccattcgttattaaattcatcgtaggctacaatttcataatggacgccacgaaagagttgagtatctacttttacattgaatttgccttcgtcaggaagtgtaaaccagatatcttcagggcgaataacaacctcaattggttcatttttacgcatcccaccatcgacagcttcaaatttctgaccattaaattcaacgaggtagtcttcaatcattcttccgtttagaatgtttgattctccaatgaaatcagcaacaaaatgattaattggttcatcataaatatcagttggaggccctgattgcacaatttcgccttcattcatgatgaagacccaatcagacatcgctagcgcttcttcttggtcatgcgtaacaaagataaatgtaattccaagactttgttgtaactctcttaattcatattgcatatcttttctgagtttcatatcaagtgctgaaagagattcatcaagtaagagaactttagggcgatcaattatggcacgggcaatagctaccctttgtttttgccctcctgataatttagtaattgaacgcttttcaaagccatctaagcgcacgagttttaaactctcagagacacgcttggcaatttcctttttatctacccctttaattttaagagcgaaagcgacgttatcaaaaacgttcatatttggaaaaagagcataggattgaaaaatagtatgaacatttcgtttatttgcgggtaagtcattaattcttttattatcaagaataacatcaccatcggttgcatcaagaagcccagcaataatatttaaaattgttgattttcctgaacctgacgcgcccaaaagagtataaaattttccctcttctagttcaaatgaaatatctttaagaacggttgtatcagtgtcagcataagttttactgacatttttaaattcgataattgtttttgacatttttttaattcctttgaatataaagatgtgataagccgtaaaattgcttgtaagtaatataaaaaaccaagccaacgcttggtttcatcatcaatttaagttttctgattccaaaaggacaaacagaaaaatctagtgcagagtctatacagcagaagaacttttaatactcttattgatgcgccaaagcgtgtttttcttgggtggggcttttatattccccataactcctaaaaagagttaatcaataaggcaacgaaagtcgccaatttcggcttttgacccggctgtccgtctggccttggctcaatttttactgacaaatcgtcaatattttactgacgaaaagtatttttgagaaatttttagtttcgtcagttcaatgcgaccaaaggaagtcattgaatcggtggataagggaagtttcagctttgctgaaatttctatcagtaaattaaatccagaattcaaccattaaattggcagatagaaaggtctaatttgctgacggcttattcatcagtaaaattgagcggtcaaatcttctgtatatgcacagaacatcattaattatagcttaaattagatgatttatcaagttgaaatttgaaaaagacaggaaaatcctgtcttatttttcaccgattattctaacttctggttcaagagtaacccctgagttttctttcactttatcaataacatgtgcgataagtttttcgtaatctgtcgcattaccatttgcaacatttaccatgaaacctgcatgttttttgctaacttcaacaccgccaatgcgtacaccttgcagattagcttcttggattagttgtcccgcaaaatgaccgactgggcgtttgaaaactgaaccgcaacttggatattccaagggttgcttactttcgcgcaggaaattgagtcgattcatttcattttgaatttgagtcggatcacctgcttggagttcaaattttgctgacaaaacaaccaaatttttgtcacgaatgacagaatgacggtagccaaattgcatttcacttgcggtcagaaccgaaacgtttccgtcagtatccataactttgcaacttaccaaaacttgagaaatttcgccaccataagctccagcattcatgaaaacagcaccgccaattgaacctggaattccgcaggcaaattcaaaacctgtcagtgaattcgcttgtgccacttgtgttacttcttttaattttgcaccagcttgagcttcaatcgtatagccagctacttttactgattctaatttttcaggtaaaatcacaaggccacgaattccaccatcacgcacaatcagatttgaagcatttccaagcacagtaactgctgtgtcagttgattttgctttgactaataattctgtcagtgcttcaattgtagctggaaaagctaagatatctgctggtccacctacttttgtataagtatattttgataatggttcattaaatttaaccagcaaatctgggatattttcaaggtcagtttcttttatcatatccttattttatcattttctattaaagatgacaattttgtcttaaatttcggctttaactttctttttattcaagaaacctttagctttatcgaagatatcaatcgggaaggctttgctcaaaacattgcacaaaccaagcgctaaattgaaatcaatcatactgtgaacaagaccaccaaaaccaatcaataatagaagattaagtagagcagcttgatcaatatttgcaaatcctaaagaataaaaaacataaactactaaagtttccaaaccagcatgaaaaataccgagaataaaattaaaaatttggattttaactttttgatgaacaagttcaggatgtttctttaggacataagcacccactgtcattacagggagatgcataagggcacgcaaccagatagttggtaccggaatactaatcataaatcctagggtagttcctagagcaacaaaagcggtcattaatggactgaaaaacatggcagccattacaggaacatgtgaggcaagcgtgaatgatgcaggaccaataataattttagccggcataatcattggaattagaattccaagtgcagttagcatcgcagcaataatcagatttctgacttttgccttttttgtttgagccatttgagtttccttttctttttaaactcttgctttaaaaaagcggacagtagggcaataatggtttttcatttaaatcacatttcctgtcaataaaagaaatttaattattcattacttttaattttaaaaaaatgatcaatcaaaaaccttgttctgacaaataaaatgaaagttagtgaactactttacattcttttttgctttaatgattatatcattttatatgtaaaataatcaagaaaaaaatctgtatttataatacagattcttctacttgtaatccattactgtcaacttccaaggaataaagttgaccagataaattttgctcattaattttttctgtcagtaaattcagcttatcatcgggtaaaaggagcattactgttggccccgccccagataaataagttccataagcaccaaattcatgaccaatttctcgcaaaattttcagttcaggaactaaagaagcgcgataattttcatgaaaacggtcagactctatcatttgcccagcaacttttaaattttttgtcaaaagactggctgtcagtacatttgcaatagagctggcagcaacggcctctttgtaagccaattccttaggtaaaacttttcgactttcaacagtttttaactcatagtctggaacaaaagctagaagcttacatgaaggaaagtctgagctaacataattcgttttgtcagcaacagtacttgctataactaaatttcctaaaagtgctggtgcaacattatcagggtgtccttcaatttcacaagcaagttcaagtttttcttccgttgtcaaatttagctttgctagttgattagccaattcaatcccagcaataatgactgaacttgatgaacccaaacctcttgctaaaggaacttccgaagtcattttcaaatgatattttactgacagactactatttttagctttcaaaactgctgacagcgtggtcagtaataaatttttttcgtcagtaggaatattatttcctaaatcatggtcaattttccaatcattactttcttcaagtacttccactgtcaaatacaagttgaccgcaataccaattgaatcaaaacctgcgcctaaatttgctgatgtcgctggtacaataattttcattttcctagtcccccaaaactttaaaataattaagtaatttaaaatctacttcttcttttaatttatcttgaatggccaaaagttgaacgcggttaatctgatgactgataatcacaacaactgcgcgatgtccatcacctttttgttgtaaaacttgttcaaaagagacatcttcgcttgtaaataactccaccaagcgcaataattgcccagttgaatctggtgtttcaacggaaaaataatatttatttacaatatcatgaggattagctaagctcgttggacgtgcgtattcattaaatgacttcccaattgttccatcttttacccgtttaacaattcgaacaatatcagctaaaacactcgtagcggttggcttttgacctgctcccgccccatagaacattgaatcaccaattccctctgattcaataaaaacagcattcataacaccattgacactagccaatggatgactttttggaagaaaagttgggctaacctcagcgaaaattcctgattcaacctcattaatttcacctgtcaattttaaaacatagccaaattgttgagcaatctcaacgtcagttttttgaatcgttctgaggccagatttagaaatttgatcgggacttagcgtcattccgaaagcaaattcacttaaaatcgctaatttataactggcatcaattccgtcaacatcatttgttgggtcagattcagcataaccaagttcttgagctttggccaaagattggtcgtaagtccatgcctcctctgacattttcgtcatcataaaattacttgttccattaagaattcctaaaagatgtgtgattttgtctgatgaaaatgaattggctaaagttcttaagattggaatcccaccagcaacagccgcttcataataaagagcaacatgatgtttctctgccaaagcacgcaattcagttccatgaacagccagtaaatccttattggctgtgacaacatttttacccgctttaatcactttcgtaatgtaggtcttagccggttcaatccgtcccatcaactcaacaacaattgaaatctcagaatcagctaaaatttcttctaaagttagaacaaaatcatattgataaccctgtgctctagctttttcaattgctttttcatctctcatcaaaacttttgaaatgacgatttcttcatctaaaatttttgatagtttttctttattctcagaaattaaagttggaagcccagttccaactgtcccaaaccccaatattgctatatttactgtcatcacttctccttttcaaacaaaaattaaattttaagataattcaaaaaataactttcgctcaatttcttaatattataccatttttatcgaaaaaaatttactgacagaaagctcagtaaatttaaaagaataaaaattactgacagccttgtcagtaataataatttcactattttttaaagcaaatctagttttttcaactcattatcgatttgtcccaaaacttcatcaagatgttcaggattattgacaaaatcaatagaatcaccatcgattctcaattttggcgaaatgttgtaatttttataccaatcaggatattcatcatgcacttgagcataataatcttttagtccttcttgattttcaatttgttcaaatgaacgaccccgttgtgcaattcttgagagcattgtttcaaatgagacatcaatataaaccaataaatccggacgttttttgggcattccatcaagttcttctaacatgtttgctaataactcttgataaatttccaattcagtttttgttacatttccatttttatagttcaaagttaggaaaagttcatcctcaaaaatcgaacggtcaagcacgttattatcctgacgataagccattttaattgattcaaaacgtttattcaaaaaatagatttgtagcaagaaagcatacttttgaggatcttgataataaagatcaagtacaggattattgtccaccgcttcataaaaaacatccgtttttaaatgttctcctaaagcctttgctagactcgacttccctgcaccaattgtacctgctaatacgatcaaaattgtcttttcctcctcgtcatttcttcaaaagaaagaaatgaatttataaatctattttattatagccgaattttttaaatttacaactatttattaactttaaaaactaaaaaattattttagttattaattctcttttttcaaaaactcacgaacttgagatgagaaatagagagagcctgtaactaataacaaatcatcttcagctaaatttttttgcgcacgaactaaagctaattcccaacttggagccaattcaaccccttcttcttccaagttttgaaaatctcccaaattcaaagcttttggataatcaaaagttgtcaaaatcaaatgtgaatttttcacagtttgaagcatttttatcatttgactaatatcttttgtagtaatggctgaaaaaatgattgtaatctttttatctggaaactcagagctaaggttttcaagcaaacgattcatcgcatgaacattatgagcaccatccagtaaaatgagtggtttttcacccaatttttccatacgagctggccaaaaagcctcacgaattccagaacgaatcacatcctcagtcaattcaatcccaaccttacttgcataaaccagagaaagttcaatagccataccagcattttctatttgatgtaagccaactaaagatttttcaatatccaatattgcttcttgaccagaaaagaaattaaaatgttcgtgttcttccacttccgtacgataatcatatggaaattgataaacacgcgctgtattttttctagccacttcccatataacccgaagtgcttttaattcaatatttccaacaactactggaattcctggtttaataattccagccttttgagctgcgatttcttcaatcgtcgaaccaagaatatcaatatgatctaaaccgattgttgtgattccagaaacaacaggtttaatcacatttgttgaatcaagaagtccacctaaaccaacttcaataaccgctaaatcaacctgctcatcagcaaaatatttaaaagccattgccgtgataatttcaaattccgtaattccagtcagttcagcatctttatcaagttctgcaacaagtggttggatcatttctacataataaattaatttatcatcagcaatcggtagtgcattaatcgacatccgctcaccaaaagtggtgatgaaaggacttgtgaaagaagcaaccttcagacctgcctgcataaagattgagcgtgtgaaagcgactgtggagccttttccatttgttccagcaacgtgaatcattgacaaagactcttctggatgaccaagcaattctaaaagggccgaaacacgacttaggcctgggcgaatattaaattttaaacgtgaatgtatccattccaatgcttcttctatagacattttgtgaccttttctactttatcttttgtattgataatattttttaaattcatcaggagcttcagttctatcaagaaggaaaaaaggcaattcagcaaggtctgcttctttttcttttagttccaatagaaaacgaaaatcaatgtgttgatgttctttctcattcttaattttgttgtaaggaatattaatcaagttaacatctaccaacttgcctgattctgacgctgaaaaacctgtttcttcatggaactcacgaatcgcagtttccaatggcttttctcctagttcaacatgacctgctggaagcaaaagctccttttgataagggtgttcaataaaaaatagtttatgttttttaaaaactaatgcacttgctgacaattgtaaatctggattctttttcccccgaagctctaaagtcgaatttttcaataatcgaataatctcggaaaatttttcttcacttccaatagcagataaagcttgaatttcagcaattaagtcttcattcatttttaaaattccttataaatttcaattgcatcgagtaaacgtttagtctccttaacatcatgaacacgcaaaatccgtcccccgtcagcaaccatttgcgcttctaggacaaggcttgaaaaaagccgctcatctccttgggcattgaagagttttcccataaatgacttacgagagattgcaatcataagaggtaaacctattctgcttaaaatttcagttgctttaacccgctcaagactatctgaacctgaatctccattaaaaaaaccaactccaggatcaataacgatttgttcagcttttaaaccaagttgaagtaactcttcttttttattttcaaaaaataatggaagttcttcataaacattatcagcataactaaaaccagctcgcccattattcatagcaactaaagccggttgatacttttctaccacttttaatttatcatttgtatcaaaaccatcaatatcgttaataatatcaaccccagcgtctaaaactcgttccatgacataagcttcatccgtatcgacagcaaaaatcgctttaggaaagttttttttcaactcaagaataggttctttcagtctgttccattcctcttctgggctaatatcgtcatatcctggtttcgatgatttccctcccagctcaagaacagaagctccattttctaaatcagcttctactctttttaaaatatgagagaggtttaaattatctggatttccatcataaaaagagtctggtgtaacattgacgattgaatagacaattgactttctagttaaatcaaaattgaaatttttacctgaccaaatgatttgatgacgtttataaatcacttcaagcatttttttatcttcatcattttcaaaaagattaatcaattttgctaagtcatcaattgttaaaactactaacaaggagtctggagtcagtcttgtcaaactaccatttcgataaagttttttttgaagagaaatcatttcattgtgatttaactcatcaaattttaggataatatttttaagagaaaaagattcttgattaagttctaagattttcataaaagactttctaaaaattccattcttttttcgttattttctttaaattcacctaaaaaataagaagttttagtaatagaatttactttttttactccacgcatttcaacgcacatatgacgtccttcaacaagaactgccactcctttaggattcaaaatatcagtcaaaatatctccaatatcatgagtgatattttcttgaaccgagagtttgcgcgaaacataatcaactaaacggggaatttttgacaagccaataatttttccatcagctggaatataggcaacatgagctttcccaaaaaatggtaacatatgatgctcacacattgaataaaaaggaatatctttaatcaacacgattgaatccgttttagaagaatcaatttcaaaaagtttatactcattaaacttgcttagacgttgtgacgaaagaatttcttcatacattttagctactctcgctggagtttcaagtaatccttctcgatttggattttcacctactgcaaagagaatctctttaacggcatcttcaatacgatttcttggtgttttttcttcttttatcacatggagctcttgttcacttactgaaagttcagctattgctttttcaattgtcgcataatatttaaagtctttatcaataagttcaaaaataggtttcaagacaaaaagacgattaaaagcttctttatgtggaataaccaagttttcttcttgcatttctaggtcaccatagaaaataatatcaatatctattgttcttggcccccaatgaattttccgctcacggttcaaagataactcaacttcatgaataaaagataataattccaaaggttcaagtagcgttgccacctttaatgccaaattagtaaaatcatcttgtttgacgccgccgactggagtactttcataaaaatttgatactttttcaatcataattttagggtgttttcccaataaacgaatggcttcatgtaaataatactgacggtcaccaatattacttcccatgcttaagtaagttgtttgcataagtcctccatttagacataatcttttatgattttgtttgtcttctatctctttaaaatatttatcttaaaaaccagctttagcctctcatctcaatttcagctgaatcaaaaattccttcaatcggtacggctaattttctaagatggacttcaaccgttgatatacgctctgaagtagcctttactgcttgaataatttcaaaggcaacatgttcaattaaatcagcttttgaagattctacaactgcttttgttgcctcatagaaatcaacataagacaaagtttcatctaattcgtcttttcctgaaaaatcaaaatgtgtttccacgattaaatcaatttcgagattttgtccgagaactttttcttctggcagaacaccaatatgtgccctaaattttatattattaagttttattttgtacatatttcctctttttaagtgtagaaaaggctatgaatctcttcatagcactattttcagagatatcttaaaatcgcttcccaagcttcttcaaatcctgtcttatcggtagaagaaaagataataaaatcatctgtactatcaaatttcattgcttttttgataatagattcatgtttattccacttaccacgtggaactttatcggctttagtcgcaactaaaatcactggaatatggtagtatttcaaaaactcatacatcatcaaatcatcttctgagggttcatgacgaatatcaactaagctgacaactgcttttaaattttctcttgttgtcaaatattcctcaatcattttaccccatttttcgcgttcctttttagaaacacgagcgtagccgtaaccaggtacgtcaacgaaatgaagttgatcatcaatattataaaaattgagcaactgtgttttaccaggttgaccagaagttctggcaaagtttttacgattaagtaaagtattaataaaacttgatttaccgacatttgaacgcccagctaaggcaatttctggccaatcattttctggatattgtttttttgatgctgctgaaattgttattgtcagattatttgtatttatggtcattttttcttggtctctcgaatcatttgtggctcagcttttccgtcaacaactgcttcattaataataacttttgtaatttcttcatgacttggaacttcaaacatgatatccatcattacttcttcaataatcgaacgaagtccacgcgctcctgttttgcgctcaattgcttttctagcaattgccatgagggcttcatcttcaaattcaagttcaacattatcaaataaaaggagttgtttatattgtttaatcaaagcatttttaggttctgtcaaaatttgaatcaaatcctcttcggtcaaacgttccaaagcagcaacaattggcagacgaccaataaattcagggattaatccgaatttttgaatgtcctcggcaataatttcttgcatataagaatcatcgtcatttaattttttattattggcaccaaaaccaataattttttcacctaaacgttgtttgacaatttcttcaatcccgtcaaaagctccaccaacgataaataagatatttttggtatcaatttgaatcatttcttgattagggtgtttacgtccaccttgtggtggaacactagctactgtcccttcaataattttcaaaagggcttgttgaacaccttccccagaaacgtcacgagtaattgatacattttcagattttttagctattttatcaatttcatcgatatagataattccgcgttctgcacgttcaatattgaaatcactcgcttgtaaaagttttaagagaatattttcaacgtcttctccaacataaccagcttcagttaaacttgtcgcatctgcaatcgcaaacggaacattgagtgatttcgctaaagtttgagcgagaaaagtcttaccagaaccggtaggtccgattaatagaatgtttgatttttgtagttcaatatcttcagcaattttacttgctgtaaaattaattcgtttgtaatgattataaacagcaactgcaagtgcacgttttgctttttcttgacctatcacatattcatttaaatggtcaaacatttctttaggtgttttaacttcaagcatttctgaatcttgttcttctcttaattcttcttctaagattcgagttgaaagttcaatacattcattacaaatataaacgtctgaaccggcaatcattttttttacatcatcttgactctttccacagaaagaacaatgtatatttggattttgtgtatttgacatagttattttattcctgatttcactaacataaaaagtaagtattattggcttacttaaaaggcactttttctattttttaaaataaagttccagaaaaagcgtgaattgtatttacgaggttcgtaaaagcattgagtaaaaacaatactcccagaccccaacgtttttttctaaagcattgaatagcgatgacaatgctaatccaacaaaggagagctgtgaaaagcccaaaaattgattttgtcatggttgtttcactttttcatattttttaattgtaaaagtataagaattccgctcatctttattgtgaagtttttcagagactagtttaaatttcccaaaatcaaatgtacttggaaaatatgtatctcctttaaatttttcatgaacaactgttcgatagagcaattcaagttcagattcaaaaagggctaagatttcagctcctcctgtgataaataagtctttattttgcttatggtaccaatctagaacttccttagggctgtgcatgatgagcactttttcattatctgattgataaatttcatcgcgagttaaaataatacttattctccctggcaatacacgtttattcattccttcaaacgtttttcgtcccatcaaaatcacttgattcatggttgtttctttaaaatgttgttgttcagcaggtaaagaccaaggcattttatcagcttcaccgataagacctgcttcatcttctgcccatattccaattatcatagcaacccctctcattgatttttacttttactattatagcaaatttttgctgttttcgctttgacaagtttgatattggtcactcatttttaaaaataatttctttttttatcaaaaaaatttagttttctctttacaaaatacaaaagaagtggtatgatatcaattatattaatttgtttcaatctttcctgttatgattaaagcaaattagtcccccaactagacttcttgctgagattgactccgaggggtctagtttttttgttttttactttaattaatttactgacagctcttctgcttatggtaaaatgttcttaaataattacattttactcatagattctttgataaggctgtcagtaaaatttttgttattaagaaagtgtatttcatgaatcatattgctctttttgaacctcgtattcatttcaatacaggaaatatcgcccgcacttgtgcggctactaataccgttttacatttaattgaaccctttggttttgaaatttctgataagcatcttaaacgtgctggtttagactattgggataaggtaaatattgtctatcataaaaatttagatgattttatgaattcaattaatgacggaggacaactctatttggtcagtaaatttgctgagcatgtttattctgacgttgattactccgatgatgaaaaagatcactacttcttgtttggccgtgaagatacaggtttacctgaagaatttatgcatgaacatcgtgatgaatgcattcgtattccaatgaatgacgaacatgttcggtcattaaatttatcaaattgtgcttgtatgattgtctatgaagctttaaaacaacaagatttccgtggactagaactcgttcatacttatgaaaaagataagttaaaataattgtatttataaatagacaaacgccttgttactgacaggcgtttttttattgttcttttatttagcgagtgctataatgaagacaaataagaggggaatacaaaaataaggagcattttatgaaggctaaactaggcaatgaaattgttgaatattggcaaatcagcctgactaaacccgcaaacgaatcgtgggtcttagaggcttttaagaaaggacagctctcgtggtctggtcaatttgtaatgaataaggagaccaaagaaaaattacttgctgacggaatgtctacaaaaaatccagctgagcataataccctttctaaagaaataaaacatttggactggctagggctttatatttccccaaataagctgagtaatgcttatccggataatatttatcttgtagtcaatcaagtacgtatcccagcctttggacgacttggagagtacctcctagtagcacctgatggttcttttgaaatttactctgaaaagaaatttcagcgagatttagaaaaaattcaataaaaaaccacctcaacggtagtttttattttattttgtttcgtcagtaactaattcatcttttttcccatgattaaatactaaattcaggataattgctgaaacagtactcatcacaatcccattagaaacaaaaggttgaataaagcttggaagtgctgtaaataagtttgttgagttaaaaccaacacccattgcaatagcaaccgcagcaatcagaagattttgatttccttcaaattcaacttttgccagcattctaattccttgtgtggcaaccataccaaacataatcaacatcgctccacccagtactggagttggaataagttgtgcaacagcggcaaattttggaataagtcctaatacaattaaaaatccagctgtgaaataaataggtttacgtgttttaattcctgataattgcactaaaccaacgttttgtgaaaaacctgtgtaagggaaagtattgaaaacaccaccaagaaatacagcaaatccttccgcacgataaccattacgcaaacgtttttcatcaagattttcatcagtaatatcagcaagagctaaataaactcctgtcgattcaaccaatgacacgatagcaataataatcatcattaatgaatcagccaaataaaatttaggtgctgagaaataaaaaggttgtggcaagtgtgcccatggtgcttgagaaacaactgaaaaatcaactaagcccatgctagcagccaaaattgttccagcaataagtccaattaaaatagcaatagaacgaataaatccagtagtaaagatattaattaaaagaataatcactatagttgaaacagctaaaattaaactttggattgttggtttgtcaacattattccccatattgccaatagcaacaggaataaggcttaaaccaattgttgtaattactgaaccagtaacgattggtggaaatagttttcggattttagagaaaattcctgaaaccaaaataacgaaaacccctgcaaccattaatgaaccaaacattgctccagagccatgtctttgaccaataataattaatggagcgacagattgaaaagcaacaccaaggacaactggtaagccaatcccaaagtgcttacgaagttgaagttgcaagaaagtggctaaaccacacataaaaatatctgctgaaattaaataggttaactgagttgctgagtaatttaaagctccagcaatcatgattggaacaagaattgaacctgaatacatggccagcagatgttgtaatcctaaaacagcagattttgagttactttgctcctggctttgttcatttttttgagacattttgattttccttaaatttttctttttttattttcttattgcttaagcttagtcgaaatctttatcatcggctggggcgaagatgactttaccatcttcaaatttttcaatccgggcaagactggtaagtttcattccttggtcaagaagtttttgacggccatcttggaaagatttttcaatcaccattcctaaaccgacaacttctgctttagcttgttccattaaatgaaccaaaccaagtgctgcttgaccattagctaaaaagtcatcaataatcaagactttatcgccttcttcaatgagtttgcttgaaatttggacagttgaagttaattttttagtgaaagaataaacttctgtaatcaataaatcatcattcatagttacattttttgcttttttagcaaaaatcattggaacgttgagtgattcagcagcatataaagcaggggcaatcccacttgcttcaatggttacgacttttgtaactcctgcatttgcataaacttgtgcaaaacgtttcccgatttccttcatcaattgataatccacttggtgtgtcaaaaagcggtcaactttaagaatgtcttgtcctaatacttgaccgtctgtatgaatgcggtcttctaataacttcattattctctccttaaaaaaattttttctcatctgtgcccacaggtgagaaaaacgtctcgttataaaaaataacaagacgtttcaaatacgcaaaaaagaaattaaatttactgaaaaatcgaatttccttattgtctcgcatttacggtacgaggtagaaacgcccagccatattctaggtataaataagattgttctattatagactaaatgctaaagtttttcaagcataagttttggtattcccgaacaatgggaaagaaaatgcttactaaatcgcatcaccattccaaattgagtttttaacaacaacataatcaacttttgtcagcgcagacaaatcacgaccgccagcataagaaattgaactttggagatcttcttccatttctttcaatgtatctttaagtgagcctttgtgaggaaggagaattttctttccttcgacatttttgtgttcacctttttgatattctgaagccgaaccaaaatattctttgaaaagttgtccgtcacgttcaacagtttgtcctggtgattcttcgtgtgcagcaaaaagtgaaccgaccattaccattgttgctcccatacggattgattttgcgatatcgccatgggtacgaattccaccatcagcaataactggtttacttgctgctttagcacaccattttaccgctgcaagttgccaaccacctgtaccaaatccagttttaacttttgtgatacatactttccctgggccaatgccgactttagtcgcatctgctccagcgttttccaattcacggacagcttctggcgttccaacatttccagcaataacaaaagtttgtggcatcaaacgtttaatcaattgaatcgttttaataacagaatctgcatgtccatgagcaatatcaattgtaataaattcgggaatgagtgcgtctgctgaaatttcacgaataaaggcatgttcatctgctttaacaccaacagaaattgaggcaatcaggccttgttggtgcatttttttaataaatgccgctctattttctgcttcaaaacggtgcatgatatagaaatagccttcttttgcaagcatttcagcaattttatcatcaataatggtttgcatattcgctggaacaacagggagcttgaacgtaaaatttcccagttttacgcttgtgtctgcttccgaacggctgttaatgacacatttatttgggataagttggatgtcttcgtagtcaaatactgagtttagattattcattgcaatttctccttgaggatgagtaggcttttatgaatttctagcctgtgaactcatttatgatttgatttacagaaaagaccgaccaaacccttcgggtttcactagttgaacgattataaaatctctgtctgctcaaccttccttattcattttatctcaatcaaacggtttttttagttatttacttctatttcttcaaaaaacacatcatatcattcggaaatagcaaacaataaaaagcaccgaccattctgtcagtactttttatttaaaaataaagttccacgtctataaatgataaaaaagattaattcatagacgagcaaaaaaattaaaaaactatgcatgaaaaattgctcaggcaaaacactaataatcgggtcagtcgctgggtcaaagagccaactattatcccgaaaaagtacttcatgaaaagctacaaaaaattggtcaaagccaattagccaagcaataactccaattgctaaaggaaatagcataacaactctaagcgcattatggaaaacaagcgaaagattttcttttataaatcgaataatgaaaggaatcaaaatgattgtcagaaagaaaacaagcataaacaaatttttcacttctgcgaaatggtgaagaccacttgctgacgaggggaaatcaggcatagatagtttcgtttcaaaaggattaattaaataattcatcagaattaaaaaattatgccatattttaccggcagtcatttgaactaaatcggttaattgataccaaaaaatttcaccaaaaaacaagggaatcgccaaaaaaatagttaaagttactgacaaggcaataatccataaaatactaaatccaaaaatgactttatctctcataggcgctcccaaagtattctaaaatttactgacagaaattaatttttccgtcagtaaatttttaaaagcaatcaattactgacagacctgtcagtaatattttcaaacttcccactcatctaaactagctacaacataagtcggaggaactggaagctttggtacttcttcagctcttgtaaatccagttgtgacaagcaagctatcaattccgttattaatgcccgtatgaatatctgtcagataattgtcgccaaccattaataaatcagatttaggaagccctaatttttcgaccgctttattggctataatagcttctggcttaccaataatggttgcttcaactcgtgttgccgcttcaagcatttttatcagcgctccagctccaggagtccaaccacgttcgtttggcaaattcaaatctggatttgttccgataaatttagctcctttatgaattgccagagtagcaaggacaagcatttcataagttaaatcagtatctaaagcgaccacaacgtaagctggattctcacgatcttttttgtaacctgcctcataaatcgcttctttaagaccatcttctccaatgatataaactgttttttctaagcctaaatcattcatataatcaacagtagcaagacttgcagtataaatcgtttccaatggagtgtcaatattaaattgttgactcaaacggcgttgtaccacgcgcggtgtttttgttgtgttatttgtgaccaaaagataaggtattttagcctcttgtagccgatgaatgaaattctcgcctgcaggaatacgcttatttcccaagtaaattgtcccgtcaaggtcaattaagtaaccaccatattttttatttgtcattttattctcttctactttttatcactaaaatttactgacagagctgtcattaaatttttccccagtgaatttcaatttgagtacttccgtcattaaaattgtgatgactcacttcgtcttcccaagacattaaagcattaatttcttcaccataaaggacttcatgattatattttataaatacatgtttgggttgatgacttttacggaattcaaaatccaccatatcagctgcccaatcataatatttcgcattattaacatgtccattcatatctaatgctgaaaaacggacaggataaacaattttttgagcatcactaaattcgtcaattttacggaatttatgaggacgtgaaatttttgatactttttcagattcataaggatcaacaatttcatccaatacacggtcaatttttctcgttgccttatccatcaaaacccaagttgaacgaacttcaactaaaacttctccattttcatctaaaaatgagaaattccgataacaaaagaatttattataactagttgcttcagtttcaattgttattttttcattaaattctggtaaacgatgaatcgtcaattcatattcaataactgcccaaaagaggccatatctctcaaatacccagacatctgagcgtccaagtgccgttgattgctctccagaaatctgtaaagccacagctaaaaggcttgaaattcgcatttttttaaaagcatcactttcatagaaaggaacttgataattttgttgatattttatacccattttatgataacctcgccttctattttagcaaaaaaaagagcaattttcataaattgctcatctattagccagagtttttaagttctcagagctaattaaattttttcacaagcgatttctaaagtatcaatcaataattcttcataaggatctttagcatgatactcatcaatgtatttaatttctttcacaccagcagcaacaactaatttcaggcaggcaaggcaaggaaataaagttgtatataaaatcgctccttctggtgaaacgccatgtttagcagcttgagcaatcgcattttgttctgcatgaaccgttgctacacagtgtccatatttatcttcagtacaaccaatatctgtacaatgtggcattcctgaaaccgcaccattatatcccgtagagagaagttgaccatttggactgaccaataaagctcctacttgagcatggttacaagttgagcgttttgcaaccacttggacaatttctttaaaatattcatctttacttggtcttgtaaatttctctgacatcatgaactccttaattgctttttgatttattatagcaaatttatttatttaaggcttaataaaaaaacttccaagagaatcataaattaacttggaagaaaaattttatttttgatttttaaacaattcattatagttggtttggttattaaccatattcaaatcaacatctcccgagtaacctggtaaagttccctggtcagtaaactgttgcattttatagcttaaagtcgtttctggtgaagcgtcccaagaacctgtatttcgtccgtaggcagcaatccaaatcgctttaaatttatcgacttttatttgattatctcgcaagaaccagtcttgggcataaataccaatgtttttagctccttgtttctccaactcagagcgaaaagcctcaatcccttggttcatatttttcatattggttacctcgacatcaagccaataataggtcggcttataagtgcttgctcgacgataaaagtctcttgcttgcttcttcatttcagaagtgttttctccagtcacaaaagcgtaaaccgccgtcggaattccccgctcttggaaagctttaatgtgctgtttataggcagtatcttctccatccttgcttgctgaattatcagcatgaccataagagccattgacacgaataaccgcaccaatcacatgctgactcaaggtgttgtaatcaatatcttctggacgttgccaacccgaaaggtcaacaactggtttgttcaaatccaaaaccttctcatccaaaatatgatttacaacaattttttcagttgctgcttttttaggaggttctaccggtcgaattcgtactaaaccaagtaaggcgatcattgcaatcatggatgctgtaaagataaaaactcccatttttttaagtttacgtctcattttaggtttcattaattatattgtaacataactttcacaaaaattcatcacgatagcattaaaaattaatatcatcgagcaaaaatttctcaaagacattattccccaactcaaaacctttgtctgtcatatggattctttgtctatcatcatataataatttttgattgataagttctgtgatttgttcaccgtataatttttcaaatgaacacttgaatttattttcaaacttctcaaccaaaactcccgattttttccgaagacctaagaacatttcttcttctatttgagattttttacttaaaacttcttcgtttacccttttttcagttggagcagctttaaggtaatgatgaactgggccaagatttttataacgaatccctgctaaatatcctgacgctccagcaccaattccataatattcctcattatcccaataagttatattatgtttgctctcaaatcctggtaagccaaaatttgaaacttcataatgattataaccatttttagctaaaatatccatgatatattcatacatgtccgcatttttatcttcacttggcaggcgtaaaagtccacgacgttgtcgattcataaaaactgtgtgatcctctaaaataagactatataaagccacatgtggtagttttaattctaaaaatttttcaacatctgacttaaccatctctatcgtttgcccgggtaaagcatagattaaatcaatcgtaatattttcaaatccagcttttttcagtctttcaattgaatcatagacctgaacttctgtatgtgtccgcccaatttttttgagcaaagcatcattaaaagtttggacacctaatgaaattcgattgactgctgaatcagccaaaactttaataacctcatctgataaatcccctggatttgcttcaacagtaaattcttccaaaacttctaaatctaactgttcagcaatcgctgtcagtaaacgttcaagttgttgggctgataaaacgctgggcgttccaccaccaatatagattgttcttaatttttctatctcgaaacttttaaattcttctatgagcgattcaatataagcatcaatcggctgtcctgtcatcagtactttagcaaaatcgcaataataacaaatatgagaacaaaaaggaatgtgaaaataagccgaattaggtttttgcaacatttataaatcccttcaaaaatttttcctattcaatgaaagatagtgagaggattaaccctaaaattaatcttaccaataaaaatcacaaatacttgacctattataacacacctatggatagcaattgactttacaaaacggaaaatatagataaaaaagagagtagctttaactacactctattcttctttatcccattcccaagaccgtgaaaactcccctcctttaaacaaagaggcaagcccacttaattgtttgagccttaataattcttctttatccattccaatatttgtcataatccaccgatcacttaaaccagcttcaaccaattgttgaacaatttctgtcattaattctactgaatgagtccctctggcacgattatgacgaatagtgctggctattctatcttctaatgggcgatcaatcacagaaacgggtaaacagttcccttctctttgcgcaatcgtttcagaatttttcattacaagatagcggtgaaaaccatccacaatctcataagtatcattttctttgtcataatagcagacaattggcatggtataaccatcttctaatatcgaccgttctaaaagtttaaattcagttggcgcagttttattaggattatacgaatttgctctaatcttttcaattggaacccgtctcacttgataagctggacttataaaaagctctcccattttttcattgcctccttcttcttttgcaattcatctttcgtttgaccaaatcccatatattgacaggaagtatcattttttaaaatggtgatacacattctcttataagagggaactaatctgaaatttttaattggtacatcatcagggtattttttgaaacgaactaattcatattcctgtttgtaatttcgattattttttggagtacctaaattttcaaattgcaaatttgtttcttctagttcactgacgactttctgaggcaaagctcccccattttttgtccagtaagtcagagaactctggaactttttgagataaacttctcgaatatcctctggtaatgtcttgagtaaaaagtcaacataggtttcccaagtatgccccttaggaagactgactcctcgataaccaagagcaattgttccaccgtaaatagccgcaaaatttgctccattgacacgaccaatcaattttccccaagtctctggctccaatgcttgatacaatttcaaagatgagacaccacattgatgaaaaggattggcaaccctcatacttttaaagggtactcctgcttgaaaatataaatcatataaatcatataaatgattataatcaaagccaaatttagcatttgctacccagacatcctcaaacaaccaatcatacatcggataaaaattgataacattatgaaaaattcgatgactataatttgtagttccaaatcttgaaaaagtttcatcacgtgtcacagcattaaagcgatttaaactttcttgagctctgattccgacaagaactgctgttctttctgctttcttttcttgatgaagccactgacagaatttgctttgaaaatcataatcagacattcctatttcaaaaaaaggaaaattgtgattttcaagatgtattgctccttctggaactgaattcagccagagttcaggatgttcagggtcccaaggaagccaagttgattgtgacatcgatattccacaagacgcagagacaggcatacaaatatgataataatcaaaatcaggatatttccccattgagcgttcaatataatctttggtttcttgataatttccctcatagtcaagataataaacagaaactactatttctttgtcagcaagtttattttcttcataataacgatgaacaagttctagcatcaatccagaatctttcccgccagaaaaggagacaattaagtggtcgaaataattacaaatataatctagtcgtttattgaaagcttcataaacattttccttctgatattttctcacattcgttacctttcgcataactttttcaacatttcacttattgagcttaaaacatttaaatcctattaaagtttaggtctcccaattgaaatcatattaattattttaaaatacaaaaattaaatataaaatacgtttatatctttatattttattataaattactttattttgcaatttcacattagaatcgtactctatcttaaggcttaaattataaaaaagtacttgtcaaagtacttttttataatttaagtattttcttcttccttcaataaggaataacattgtcaaactaagcaagatgagataaattggaaaagcaacttctgagaaattccaatgatgaatctctgtaaaacttgtagatgcagaaaaaagactgcctaaaaacaagaaaccattttctgtttcggggtatttccaaccttttaacatggtaggtaatgcggctaaagcatctgataatatcgcaagagatattgcaacattaggatttttagtcaaataccaagctactaaggctagaatggaaacgagaccacaaatataatcaaacctttcaattctccaataagctgctttgttaaatgatgagacaataaaaactaaaattggaccaaagccagccataaatacgggtaaacttgcccaagaaacaccagttgataaggatgcggctgtactaatcaatggagcaattccccaaattaaccaagtaattctattcggtttaactcgaccacgcagactagcgataagataagtagttgtaaaagatattgaaataagtgcgcctaaaataacgatgagatgcattaaattctcctaaaataattttgttttcattataacaaaatcttaagattataattcatctgggaaacgatagacttgtatacttaaatcatcatacgtttgtaagtaaagtctgcgactgttcacttccacagcactgcgataaacagtataagtccctgagcggccttcagactttggaactgtaacaccatttaaaatatgccatgcctcaataatattttgctgttcatctttaggatacaccgctctttctttgtaaatagctgctcgaataaatcgagctgttggtgtgaatcctccaggaaaaactggtttcccattgaaacttcctgtcgaaatttggttaggattatcattttttactgacagattttctaatgatgaattactatcctcatttttactgacagaagtattttcactttctgtcagtaaattgatatccatataagtacttaatttctcgacttcattctcaaatttaggagcatttgtaaccacaccaattggattatctgaaatgaccaatcgtccaccatgcggttcaatattaatcatttgtccgcttggatctgtcgcagaaaaatgtaaatcattacgtccaaagttgtagattgcattttcatcagtcatcaactgtacattatcaatattctgacgaacttcttcaattgaacggcaattccccagcaaccaaagcaaaagctcaaaagcagcaagttgaacttttcccttctctgcttctttagcgtaatctgactgatttgaaaaagttagcttttgtgccgccaaaccatattcatttacaccatctgaaatatcagcatgtaatctcatttcgctatttccgacgccaagtatagcatatggatttaccattttttgattgttataaacacttgtccattcataatttcttggtagaacaagggcagcggcattaaaagtatgccaatccattgttctagcaaaaaccaatccaccgtcacttgactttagttgaaaactggtacacatttttctccccttaattaatttgtcatctctttattttatcaaaagttttactgatagagatactagcagaactataaacttcaatcctatgacaaaaactaaaaaatgtacgaaaaaagtactgacagaaactgctagcatatccgtaagcaagcgaactcgcaacgattatcctatgacgcaattgtcagtactttcattcaacccataattataaaattatttgtacatttcaagcaatgcaaggaagctatcagcttcaagtgaagctccaccaacgagggcaccgtcgatgttttctttagccatcaatccttcgattgtttcaggtttaactgaaccaccgtattggatacgtacagcttctgaaacttcttttccgtaaagtttttcaactgttgaacgaacaacaccacaagtttcgtcagcgatttcgtttgttgcagttttaccagttccgattgcccagattggttcataagcaataaccaagtttgaaacttgttcagcactcaagccagcaagaccagcttcgatttgacctgaaacccactcagctgtttttccagcttcaaaagtttccaaagtttcaccacaacaaaggattggagttgctccagcagcgaagattgcttttgcttttttgttgatgtcttcgtcagtttcgtggaaatattcacgacgttcgctgtgaccgatgatgatgtattcaacaccaagatcaacgatagcagctgggctgttttcaccagtgaatgctccagcattttcaaagtagctattttcagcagcaagtttcaattctgaaccttgacgaaggtaagccataggagcgaggaaaagtgcaggtgcaccgataactgattcaactttatcagatgaaggcaagttattttttacagcttcaacaaaagcttgcgcttctgacaaagttttgttcattttccagttaccagcgataattggtttacgtgacattctaattctccttatagggcgtttaagcctcttaaattttggacttcagtccatcttttacaaggtctattttatcacattgtgaaaaaaattgcagaaatcaactcatcattaataaatttcaatcctgtcactttttttccaataattttatagcatcacgtgttttttccaacttgtcataactttctgtaaaatgctctgatacatacatataaaaaagaatgtcaacaacataaagctgagccatcaaactcattgttgcagcagtcctcatttgataatcttcaccagaaacagaatgaagaatacaatcagccatttgtcctaagcttgaatttccccgagaagtaattgcaatgatggggattttcatatttttcaccacgcctgcgagttccagaacttcttttgtttctcccttcattgaaattccaatgaagattgtttttttattagaaacagaaagagaggaaacaaataaatgggcatcttgaataaagataacttgcttgccaattcgactaaacttttgaaaaatgtcctgagcaaccattgaagatgctccaattccaaaaacaaagatattctcagcatcatcaattgaagacacagcttccataatttcatcatccaatagagcagaatttgtcgtctctaccatgtgatttacccggactttgagtttattcttgattgaagtaggcgtttctgaatcatttacttccttgtagtattcttcatcgtctacatgagcagcatacgaggcactcaatttttgtttaaactgagagaatccatcataacctaactttctggaaaatcttactaaagccgcagaggagctaccaatttctccagccacttcttgcgcactttttactagcattttctctccgacttcaaaaatatagtcagctatttttttctcaactgtcgtaaagctagaataattttgcctaatgataagtaaagtatccatttaacctctccgttcttctttaattataacaaagaggttggtataaaccaacctctaacttttatgctttaactgttataatctcttgacctttacttattttcccacaatggctgataatgatttctcgataagtatcagaatttgtgataaccacaggtgtaattatagataaacctgctgcttttatttttgaaagatctgctcttaccagtaaatctccttttttgacacgatcattttgcttaacgaaactttcaaaagcttcaccatttaagccaacagtatccattccaatatgaataagaatttcaacaccgtcatcactagtcaaaccaatcgcgtgcttagttggaaaaactgtagtaacaactccagcgacgggcgaaacgacatctccattatctggttcaatggctactcctttacccaacattccgcttgagaaaacttcatcctcaattgtagaaagttctttcacattcccctcaagtggtgatgcgattgttgaactagaaaattctggagttgtcacaacccgtaaagtaggttgaatagtttccatttggactgattttccataattatctgctttttcttttgcatctttaggaataccgaaaagataagtagcaataaatccaccaatataagcacccaatagtccaagaagataaacccaccatttaccattagcaataagtggaagtagtgcaagccctgaaggcccaatagcaatggctccagcttgacctaatgaaccgatgatcgcaccaccaatccccccaccgatacaggcagtgatgaatggacgaccaagtggtaaggtaatcccataaattaaaggttcaccaattcctaaaatccctactggtagagcaccttttacaagttcgacaaattctttatcttttctcaatcgaagccaaagcgcaatcgcagcaccaacttgaccagctccagccattgcaaggattggcaataattgtgttgagcccgttttagcaatcatttctaaatgaataggggttaagatttggtgtaaaccaaacataaccattggtaagaaaagtacacccaaaacaaagccagagaaaccaccaccaacttgaagaataaagttaattgccccgactaaacttgaagaaataactcccgctaccggcataatggcaaaaatctccgcaaaaccaatgaccaataaaccaatggttggtgtcacaataatatcaattgagtcaggaataaatttacgtagttgtttttctaaaatcgatagtaaccaaacagcgaaaattacgccaataattccaccttgtcctgccgaaagtgcacttccattaaagatattttttaatggcgcttctgggttcattcctgtgagcaaggaaaccgcaccgataactccaccaagcgaaggtgtcgctccaaattcttgagctgaattaattccgacatagatggctaagtaagaaaaaattccagattgaataatttttaagacggtaataaactgggtccatgttgctgcatctaaggtaccagcagtgactaagtttcctaaaacagaggctagcccaccaatcaaaccagcaccaacaaaagcaggaatcaatggaacgaatattttagaaatcgtattaagaaccgctttaaattttgaaggcttattatatttttctttagcttccgattttgtttttgccattaaatcatcaattgattgaccttcaacacttggaaaagtttctcctaaccttaccccaactgtctcaaccattgcttgagcaactttatttacagttccaggcccgatgacaacttgtagtgtttcatcttcaacaacacccatcactccatcaattgcctttaaacctgctaagttaacttttgaatcatcaataatggtcatccgaacacgagtcatgcaatgaatcaatttttttacattttgtgttccaccaacattttcataaatctctcgtgcaatacgagctattttttcttctgccatttttgctccttctcctaccttataaggtaaattcttaattcagagtatttttcacaaaaccatttgctctaacaagcttggtttttccttcttctgctgcacaatcagttaataacatgacaattgcaagtttaacatcttgattggcttcaatgaatttttcttcggcttcttcataagtacaatctgtcgcttgcataatgatgcgtttactacgcccaactaatttttcatttgttggtttaacatccaccatcaagttattataaactttaccaatcccaatcattgaaattgttgaaatcatattcaaaattaatttttgagctgttcccgattttaatcttgttgagcctgttaaaaattctggtccacaatcaacttcaattggaaattcggcatgttttgaaatttcagcattaagattgcaagaaaggcttgccgttttagcaccaatttctttagcgtaatctaaagctccaattacatatggagtccgaccactggcagcgattcctaaaacaaggtcgttctcattcaacttcaaatcaatcaaatcttgtcttccaagttcaagactatcctcagccccttcgacagcaaccgtcattgctttgtcaccaccggcaattaaaccaatcacttgtgtagctggtacgccaaaggttgggacacattcagcggcatcaagtacacctaaacgaccacttgttccagcacccatataaatcaaacggccacctttgttaaaagcttcaatcgctgatgaaattactggttcaatacttggaagtgcttcttcaactgcaaaagcaacttttttatcttcattattcattttaataagcgcttctgcgacagtcatttggtcaaggttaaaagtttcgttatttcgtcgttctgttgttagtgttgataaatcaatcattatttttctctttttctattttaaatttttgtcctgggccaataaaagaaataagttctaaatcttctttaataatatttcccacaacatttacttttttatctgctggcaaattccttttagtaatttgaatttcgcccatataacgaccatattcaaaattatcaatagtaattgagcctttttttctctcaattgtattttctggacttatttcagaaatttcattgaagcgggcctgagcgctgcggaccacatctctagcatcatcttgtctattttcatgctcaccgaggactttagcaaaatcacttgttgcttgggttgcttgcaatacaagttccccctcttgaagatattggttaatctgccaagctgttcttgcttttaagcctccatccccgacataaatatgatctatatttatagattccatatcaagtaaggaagagagtggatgttgatagcggtgcgcttcaagggttggtaatccttcatataaaggatggcgtagagaatcatctcccggaataaaggccataactttaaatgaatttcttttcaaaaattcattttttctaagaaagctctcccgagaaaggcctgtttctggtcttgggtaatagttgtgccaggcttcaagctgattaaagtttgccttgttttcttttaactcatcaatatcttcttgcctgattgtactggcatttagactgacagtcattttttgactaacttgcgcaattgtctcattgctgatatgataatccattctgagaccagttactccaagttcttgaagttcttctactctatcaatagaaaatccagctttttctaaagcttgacctgaaatatcaaccataagtttcaaatgattctttttagcagctgttcctaagtctattagcctttttttatatagacttgcttcatcctcgggaatatgcatcgatgtgaaaatccctttaaaaccatgattagtcatcttgtcaatatataaatagtccttttcattcaagtccctattcataaaaattgaataaccgtacattttttatccttccgaaatattatttcttgataacgtattcattataacctaaaagaattattatttcaagtatcaatttaatctttttttattttgaaatattatttcattgttttgtataataaaaagaataaatttctttattctttttattatatttacaaagtacatttttctttaattgaatcaaaattctctttaagaagaaccgttgaagctttaaatttttcttgctcatcttgagttaattctaactctaggaccgctcgaacacctgttctatctataattgcaggacttcctgtatatagattggactggccatactctcctgtcaaataggcagaaactggtagaatcacgctttcatttctaaaaattgctcttgtcaaacgagctaatgaagcagcgattccgtaagaggtatttcccttttgcataaagatatccaagcctacttcacggatttcttggtcaatttcatcgaaagttggaaactctggattaggatattttttgagccacgttgttaatggaatcgcaccgactgtcacatttgaccaagcggcaaaacttgatttcccatgctcagctaaaacatatccatgaatacttttaggattaatttggagtttttcagcaacgatttggcgcatccgactagtttctaaaagcgttcctgttcctatcactcgatgtttaggcaagccagatacttctgcaacaacttgggcaaggacatcaactggatttgatgcgaccaagaaaataccatcaaaacctgcatccattgttttacgagttatatcacgaatcatttcgacattattttctaataactgtaggcgatctggattttttccgaaagttgctgatggagcattggcagacaaaacaacaatatctgcatcagaaacatctgaataatcagcagcataaatgtttttaggtgctgcatttaaatagggaagcgcatgaagcaagtctaaactgttggctgaagctttacttttgttggtatttattattgcaatttcatctgctaaatcatcaacaactaagttatgagcataagtactcccgacggctccagctccaacaattacaacttttttgttatttattttcatatcttttcatcataaaaaaacagcggatgtcattttgactcacgttgtttttctactccctttccaaatctcttttcccaatttacttacagtttatttacgctttgaaatcacgagcaatttgctcatcttctttcatttgtttaattaattgatctatcccatcaaatttaatcatatcgcgaattttatctagccataaaacagtcaatttttcaccataaatttctccattaaaatcaaaaatatgaacttcaactgttttttcagtcccgttaaaagtatcattatatccaattgaagcaaagccacgatgacgttctccagcaaaaatgacatcacaggtataaactccaacagctggcaaatgaacgtaatctttaattactagatttgctgttggatagcccagttgtcttccgcgggcaaaaccatgaacaacaaggcctcttgtttcataagaataacctaaaagttcatttgcttgtgcaatatcaccttcttcaactgcttttctaatccgtgtcgatgaaatttttccatgttcatccgctttttccggcatgatgaccacacggtagtcttccgttgacttgagatttttcatatcagaacctgtcgtataatcaaatcctgtaatcaccactttgggattaaatcttttgacgacactttctgcgaattcagttgaagtttgatgagcaaaattagaagtgaaatctttaaatacaaggtaatctaccccattttcagcaaagagctctgctcgtttttcatctgaagttaatttcaaaagcatttcaggttcaaatttgttgaaggttaatgtcggtttttccggaaaggtaaaaacagctatttttaaattcaataccgccgcaatttttttagcttctgtaaaaagactttgatgtcctctgtgtaatccatcaaaataaccgaggacaaggataagttcttcatcaaattttagttcatcattaaattctaatatttccatttttctcactttggctcatattgctaagaattaaaccaatactttatttggtttccaaattcctgctttttctggatgtttcatgtaaacagcaactaatttatcatcataaaaggctgcaaatttatctcttgtcagttttgacaagtctgtcagtaaaaattcacttttattagacttactgacagggctgtcagtagtttcatctgtaacccaatcatcctcagcaaatttttttccaactcgtgccatttcaaactgatcagcagtcaaatttactcttggcaaatcactgacagcatattctgctgggtacattaagctagaaagctctcctgcctccattgctgcttcaatctctgagagtttgacggcatctttaatcatcagtccattacttgctgttctttgcaattttgacatatgtcctacataaccaagttgctctgctaaatctactgctaatgttcggatataggttcctttactacactcaactttgaaagaaaaacttaccaaacctgccgtttcatcagtcatcacgggacttgttctgacaaatgatttgattgtaatttctcttgccggacggtcaactgtctgaccagctctggcatattcatacaatttttttccgttaatttttacggctgaatacattggaggaatttgctttatttttccaataaaatttttcattactgagtcaatttcagactctgtcagctcccgttctactggcgttttactaacaatttccccgtcagcatcttcggtttccgttgaaaaaccaatagtaacttcaccttcgtaaattttacctgccgcttccatgtattctaataaccgcgtcgattttccaacggccactggtaaaacgcctgtcacagaagggtctaaagttccaccatgtccaattttttttgtttttaaaataccacgaagtttggcaacaacatcaaaagatgtccagcccgcttctttatagacatttaaaatgccatttaaattttcattcatcctgaaaattatagcattttttgactaaaaaatcacttacagtctttatgattggtcctttccataaaaaaattactgacagaatgtcaataatttctctgactaaaaaagactgaccaaagtcaatcttttattatacttaatttcccgttggaacttttgtggcgtttattgatttgatttgtgaactaccactattgagcgaagcatccgaaccatatttagctacaagttgcgcacctgtcagtgtttctttagtttgccattgaaccattggccatggatcctgtgccattcttaaacctgtctgcgttggatcaggaacttgtaaataataggttccatcagcattttgttgaatacgtgctgtattttgtataacattgacagggtcagaatacgtggatacgccatttgaacctacattaacaagataagttaagtaagattctccagtataaatatcaaatttgccttgagcattattaacccattgggcataaactgcatcttgctgctttccagttagagttgaccagctttttggagagtcattacttgaagatgccgaagtctttgaactacttgaagcggaagttgattcttgagttgaatcactcgttgtactagagctttgtgatttactacttgtgctcttacttacttttgtcgagcttgtttgtgcaaaagaggctgacttatcaggagttttatgaggataaaaaacttgataagcaatgattccgagagcaactactaaaatgactgccaaactggcaattgcaattacttttttgctgttttttgaactcgcttttgaatgttttgccataaaaagcctccttaataaagcttgaaaaatactttttcataattaaattatacttaattttcttatctatttcaaagaatttacctttaatcaatcttaataatacaaaaagttactgacaaatagtccgtcagtaacttttattctcaataactacttattaataaatattaattgcttgttttagcataggccgcagattgagttccagcttgtcgtccaaagataacaatatcagcaacagcgttaccaccaatacggttaccaccatggagaccacctgtaacttctccggcagcatataatccttgaattggattaccatcttttttcaagacttgagtatttgtattaatttttaccccagccattgtatggtgaattcctggtgccactttaatggcataatacttacctgatatttcagtagtcattcctgttgtacgaccaaagtcttcatcttttttagctgatacagctttgttccaatcatcaattgttgaagtcagcgttttttcattaatatcgagcttgtcagcaagttccttgatactgtcagcttcaacgaccatatctttagacatatactgttcaaccgcttttactttatctttagttccttctccaaaaataacataagaatattttcctggttgtttaagttcagcagcagaaactttatcacgagtatccatttcattaaagaaacgttttcctttttgatttacaagaatcgccccttcaccacgaattgattctgaaacaagataacctgttttttggaatacagttggatgaatttgaattttatccatgtcaactaattgcccaccaagttcagaaatcatagtaattccgtcaccagttgaaccagcggcatttgttgtcacataatctttaaggtcaggacgatattttgcaatcattttcttatttgcaccgaatccacctgttgtaacaacgactgctttagaagaaatatctttagtttcaccctcaatcttaactttaactccagatactttaccatctttttcagtaattttggtaacatcactatttacaaataagggaatatttcgtttggtaatattttcttcaagaccttttaccaaataaccaccaactgctgaaccatcatgtggtcggtgagttcttgaaactgacatccctcctgtcgtagttaaattatctaaaacaatcccatttgtatttaaccaatcaacagcaccagccgagtggtcaacaaaataacgaaggagtgccttgtcattcgtaccgccaccacctttgagcgtttcttcataaaatttatcatttgaatcggcgacaccttgtgctttttcgactgatgtttctgacgcgttcaaaccagctgaggcttttgaagtatttccaccagcgattggcattttttctaaaatgactggattcattccagcatcttttgcttcaattgctgcagtcattccagctccaccagaaccaacaataatcacatcgtatttatcacttaaagtagaagggtcagcatagatgtttgatttacttgcaccagccgaggtttcaactttctgagacgaacttgattgtccttttgtattctttgtattacttccacaagaagtcaaagagaggcccacaagcgttagcaagcctagtttagtccaaattttcataaattactccttttgtgttaaaattcacatagttattataacaaatttttagcaactttccaaatatctataaaatttttagctgtcattaaaaatatttttagaataaatcacaaaaagtactgacagaatcgtcagtactttccatttttacttataaagatttatgagttcgattgtaacttagaataaggctgagcatgtagcatccaacgcactccgtatttgtcagtaaaatcacccatttttccaccccagaattgattttcaaaaggtaaattaacagtgactgtccctgattcaacagccttgtcccaaaaagcatctgcttgtgagaccgcttgttcgtcttccgaatctaaatcaattaaaattgaaatagaatcataaacaagaggatcaactttcataaaattgtccgcagccataatggttgaacctagaatgtcaaattgagagtgcattgttaaatcggaagccttctcgattggaactccaaattgttcagcttgttcttcagccagaggcattcgtgaaatatttgtcgctccaagaacatctttataataatctaatgcttccttcgtattattaaaagtaagataagggtgaatattagccatagtaagctccttttctgataaaattttatagtaattacaactttaatactataaccagtttaccacaagaaagcgcttcaatccattaattctgcttgtctataacaataatctgcgtggtcattaatcactcctacagcttgcaagaaagcatagataaccgttgaacctgtaaatttaaaaccacgtttcttcatatctttactcattttgtcagaaagttcatttgttgctggaatttctgactcatcattaactcgatgctgtaaaacttttccgtcagtaaacgaccagatgtacttattaaaggagccaaattctttttgaatttctaaaactttttgagcattaacaatcgccgctttaacctttaatttatttctgataattcccgcattttgtaaaagttcttgttctttattctcgtcatatactgctactttttcaatttcaaaattatcaaaagcttcataaaaattttcttgtttatttaatattgttgcccaagaaagccctgcttgatttaaatcaaggaccaattttgcaaaaagttcctgatcattatgtaaagggactccccaataagtatcatgataatgaatcattttatcagttgacaaacaccaattacatcttcttaattcagtcatttcctacctcaatccaatcactttacataatagttattatgcaaaatcaataaaatttcttttcccaatgctctccatcaatctcataaacaaattctgagtaagttgagtgaagcatcatgtctgccatttcaagaaaactacttgcaagattcaaatttgctaattgattaatatcttgccagaaaactttaccttcatccgtttcattaattaattgaccagagaattctgttgttgaataaagaaaaaccatatatcttctgttcttctcaggttcaaaccaatccttaactccacaaagttttaaatttgtgatatcaagtccagtttcttccttaatctctcttattgttgacggaacaagagcctcacctttttccagatgtcctccgggaaaagcaattccagtccatgattttttacgctcttgaacaagaactttatgatttttttcgtcaataatggcacacatatttgtcaattcgacttgttctaactcatgataagtcattattttttcactactttttctattttttctcaattggagccattgctgctaataaacgtttcattccgacttctgggaaattaatcttgagttccatatttttaccagaaccagaaattcctaataccataccttcgccccatttacggtgaatcgctgtatcgccaatttgccaatcttctgtttcagaattattaatcgtcgcttgagctgcagttggattaatgactgcttttctttgatggagcgcatctgacatcgaaatcccactggcaaaaccaccagatttataagaagcattaaagcttgaatttgctttacgagcaatcccagcatattctagtaattcatcatcaatttccgaaataaaacggctgggacgattataattcgttttaccataaagcacacgttgattggcattcattaagtagagcgtttcttctgcccgtgtaattccaacataagccaaacgtcgttcttcttctaactcatcaatatcttcatttacccgtgataaaggaaaaatgttttcttccattccaattaagaaaacaattggaaattccaaaccttttgccgcatgcagggtcatcattgttacttggtcagattcttcctcataagcatctgtttcagaaagcaaactaacttcgttaaggaaacggctcaacttatctaaaccagtttcaataattggctctcctgtttcttcatctagaggaatttctgatttttcatcaaatcctttagttactgacaagaattcttcaatattttcaattcgtgcttgattttcgatacttggcatcatttgcaaagctttgacatagccagtacgctctaacatttcttcaactaattctgtgattgttgaactttcactatgtgttctcaacaaatcaaaggccattgccaaattataaatctcaccagccgcttttccacgaatatcggataacataatatcaaaacttgaatctgctaaagaaagtccacgactgtcagcaaaacgacgtaatttttctaatgcccccggaccgactcctcgtttaggttcattaacaattcgttcaaaactcatattatctgctggatttgctactacgtttaaataagcaataacatcacgaatttccttacgtgagtagaatttcgttcccgcaaccattgtataaggaatattagatttaacaaaagaatcttcaattgtccgagactgagcattagtccgataaagcacagcatagtcagcataagaacgtcctgaacgaacacctgatgtgataatttcagaaaccttatttgcttcttcttgttcatttccagcacgaaaataaacaatcttatctccagcatcattttgcgtccagagctcttttggtcgacgttttaaattattttttataacattgtttgccgcatcaagaattgtttttgttgagcggtaattttcttcgagcaaaacaactttagcttttggataatctttttcaaagtctaagatattttgcatatctgctccgcgccaaccatagattgattggtcagcatccccaacgacacagatattttgaaaacgactggctaaaagtttaaccaactgatattgtgcatggttggtatcttgatactcatcaacatgaatatattgaaatttcccttgatagtaagaaaggacatccgggttttcatcaaaaaggcgcaacgtctgcatgattaaatcgtcaaaatccattgattctgcttttcgtaattctttttggtaaatcttataaacacgcgcaacaaccatttcgtatggatgtctagcgcttgtttgagcttcataagctgattcatctaataaatcatttttagcatttgaaatcgcatttaaaagccctttgggttcccattttttaggatctaaattagcttctttcaaaattcgtttcatcaacgatttttggtcccctggatctataattgtaaaattacgattataaccaatatggtcagcatcacgtctcaaaattcttacacacattgagtgaaaggtcgcaattaatgtatcttgtgctcttggagtaagtgataaagcacgctcccgcatttcttttgctgctttatttgtaaaggtaatcgctaaaatattccaaggattaaccattttttcatcaattaagtaagcaattcgatgagttaagacacgagtcttacccgaaccagctcctgccataatcaataaaggcccttctgtagtttggaccgcttctgcttgtttttcgttcattccttgtaatagtggattcattttattctcctagctgcaaatcattattaattatatcataagtaaatcacttaatgcgagtttccttttttcttcaccatgcttataaagtatcaaaatagcccccactcataaaacattaatgatataataaaaggaaaaggaaaaaattaaatgatttttttatcaactgtactaattttatgctgtctttggtatttttttaagtttttagcccatttttctcctaaaattcatgatgaagttcgtaaattatccgtctacacccaattttttcaaaatggcttcagtcagcgcctgcaacatttacctatactgccattttttgcgcttttacactagttcaaagaactgcaccacaacacctgattaatattttaacgaatcattcttcaacaagtatagctcgggtatctgataagccaatttctactttttttgatagtgctttttgggttgcggataatggagcaggtctcctcatttatgtagccattttttggacgattattgcttgggcagaacgaaaatatggttcaccaagaatgattgtcattacattatccggtcatattttagccagtcttactactatttttcttgaactttgggcaattaatagcggacgtgcgcccagttctttagcaatggcaactgatgttggtgtttcatatattatggttgctggatgtgctgctgctattctcttgatgaaaaaatggctacactatattggtttagtagccattggtcttttcattttgcttcctttatttattgatcacagcatttgggacacaggacatttatttgcaactatctttggctttatctctgctagattactccttaaattatcaccagtgcgtacggtcagttctccttacgaacttcttttgaagtgccgttcagaactctccaacaaataaatactaaccatataccaccaagcaccccattaatctgctgaccaagagggcctactaactgaggaattgcacccgcaatgaaagaaagtaaagttgtaattacaaaagcaatgaccaaaaggaaaacaaatttatttcgataaactaaaagtgaaaaaatcactcctgtaagaataaataataaggctaaaacgcttaatccgtcgtgtaaaaagagttcaggtgctttaaatggattgggaattccctcactgtgagcaatatcagcatatggaaacattgtagctaatcctgttgctgcaccaaatcccgcaatcgaaagaaaaattatgagaagacgtttgtcttctctttcattttgtttaaaaagtccccacgcaagtatcaaagaaaaacaagcgaaaagaatatctgttaaggtgaataattgatgataaggttgattaagtgcagaaagtccactcaatagacttgagttaactactgttggatttaaccaaaatgcaagaatccaagcattgtacaataaggcagcacaaatagcaataatgattaagtaattactttttttcattttctgaatctactcctaaatcagctgcttcagttggtaaatagaactctgccattgcaaaagcaggcaaaccataactgagtgctctttttaactctggcaaagcatcttcattagctttagggtctggaaaaacttctgataaatccattagaatttcatcttcaagtagattactaagaaggttctttaaggattcaattgagtgataagcccataaaactgttacttttgaattctgaatagaaaagaccttatcatatcccgcagccaatgccaaataatcctgcttatctacttcaacaaatctgtttgatagcaaatctcttctaattcttgataaatattctgttcgttcaataaattttgtatggcctattttttcgatatctgttagttctcttagtgttttagaaagcattttccatgagttaacccgtagactcaattcacctgtttgcgtgcgcatcagatttcctttaaccaatactctatcaccaacggtcacatcttttttccatattgcaaaattttctaaacgattttctaattcagcatattcattaagagtgtcacgttttataaccaattgaatttttgcttgattatctgccaaatctgcaaattgcattgcgcctcggccacgcaaactaattaacttcccatgaatgctatattctttttcatcaaattcatcaactgattcaaatttatttctaagagtttctactgattcggtttcgctatcgggaagactaaatggtggaataccattttctctaagatcatttaatttttttagataactgtcatcatgaccagcttcattcaataattccaatcgcttattttcttcaagtcgatgaacctttttgatgaaatctgattttttccaccagcgattttctgttctagggtcataatctcgtgaaaagaaacttttgattttagaaaagatattcgtcggaacaaatccttcagcttggccaattgcaaaaagaacggaagtaagagaaccgccattatcataacaaatataacgagttcgccattctggcaagtaaatatcatttgaacgataaagtgattccaattggtaccaacgtgaaaagaatttcattacagttcgtgccgctttatctaaggcattcgcttgcaatgtttctccgttaatgaagaattgccgtgctgccgcaaagtttaaactaatttcgcttatctctttttctttagctgcttctatcaaactgctaatcatgaaagtgacagctccattcattgcctcaggagaacgtctcatcgtatcaagcgacagtttatctgaccccaccggaacaaaggataaaattccttgaacttttccagcagcatcggatgctgttacaatcattatttgttggtctgttggatcaccaaatcgacttgaggccattgaataaccacgttcatcaccatttcgccattgttctgttaatttggttaaatcactaagttctgtagcaggaatttcagcctggcgacgaatcttgacttgatagttttctctttttgcacgacgcataacttgtgcaacatcatgcatggctggattttcaatagaaaagtcacgaacgataacgaccgcttcatccccgaatacagttgcgttcagacctaattgagcgtacatttttgctcctgcttcagaggagccaataacgcctggtgtccagccctgtgctcgtgcaaggttgagaaatgcttctcccgcacttttccatgatttttcatctccgattgggtcgccgctggctaacaaaacatctccaaaaagatgataagtgatggcagcttttttatttttagaaaagatagcttttttatctctgcgagtcgcaaagtaagcaagcgagtcatcatcaccataatctagaattagctgacggattgctaattcttgttttgcatttgccgaaagttctttttgagtagagcgcgtaaaaatgagaaatgcgctgataaaaccaagaagcattatgactgaaattgtagtactgacccaaatattatttccagagctgtacgggaaaatttcctgaccaaaaggaagaaggtaacggaaatcactgacagattctctaaaaacgtaagcaattctttgagctaaggatacagaaccatggaaagttaaaaatgaaacaattactccgccaataatagagcagacaaatcctacagccgcaataattatacctttccaccaagtgccattcacaatttttgttggaaaggcatttcgagataaaatcattaatacagctgtcgcaagagaaacaactactccgagaataacaaataaaagtgagaagatagaaaattgtgacatgtctagtgcttctttggtcacaaatccaaagaaataggccaataagaaaataagaccaaatgcaacaaaagctaattggaaatagataatttctatccaaagggctaatcttctccggtgtcgaattgagcttgctaaaataaatagaacaattgcattaaaaatactaaaatcggtaggaagggcaaaaagatagaggaaaccagataatagtttttgaacaggaggcatcaaccagccaagaatcccaactattaaagcgtaaattgaggcaaattgtaataaatgcccaagaagttttgcagacttatcctgccatggttttactcgttttaatctttgttttaccttatcttgcttaactttagctgattttttatttttcataacttccttctatcaaataacttttatccaaaaataattaatatatgtcgttatcatatcattttttcaataatttttcatccatttttatatttggaggataatcaaaaaccttgattatttacaaggttttttcatctatcgtattctctattgaatcgcatccataaagaaattcattaattttcatcaagagcagggggatattacgatttacaaaatctccatgcattttcccaccatagggctgataatcaaattgttcatctgtcaacttcatacgataagttttaagtgctaacttccaagtttttaattgaataataaatggataagtaatcggaacttgagggcttgttattacttgtattttttcagctgataaatttgttttttccaataattgattgagcttatctacgaatgaaacaggaatacaatcaaacattaattgaacatcagcagattgcaaccagggactacgatctacgacagggtccattgatacaagtgcataatttccaagtaatccatgataaagtgcacccatacccccacgggaagaaccagcacatagtatattctctctaagtattccttcttctttggctgtttttgcgattaattcctgaatattttgttcataatctctaaaattgggagtgttgagataataagaaccattaattaaattactatcggcaattcttaataccgctgtatttttagcaatagagcctgtaattccttcaaaaggattaggaaagaagttttcccgagcattcccgtgattgtagctcaatagtcctgggaaccaaaccaaaagttttttagtaaaaaaatcaggctggttttgcgaaagctctaaatcataaaaaactcctttatattgctttaatccaatttctaaatcttttctcttaacagcataagcccgaccggcataataaccgtcaatggttttatcttctaaaagaagctgacgtagtttttcatttgccactgaccctgtttgcatacatgctgcaattaaatcattttcaatcgggcaaaggctatcaaaataatcataaccgattaaatcagtagcaatcaaagcaacttgaaagtgttccattcctggacgaagcaaatgacttttttgcattttttctatctgaccttcaaaaatacaagtgacatgcccttgactatctaaaattaatagccgctcattttcaattttccatgtttgttcaaagtcactatgcattccttttatcttaccgtcaggttcaaatgaccagattccccattttgtatagcttggcaattgacaaaaataaaatatttttcccagtaaaaaattatataattcttcattcattttgtttttccctttttgtttaatttatgatgactgttgcatttacttttacgatttgtcctgtaatgtctgtgaaattaaattgaatattgtagttgccaggataatcggtagcccaatgagtttgtccatcaacaattatagttggaacaaggtaatggatagaagacagagggacttgagttccattactatacttagcattcactatggcattatacatcactttttcataatttccactgccagaagctgcactaacggttgtggtaagtaaaattggactaacagtagttaccaatactgttgaagtaattatatcccccgtgtttgggtctttaaaattgaaattaacattatgaactccagtataatctgttgcccaataactcaatccatcgacagttatagtggggacacaaaagtctatttctgattgcggaactaaactaccatcactataaactgcattcacaatggaattatacataatattttggtagtttccactaccagaaatcgttgtaatcggctgagtagttaaggttggattaatcatcgatttattcattaacgttaatttccgaacattaccagtatgataatataaaggttgatttgttaatgtatttattccaatcttatcctgaataggaagtttatccatacctataagccctctccaacgtatatcattatcggcccacgtatcatcagcaatgtaccattgtccatttacttgaacctcattccactcgtgtcccccatttccaaaggaaaggtaaaaaccatcagtaggtacatttccattattaatttctgtcactgctggaattccagcatagatataaccaagttctgaaagcatcgaatactgcatgcaatcacctttgccagataaaaaagcactaaacgcttgaccataatattggtcatggtcattgctaacaatttcatttaaacgtgcaccagatataatattatttgcttccgtgccatcttgttctgcacctgcaagatcataagtcattaaatcatcaacgtaatcttctattgcttctattttgtcaaaatcagtattttttccttccaatacgttactgaaaccttccataagagaggttgctgatttcaattcattttcgctgtagttatagtttttatatccgccagttaaaatataatttttttcttctctggcttcaaagccttttgtcatatatgatatgtcatgtgcataaaaagccattagtatatttccattatagttatcataaacagcgttattatcagagtcctcatctacaatcgcgttcttatttaatgtattttctatttcacttataggtagtgacgacgacggtaaagaaacagaagtaaccttaacttcctgactgattgaagctttggtataagggtcaacaaaagaataagttaccgagtatatacccggtttatctgtaacccaattaccataagcatcagttgatatactatactttatcggcccgttgtaataatctactccctctactcggttccccttagagtctatggcagttacaactgcttctttagcgtgtttataaaagtcaccactaacagcatatacagttaggttcttagtaactagtgttgggacgctatcagcactaactctgttttcttgagaaaacatagctataagcataaacgaacatataaataataaccctgtaaatgaataagtaatctttaatttacaaataaatttcataagtttccttttgtttactttatttactaagataattatactatcatcttccttcttttgcaatcgctatcttaaataaaaaaacttcgtataataacgaagttcttaaatcagaaatttttaatttgattatatttggtttcaaatgcatttttcatggtatcagttgctttatcataagatgtcttatctacaaaagttccatgtacaatgattctatgagtcgcttcagcatcagcacaggttactaaagtgatttcttttttacctggactatcattgattacttcaacatgttctggcgtcactacatcaatcttatcaattttatactgataaatattatctttatcagtcacataaatcgtcattcctgcttttgctttctctaacggagtgaataagatagataagtcagaagtaaatccagtcatattatgaccagccaaactatagttaccttcacccatgacttcgtcagctttcattgttcccgctccatataaaagtgaagtatttccaacccctttaaagatgggaagattgatatttaattcgggaattgcaataccaccaattacaggtagaggttgactattaaactggttagtaaggactgattgaaaatctactgattttaccgcagcaaaatcaaaacttacatcagcttttttatttttttctatcttttcttgtgaaacattatgaagttgatatttattactatttgttgcaatcaacatgttacgaattggcttattaaaaattaagactaatcctactataaatagaagaacaataaatgtatttaacagccagttatattttcctcttttagtttttttacgctctgccatttttgcccaccttgtctttttgtgtactctttttattcattgtaccatgctttaagttctgagtcaaaagttttaattgttttacaaaaaaatcttgcgcatagcaagatttaaacaattattttaagtttgtaatattaccaacttcaaatgtttttttatctgaaagctggaatttgtctttcagtccaggtgtaatataaaccttattatctttatcaacaaatacagcctcaacatttttcaacttttcaacgtattcgtaaccttttttggttcccatagcgtatatcattgttgacaaaccatcaccattggtcttatcttttcctgaaattaacaaggtgatactggcaatatcattctcaaaaggatagcctgtcttaggatttaaaatatgactgtatttatgcccatcaacttctaaatatctctcgtaaattcctgaagtattgacgtgctcattagaagctttaataatccccatttgagtcccagttggatcatttggattcttaattccgattgtccacggactgtcagcacccctcggtgaatgaccaatcacataaatcgaactagaacccaagttgacaatccctgtggtaacaccatcttttttgagtgaatcaaccattttcatggcaacaaaccctttgacaatggaacccaagtccaaacgagcgcctttttgtgtcagataaattgtttcatttttatcatcaaattttatgtcatgataattaattaaaggcaaaacttgatcaatttctgattgagcaggctttctagcgttatccattccaatattccaaagacttgtcagtgaaccaattgtaatatcataacctaaatctttagctgaatagttataaccagctttaactaattcatatacatttgaattcaccttgataggtttaattcctgcattttgattaatctcatcaatttgtgaacctgattgattaacggttgttaaattattgtattcaacaggaagttttagagccttttcaactgcagcttcttttcctttgtcataaacagtgactttaatgtaagttcccattgtcgtcacgtctttattaattggtgacgttaataaattacgattatctttttgactagattttccattagcgcaagcacttaagctaattaaactaagtgctgctagaacccaaattattatttttttcattctctaatttttactgactgagctgtcagcaccatcttattcagtcagaaagtctgtcagtaactggcagactttcttttcaattattcttcgttattgtcagtagaaattgtttcatcagtaagttctggcgcatcaacttcttcatcttcaatgaccggatctacaagtgcaaaggttacaatttgtgcttcatcatcaagtcgcattactttaaccccttgggcagctcgaccagtttgagaaatgttagccacatttgtacggataataacccctgtatctgtaataaccatcaaatcttcgtcaccattgacagcagttaaaccagctaatttaccagttctttctgtgacattcatgactttcatccctttaccaccacggccttttgttggatattccgaagcctgagttcgtttaccaagaccattttctgagataacaaggacttcttgactgtcatcaattcgtgaagttccgacaacatagtcgccttctctgaggttaacccctttaacaccggctgctgcacgtcccatatcacgaacaactgcacctttaaagcgaactgagtatcccaaatgagttccgataatcacctcatcttcacccgaagttctaagcacattaatcagttcatcaccatctcggagtttcaaagccttcaaaccatttgtccgaatattgctaaattgactggttgaagttcgtttaacaattccgttgcgtgttgtgaaaaagagatatttcgccgcttggtcacggtcaacattgatgattgttgcaattttttcaccgtcatcaagcttgaggagattgacaattggcaatccttttgctgtccgaccgtattcaggaatttcatatcctttcattcggtaaacacgtccaagatttgtaaagaagagtaaatgatcatgtgttgatgtagataccaaatgttgaacaaagtcatcatcagacattcccattccttgaacaccacgtccaccacgattttgggcacggaattcgtcattagctagacgtttgatatatcctttatttgataaagtaatcaatacatcttcttcctcaatcaaatcttcatcttcaagagtaagaacttcaccaactaacaattctgttcgacgtttgtcagcaaatttacgtttaacttcttctaattcttcacgaataattttcttaacacgttcaggttttgccaaaatatcggctaagtcagcaatcaaagcgactaaatcttgatattctgcctcaattttatcacgttccaatccggtcaaacgacgcaaacgcatgtcaagaatagcttgcgattgtttttcagagaggaggaattcatccatcattgttttttgtgcaatggcatccgtttgtgattcacggataattgtaatgatacggtcaatattgtcaagagcgatacgtaaaccttccaagatatgtgcgcgtgcttctgcacgtgctttatcaaaggctgtacgacgttcaacaacttctatttgatgttcaatataatcaactaagatttctttcaaagaaagaattttaggaattcctttttcgatagccaacatattgaaaccaaatgaagtttgcaaacttgttagtttgaacagattgtttaagataacatgtgctgataagtcacgacgaacttcgataaccacgcgaattccttcacggttggattcatcacgaaccgcagtcaatccttcaattcgtttttcatggttcaaacgaacgatatgttcaaccaaacgcgctttattgaccatatatggtagttcagtcacaacaatacgttctttcccaccagccatttcttcaatgtgggtttttgcacgtaatgtaattgaacctttaccagtttcataagcacggcgaataccagatttacccataaccaaagcccctgttgggaagtcaggtccaggaatcacagacattaaatcagtaactgatgcttctggattttccatgagcatatctactgcatcaattgtttcacccagattatgtggtggaatgtttgttgccatcccaacggcaatccctgtggttccattaactaaaaggtttggaaaacgagcaggtaaaacgagcggttcacgttcagtaccatcgaaattgtccatgaaatcaacggtatttttgttgatatcacgcaacatttccatggcaattttacttaaacgagcttcggtataacgcatcgctgcggcaccgtctccgtccattgaaccaaagttaccgtgtccgtcagcaagcatatgacgataagaccaccattgagccatacgtaccattgcttcatagattgaactatccccgtgtgggtgatatttacccataacttcaccgacaatacgtgccgattttttatgtggtttatctggagtatttccaagttcattcattccgtagagaatacgacggtgaacgggttttaaaccatcacgtacatcaggaagtgcccttgcaacgataactgacattgcatagtcacgaaatgacgtcttcatctcctcaactaaattgacattgataacatttttgtcttgcatgtttgccttgtaaaatctcattaaaataaaattttactttcctttcttgctttcggaagagtttgccccaattgacaaacagattatctaaattataccaaattttgcacgaaaagtcagcttttctcatagatatagactagtttttacaattaatccttagatatttttaagaatacttatccttttgttttattctaaaatatacatcaaaaaaaccctgaaaaaatcagggataatctggctttattccacattgagcgaatttaaatcaagaccatttgttttgcgttgttcacgacgggcaatgaaaggtaaaagcataccaagtaaaattaagataattggtgtcaaaatattcgatgcaagttggaaccaccatgcagatggattagcagcatagtccaattttggaaccatccctaacacgcaggcgatgagtgtaaagaggaaacaccaagcaccagcaatcatggctagacgtttttgtttgataaatttatattcagattggaaatgtttcactgcccgatttaacataatgaaggcaaagaagacccaaagataacgcattggcatcacaactgaatttaaattagtcaaccatttgaccaattcattcacatctccgattccaagtaatggtaaaagaataatgatacttacaagaatccctgttaatgtataaccatttttaagcgttcctttgttcgtttttttacgcaaccatgctggaacgaattctgggtcagcatcagcaagtaaaatgcgtaatggcgcatcaatagagaaagctaaggcagcaatttgtcctacaccgttagttaaagcataaacaatcattaaaaagtttccgacaccaaagtgttgacctaaaatttggaatgctgcatatgcaccgttagccatcaagtcatttggtaaattaccgcttgagaaaatcattcccatggcaatcgaacctaagacggcacagataccaaccattccagcaagtaaaaacatgcctcttggaaattcttttgctgggtttttcgtttgattaacataaggagaaattttttcagcaccaccgacagcgaaaactagcattgagatagttgtgaaataactgaagtcaaatttagggatataagttttagtatttcccatgtcaggcgttgcaatatgaaaatctttcgcgataaaaggtgctccaatcgccatgacaatgaaaagtaaactcataacaaacattgctgttcccgcaagtccaccaatcactttcagagtatttaacccttttgttgacaaccataagaaagctaagaaaattgctaaggaagccagagcaacagcggtcattgacatctgattaaccagatttccgtttccttgacccacccaaccaaaagcaatcaaaatcgcttgtggtttttgagccaaataaggaatgtgaactacccaataagtccatgcggcataataagccaagcgtttcgtactggtattttcaacccatgaactgatcccacctttactatctttaaaagttgaacccagttgaccaacaataagtgcatagggaataaagtacaaagccaaaattaacagccatgaggtaacaacagtaattccttgttgggcaaagttattgacaacattccccatcccccaaaccatgttaaaggcaatgaatgcgacggtaaaccatctaatttttttgtgtccataaaactccttaaatttttttgaataaatcgcggacattgacaatttattgtttagcgctttcttttaagcgtcattaaaattataaaatattacagactctcctgtcaattttttactgtaatcaaaaaagatacttaaatttttaagtatcttttaaatattaagaaaagtttaaagactttcaagagcttctttaatcgccgtttttccattgtgcattgaaatgacttttccaattgaatgatcggtcatcactaattctttgatagtatctgccacatctcctattgtgttacttgcagaaacctcatcattaatatcaatcaatcctgtcgcctcttcccctgttaatgctccaggttgaatgattgtataatctaaatttgtttctttagtaagatataaatcagcaaaatgtttagcaatataataatcttttaatgcatcaaagccggcaccaatccatttttctggttgaagagaaaaaatcgtacttagtaagataaatcgtttaacttctgctttctcagctgcctgcatgagtttgacagccccatataagtcaactttcaataaactttttccacctgagcctgaaacattaataatagcatccattccatgtaattgcttggccatttcctctggtgtccaatcaacatcaaaatgaaccgcttttacattattatattgaggaacttgctcaacttttcttgctccagcatagatttgatggtccgttgttgagagagatttaagcaaacttttacctacacgtccggtacttccaacgataaatattttcattttctacctcttttctacttcttttattgtaacaaaaaaccaccttgatggtgattttaagatgttttattcttcatccattgagagcacagataagaaggcttcttgagggacttctactgaaccaatggctttcatccgctttttaccggctttttgtttttcaaggagttttcgtttgcgggaaatatcaccaccataacatttggccaatacgtttttacgaagtgctttaatatctgaacgggcaacgattttatttccgatagtcgcttgaattggcacttcaaattgttgacgtggaatgagttttttaagtttttcaacaatgactttcccgcgttcaaaggcaaagtctttgtggacaatgaaacttaaggcatcgactttttcagcatttaagagaatgtccattttcacaagatttgatggacgataatcagaaatctcataatcaaagctggcataacctttagttgatgatttaagtttatcaaagaaatcaaagacaatttcactcaatggaatattatatatgatattgacccgatttgcgtctaaataatccattgttaggaaaattccacgtttccgttgagctaattccataaccggaccaacgaaatcatttggtaccatgatttgagctttaacaaatggttcttcgatgttttcaatgcgcgtaggatctgggaattctgatgggttggctacttcaagggtttcaccgtccgttgtattgatatgataaacaacggatggcgcggtcatgatcaaatcaataccaaattcacgttctaaacgctcttgaatgacatccatatgcaaaagaccgaggaaaccacagcggaaaccaaagcctaaggcttgcgatgtttctggctcaaaacgaagactagcatcgtttaattgaagtttttctagggcttcgcgcaagtcattgaatttatttgattcaattggataaatccccgcaaataccattggattcatttctttataaccctttagggcctcagttgctggatttgatgcgagggtcacggtatctccgacacgtgtatccgcaacggttttaatagatgctgctacataaccaacatctccagccatcaagaaatcacgagaaacagcttttggcgtgaaaataccaacttctgtgacatcaaattctttaccgttactcatcaattgaatacggtccccaactttaagcgagccgtcaatgacccgaatttgaagaataacgcctcgatatgcatcataaactgagtcaaaaatcaaagccttgagcggagcgtcaacttgaccttgaggggcaggaactttctcaacaatttgttcaagaatttcttcaataccaatcccagctttggctgaagcaagaacggcttcagaggcatctaaaccaatcacatcttcaatttcttgacggaccatttctgggtcagcagctggtagatcaattttattgatcactggtaaaatttcaaggtcattatccaaagcaagataaacatttgcaagggtttgggcttcgattccttgtgcggcatcaacaactaatattgctccctcacaggcagcaaggcttcgtgaaacttcataagtaaaatcgacgtgacctggtgtgtcaatgaggtgaaaaatataagtttcaccatctttggctttataatttaactcgatagcatttaatttaatggtaattccgcgttcacgttcaaggtccattgagtcaagaagttgagcttgcatttctcgttttgaaacagtttcagtttgctcgagaatacggtcagcaagtgttgattttccgtggtcaatatgggcgataatcgaaaaattacgaattttttccttacgcgcgttcatttcttgtagattcattttgattcctttataagagttcttgtggacctaaactggtttgaaatttacttttcatccactgaactttctttttgcttttttataactaaaaatcagttagaataattatagcatattttgcaataaaaaaccgctcttattatgtagggagcggttctgtgagagctataattacttttattttatagcaaaatattctataaattacattttaatcaaattactgacttctcaattgaatagtaacaaaatttgaaaagtctgtcttctatatcagacaaaattattgaaataagtgctggtcaaagttttcatcattgtcaggaaattcttggtcaattttggttattttaccaatttcaatctcaagattttctgtaatgaaattttggacatgtgcggtaaaagttttatcatcactgacaaaatgtaagtgaaaaccaagaccaaaaaggtcagtcaaatgttttggcgcccaaactccaaccatagttccagaaatattttcttttgtaaaataaggttggtcagccataatttcgtcataaggacgagtgttattggctggtttgctactgactgtcacttctttgaattgaccagtcataacaatagtataagcggtatttgctgttggaaatcgcttggtcagtgctgacagaaaatcttctgaattactgacagagctgtcagtaaattttgcgattggctgatgttcgaccattgccacataaggcattgtctcatcttcttcaactaatcggacatgattttctgagtccccgtgataagcgattccattgataatggtcacttctccatttgcagtatcaagtgtgccgataccgactgagccgtgctctagtgcttctttgagggtaatcgttcccttgtataaaccactagaaagtgtcgtaaaagtattgtgttggaatattctgctattcataatgatattattttatcacttttttttattagtagtatcaaatatgttttataaatttttttcaaattttatagagcaaaaaatccctgtatttggtataatattgcttatgacaataaaaacttcatttgcaaaatttgctggtaattcatcgcgctttgtcttggaaaaatttttcaagcgcggttcaactttaccaggaaaaattgctttaaaatttgatcctgaaattcttaaatcactgacaaaaaattatgaaatcattgttgtgactgggacaaatggaaaaacattgaccacagcactgaccgtgggaattctagaaaaggcttttggaccggttgtgacaaatccaactggagccaatatgattacggggattgtatcaacttttctcaaagctcccaaagctggaggcgaccgaaaagggagcgttcaggcggcgaatgggaagaaatttgctgttcttgagattgatgaagcgagtttgccaaaaatcactgaatatatcaaaccttcgttatttgtgtttactaatattttccgtgaccaaatggaccgctatggcgagatttatacaacttatgactttattgtcaagggtgcggcaaatagtcctaaaggtacggttttgttaaatggcgatagtccacttttcaactcaaaaaaattagttaatcctgtaaaatactatggtttcaaccatgaaagccatgaacctactcatgctcattacaatactgaggggattgtttgtcccgtttgtcatcatattttggcttacaagatgaatacctatgctaacttaggaaattatatctgtgaaaattgtggctttagtcgtccagaattagattatcaactgacagaattatcagagattacaaatacttcttctaaatttgtcatcgatgggacagattataaaattaatgttggcggactttataatatttataatgctcttgctgctgtatctgtcgctgaatatttcaatgtgccaaaagaaacaattgcggctggttttgaactttccaaagcagtttttggtcgtcaagaaacgcttgaaattgacggaaaaaaagtaaccattgttttgattaaaaatccagtaggtgctaatcaagcccttgaaatgatgaaattagccaattatcctttcactttagttagccttttaaatgccaattatgctgacggaattgacacaagttggatttgggatgctaattttgaattaattaatgatatggaaattgaccaaattatcacaggtggtgttcgttcatctgaaatggctagaagaatgcgtgtgacaggatttaatgccgaaaatatttctgaacacaaggaactttcagaagttttagaggcaattaaagagagtccaaaagagcatgtttacattttggcaacttacactgccatgttacaaatgcgtgaattattggctgagggtcattatcttggaaaggaaatgcgttaaatggcttatatctctttaaaatcaaatcttgaaaatccaaagtattccctcaatgtggctcatctttatggtgatttaatgaatacttatggtgataatggaaatattctcatgctcaagtatgtcggagaaaaattaggggcagagatgaccttcaatatcgtttctttaggtgatacttttgcaaaagaagattatgaccttgttttctggggtggtggtcaagattatgagcaagaaattattgctgaccaatcattgattgacttgtcagcacctttaaaagattacattgaatctgaaaaaccacttcttgcaatttgcggtggttatcaaatgctcggtcagtactatgttaattccgaagggacaaaaattcaaggaacgggaattcttggacattatactgaaaatttacgaactgaccgttttattggtgatattgaaactcacaatgaagaatttggtgaaacatattatggttttgaaaaccattcaggaattacctatctgtctgatgacgaaaagccactaggaaccgtcgtttacggtggtggaaataatccagatgatcaaactgaaggtttaatttacaaaaatacttttggaacttatttccatgggccaattctttcaagaaatgcacgactagcttatcgtttggtgactactgctctttaccaaaaatatggggaagaaattcaactccctgcttttgaagagattttagctgacgaagataaaggccaacaaattggggacctcaaacgtaaagttgaaaaataataaaaaaattactgatgaaatttttgtcagaggatagccgttagtgtctttagcacttatggatatcctcgaattttcatcagtaatttttttatttcttaaaaagctgtcagtaaaatttttaatgattaatctactgatttcaaagccccaagcatatccacggcttttaatttgaaatgaacaacaatagctagcaaaagagtagtcgcaaaagtaattgctgccgataataaaagatttgtccaaagtaatcccggtgcaaacataatttggtcagctgacaattggttcataatcacctgatggaaataatcccccaaaacaaaaccaaccagaattcctaaaaagcttaataaaatcgtttcccgataaatataaagtgtgacttcacggtcataaaatcctaaaactttgattgtggctaattcgcgaattctctcggaaacattgatatttgttaaattatagatgacaacaatcgcaagtaaaatggcacaagtaatcaaaacaatcatgacactattaatgccatacataaaggattcaatcacctttttgaggtcactattttgtgaaactgcttgaattccgtcttcttgcataaattgagctgacattttttgaatattatttgtagacgcatttttcaacttaatcaattgggcatttgccacaaaatcttttttaaaaacattttggtaaaccgattgattcatgaaaatataatggcccatatacatttcagtaattgctgctacttttatcttatgaggctgattttcactatcttttagtgtcagagaatcaccaactttaaggtctaaaagttcagcaaatttttctgaaaggactgctccagagttatttaattcaattttttgactatttttacgagattttaagctaatgtattttgataaatcatcagaacgatttgtcgcaattaagttaacctcttgtttttctaatttgtcactggcttcttttgtcaaattttcaaaggcaatcggcaaataattctcaatttctgatgaggctaattctttatctatttcttctttttctttgtcatttactttatttttttcaatagtaatcatgtcatagtgcaaaatttgaccaaattgtttatttgataaaccagaaatagaatctcgaattccaaatcccatgacaagtaaagcggtacagccagcgacaccaaagatagtcattaacattctctttttataacgaaatagatttcgagccgtcactttataagtaaaactcattcttttccaaataaaattaattttctctaaaagaatccgtgagcctgcttttggtacttttgctaaaaagaggctggctggtacttcttttagttccattcggacaacccaatatgctggcaaaagactacaagctatagctatcgcaaaagcaactattgtccataaaggagagaatgttaaccgtaaattgctaaaggtagatgaagctgtgtaagcattaaataccgctatcggcaaaaaggtatgtccaataattgttcctactaaagctcctaaaccgctagaaactaatccataaaccataaatttcttacgaatgtcacggtttgaatatcccaaagccttcagtaacccaagatttcctcgctcttcttccacaaaacgagtcattgttgtcaaactcactaataaagcaatcgcaaaaaggactactggaaaaatatttgaaagactgtcaattcttgttgagtcatctaaaaatgtcttataccccggatttccttctttacgattattaatttgataagtcggtttttcaagctggtttagggctgtttcctgctttgcaagctctgctttagctttagcaatcttttcttttccagcattaatttgattttgggctgcattgatttgctcaatcacttgagcggatgcatgttccccaatttgattcttttgagcgattaattgattttcttgctgagtgagttgattttcttcctcaactatttgacttttcgcttcattaatctgtttttctggggctgttttcagtgctgctaagcgtttttctggttgattcttaaaagtattttctaaggttttttgttcggtttttaagcggctatcgtatttgctatcaaaaatggagatattttgtaagtttttataggataggcgagcaatcatataaacatcagaatcaaaggcttccttggtaacaagcgcataaccattaagtttacccgttccgactgtcgttgaaccaaaatcacttttatcgacatattcacttgatttcacaaatccaacaattttaaaggaatgattttttatcaaatcagaatccttagatttgggaggggtaaaatcaatggtttgtcctattttatattgtccatcatataaataatctaaagcaatttctgaatctttttgaggcaacttgcctgacattaactcataagttgacaattcatctggtgtagaaaataaacgcagactattttcttttcctttgattaccaaatcttgaaaatagccaaattctgctttttttacacccttggtttcgttaattaattgctggtcagaatggtccaatcccaaagttgaagttagcgttaaatctgctaaatgatgttgagcataaaaatcttccgctgttcttctcatatcgggtccagaaacttttagtccgacaaaagcgaaagtccctaacaacatcaaggaaaaaatagaaataaagcgacctaatgaacccgtaattgacctgcgaatttctttatttaaagttttttttcgcatagcttaccactcaattctatcaatatcttctggttggctattattatcaatttgtttaatttttccatcatgcatttgaatgacacggttggcaattggagcaattgcagcattatgcgtgacaataataactgtttttccttcttttctggccatatcttgaagaattttcaagatttgttttcctgtatgataatctaaggcaccggttggttcatcacaaagcaagatttttggatttttggctatggcacgcgcaattgctactctttgctgctcgccaccagaaagttgcgaaggaaaattatgaagccgatgttccagaccgacacttttcagcacttctttagcatcaagagcattttcgacaatttcagaagctaattcgacattttctagtgctgtcaaattattgacaagattataaaattgaaaaacgaaaccaacggcataacgtcggtaggtaatcaattctttgtttgaaaaattagagattttttcctcatcaataataacctctccctcatcatttgtatccattcctcctaaaatatttaggactgtcgatttacctgccccagaggaacctaaaatgatagccaattctcctttttcaatttcaaaatttacttggtcattggcataaatcttctcttgtcctgattggtagattttagactcattaatcacttcaataaatgtcatcttatccctcctttttttgtaaacgttttagttaattatatcataattacattttacttcttattcaagtcctcatcatttttaataaaaaaattactgacagaaatcctgtcagtaactttttgtttttatttccaaaaatcatcaaaaacgctaattggtaagtgacgtttatgttgtgttttattccaccatgcttcgattttagccttagcatcctcagaaatcactttaccttctgtgtagtcatcaatatcattgtaagtcacacctaatgcaatctcgtcagcaagtcctggttttccttcttcaaggtctgcagtcggaactttttcataaatggctgggtcagcgccaagttcagccaagagtgcttttccttgacgtttattcaagcggaaaagtggaagcaagtctgctccaccatcaccaaattttgtgaaaaatccagttatattttctgctgcatggtctgttccaagaaccgctccttgatattgaccagccacagcatactgagtaatcatacgttgacgtgccttaatatttcctttgttgaaatctgatacttcaattccagcttcattgagggctgccacttgtccttcaacagcagctttaatatttacagtcaaactgacatcgggttgaatgaaagcaagcgcacgttgggcatcttcttcatcagcttgaacaccatatggcaggcgaattgctacaaatttataagtctcatcagcagtttcttgacgcatttcttcgatagcaatttgagccagacgacctgctaaactagaatcttgaccaccagaaatccctaatacaaaagacttaatgaaaggatatttttttagataatctttcaaaaaatcaactgacaccctaatttcttctttaggattaatgactggtttcacaccaagttctttaataatttcatcttgtaatgtcattttatcttccttttactgacagtttctatattttactgacagctctgtcattaactatttttaatctaaaattttactcatatagaattcatcaatgtattttccatcaacacacattgcctcacggcgaacgccttctattgtgaatccatgtttttgaaaaagggcaatcgcagcatagttattaatcattaccgttaattctaaccgttttactgctttttcttttgcccatctttctaattcctcaaaaagttgagaaccaattccttggtgttgaaattcttcaataattcctacaacaacataggccgtatttctaattcgattagcgtttcctcttttggctgacagaaatccaacaaattttccatcaacatcagcaccaactaaaaaatcaaaacgtgaaattcgaccaattgttcggctaaaatcaaatcttcgctcctctggttcaagcatcatgaacttactttctgtatccaattgcttttggacatcccagaaaagtcttgcatcacagaggtctattcgtcttattctcatcattcatcatccaatctcgtcattgatactgttgtacgcacctgtgaaattaggcgcattttatgattccataattcttgtgacaaatctactgggtaaggttgaggattcaaatcacgtttatattcatcccaaagttcctcaaggttttcacgtgcaaattctttaatttcttgcaagcttggtaattcatatatcaattcaccatccacaaaaatatctttcaaaagtggattagcattgaagtctcgcacatttttattgatgtaggtataaagtgggtggaacatgtaaatttcttctgctacatctggacgttcatcagaaaatgtaatataatccccctctgatttgccatctgctttttttgtgattcgccaaacttgttttttacctggtgtagaaactttttcagcattacttgaaagtttaatggtatcctgcatttgaccactttcatcttccatagatactaatttataaactgcaccaagcgctggctgatcataagccgtaattaatttagttccaactccccaaacgtcaatttttgctttttgcatttttaaacttaaaattgtgttttcatctaaatcatttgaagcgtagatttttgcatcagtaaatcctgcttcatcaagttgctgacgaacttttttcgagatataggccatatctccagaatcaattcgtacaccttggaaattaattttatcgccaaattcacacgccactttaatcgctgaaggaactccaactcttaaagtatcataagtatcaacaaggaagacacaatctttatgtgtctgtgcgtatgctttaaaagactcataatcattcccataagattgaaccaaagcatgagcatgtgttccactagccttcaaaccaaagattttagctgcacgaacgtttgatgtcgcatcagcaccaccaatgattgctgctcgtgttccccaaatggctgcatccatttcttgagcgcgtcttgtcccaaattccaacaaagggtcatccccaattacagatttgatacgagcagctttagtagcaatcaaagtttggaaatttataatattaagaatagctgtttcgaccaactgacattccgcaagcgaaccttcaacctgcactaaaggttcattagcaaaagcaagttgtccttcttgcatcgctctaactgttcctgtaaaacgcaattcttttaaataatttagaaaatcttccggataatctaattcacgcaaataggcaatatctgtttccgagaatttaaggttctttaaataatcaaccattctttctaaaccagcaaaaacagcataaccatttttaaagggcatctcacggaaaaaaacctcaaagaccgcctgacgctgatgtcgtccaagctcaaagtaagtttgcatcatattgatttgatataagtccgtatgtaatgtaagactgtcgtcttgatatagatgtggcataattttttctcccatattcacttccgctaatcataccgattttaacgcaattctaatctttattttatcaaattttgccctaaatttgtactgggaaccctttataattatacaatatattataatttaaatttcgccatgtattttatataaaactagtcaattttttgctccacttatgttttttgtactacaatagaagtaatggagaaaggagaggattatgattagttatctaaagaaactacttaaacaaaatgatagtgtaaaaatccacttaatagacggaagtgtcgtctctgccttacatttcaagaaaggttacagcaacggaaattgccttgtaattgatgaggataacaccgagcattatattaacagtagatacattgtccaaatcgaatcttaaattaaagaactcccttgaggagtttttctttagtcttatagattgcgatgagctatggtacaatataaattgactgattcaaaatattggtagattaaataatttcaaaaattaaggagaaagcccccttatgaataaagggaacagaaaaaaagtaggtctattaggaggaaattttaatccaattcatcatgctcatttaatgatggctgaccaagttgcccaacaaatgaatttggataaagtattactaatgcctgaaaatattccacctcatgtcgatgaaaaagaaaccatttctgcaaaacatcgagttaaaatgcttgaattagcaatcaaagaaaatcctagactcggtcttgagttgattgaaattgaacgtggtggaaaatcttacagttatgacacgctcaaactcctgactgaagctaatcctgataccgattattatttcattattggtagcgacatggtggaatatcttcccaaatggtacaaaattgatgaactcctaaaacttgtgacattcattgccttaagaagaacggatacaatctccaaaagtccttatcctgttacttggcttgatgctcccttgttaccaatttctagtacaatgctaagggaaatgtttgccaaaaatattgaacccacttacttcttacctcaaaacgttattgattacattaaaactgaaaaattatataaaaaaagatgacccagagaggtcatctttttgtttaaacttccaaatttagaacttcttgcgcataaatggatgaatttccattcaaaacgtaggcaattgtcataattggtaggatatattgaaccgaaccaaagccaaagacctccgcagcaataaaaattgggccaaaataagagtttgttgcggctgaaaaaattgaaacataacccgcagcagccacaaattcgacaggtaaaccaaagagcatagccaaagctgcacccaatgttgagccaatagcaaagagtggtgtgacttccccgccttggaatccggcagaaatagataaaaccgtaaagattaattttaatatccaatcatatccattgatatgtccaccgttaaaacttaaagaaatcaaatttgtcccaagaccagcataacggtccaaatgaataacaagtaaaccaattgagatgacaattcccatcaaaataattctataataaggattaacaattcttttagcgacggttgctttcataaaagctaaagattccgcaaaaaatctccctacaagtccaaaacaaacggcaatgacagccaattttaatagaaccaaagggtcaatatgaatgttagtattgattgcgaaagaaaatttttctaatcccaaactgcttgaagtccaacttgcaacatatgaaccaaccaaagctgggattaaagctctatattcaattttacccaacattaaaatttcaatagcaaagaaagttgccgcgattggcgtttgaaagagccctgcaaaaccagcagccataccagtaatcaaaagtatttttttagcttcttttgctgagagttttttgccaatcgcatgtccaatcacaccaccgatttgaactgcaactccttcacgaccaacactggcaccaaacaaatgagaaagccaagtcgagaaaacaatcagcggaacaagacgttttggaatgtcttctcgcccatgattccccgcttcaaaaattaggcccattcctttttggctgtctttaccaaaattcttataaatataaacgattaagagaccggctaaggttaaaaatggaattaaatatagggcatgactatctctaaattcagtaatatagataagccctcgaccaaatatagcatcaacaataccaattaatcccccaataattacagctaagaagacatataaaattgcgcttcttgaaattcctactttaaaaaaattcatttttgaaactccttgtttgtgagtttaactcactttataatattttacaaaacaaaaggcgctacaaacaagactacttggagatagccttttgtttgtaggcgccattagttttaagattttattcttaaagcggtttcgggtgtgcaccatacccatcattattaatatttattttaacattttatgaaatatttacaagaaaaagctcagtcgcgcatcccattcttacgttgaatttctttaagtttatccggagtaacatcttctcctgttttttcatcaataactttgatggtttcaacttgtgagcggaaatttgctttaacactatcgaggtaagcacgacgtaaaagggcttgttcttcaagctcagcttctgataatccttctgctttcttcttacgcgctaattcattaatacgttctacttgttcatttgtaattgccatttcttagttcctttcttcatgaatattgttaaaattactgacagaactcaaattttactgacagctttttaaagtcataaataaactttctgtcagtaaatttatcaattttattttgtattaatcaaagaaaaatcagccataacgcttgttaatgcaacaacttctgacaacaacgcaatacgattatcacgaactgctaaatcttcagccattaccattacactttcaaagaaagtttcaattgaaggtgcaagtgaatgaacaattgctctgaatttttcttcaccaggcatataagtccattgattttgaagagaaataacaacattataaagtgcttcttctgcatcttcttcaaaaagtgttggatttatttctttaatatcttttgcttttttaaccaaattaattgaacgtgaaacattttcaattgctggtttaaaaggttcgtgaagtttgtgcccatcaatgacaaaagccgattccatcatgtttgtaatatcaaagcttgaactattaattgccgcttcaacaatatcatgacgatcgagtttttcaagcaagagtttttgaatacgtgctttgacaaaatccaaaatttcaagatgattttcaccttcaaattggtcaataaataaagataaatcgaaatgccaattcattttttcaataatacgaatcaagccttgtactgctcgacgtagggcataagggtcatttgaaccagaaggaattaaaccaacattaaagaaagagaggaccgaatcaattttgtcagctgctgcaagcacagaaccgacttttgtttcaggcaattctccctcggctgaagttggcatataatgttcacgaattgctgcagaaacatttgcattttcaccagctaaaagcgcatatttttcacccattaccccttgtaattcatcaaattctccaaccattcctgtcaaaaggtcaaatttataaatttcagcactacgggcaacgtctcttttttcttcatcagtcaagccagcaatatcagctaatttcgcggctatttcttttgttcgtgccatgtgttcagtaattgaaccaatttttgcatggaaagttactttagcaagtttagcgaccaaatcttcaattttaagtttttggtcttctttccagaaaaactctgcatcttcaagacgagcaaccaaaactttttcatttccgagcacgacattttcaatattttcagcgttcccattacggacagagataaagtttggtgcgagttgaccttcttggttataaacttcaaaataacgttgattatcacgcattgatgtcactaaaacttctgctggaacagaaagatatttaggatcaaatgaaccaacaaaggcagttagatattcaacaatattatttacttcttctaataaatctttatgcaaagtaacttgccatttattttcagacgcaagagccaaaatttgagctgaaatttctgctttacgatgttcagcatcaactaaaacaaagttttctggcattttgctagcataatcatttgcatttttgagttcaacctcaacatttgccaagaaacgatggccccgtgaaaaacgatttgctgttacgtccaataaatcaaaagcaacaactttatcttctagaagtgaaacaatccattgaattggacgaacaaagagaaaatcattatttccccatttcatataagttgagaatgtcatttttgcgatgacttcatcgccaactttagacagaatttcttctgcttttactccgtaaatatgttttttagcataataataatcacccttaaggattaaatcatctggagtagctccttgtcctcttgagaaaccttgaatcgcttttgaccaattcccttgcgcatctttagcaattttagcagatggacctttaacttcttcatcaatcgcttctgacgcttctgccaaaccttcaacaataattgctaaacgacgtggagttgaaaatttaataattttatcaaattctaaacgattttctttaagaaaagtttccattctttcggctaattgattgattgaaggagtcaccaaatgtgctggaatttcttccaaaccaatttcaagtaagtaatttgtcattatttttcttctccttctacaatcttagtatattttccttttttaccaaggtatttttcacgtaaagcttcatcttttaagagcgggaaaccaagttttgcacgttcttcaataaaagtttttgctaccttacgtgccattgtacgaactctatgcatataacctgcgcgctcagttacagaaactgctccacgtgcatcaagtaaattgaaggtatgtgaagatttcaaaatataatcataagctgggtgaactaaacctttatctaataaatcaagcgcttcttgttcaaattctccaaaaagtttaagtaaaagctcttggtttgattcttcaaaggcaaatttagaatgttcgtattcaggttctttgaaaatatcaccgtaagctacgccattcccccattcaaggtcataaacagaatcaacctcttgaataactgtcgcaatacgttccaaaccataagtgatttctgaagttacggaatcaacttcaattcctccgacttgttggaaataagtaaattgggtacattcttgcccatcaatccaaacttcccatccaataccagcacatcccattgaaggattttcccagttatcttcaacaaagcggatatcatgctctaaagcatcaattccaagttcagctaaactttgaagataaagttcttggatattttttggagatggttttaatacaacttggaattggtggtgttggaacaaccgatttgggttttcaccataacgaccatcagcaggacgacgtgaaggttgcacataagcagctccccaaggttcaggtccgtttgaacgcaagaaagtgtaagggctcattgttcctgctcctacttcattatcataagcttgcatcaagtttgccccttgtttagaccaaaagccttgtagggtcaagataatatcttgaaatgctagttttttatttgccattattttcctccgaaattcaaaaaaccgcaattcacacactcatcaatcctcgaaaaaatccgaaaagagacaaagggtgcaaatgcacggttccacctttattttttactttatttgtgttcattacagttttaagttaagccattattgttctcgaactttcactatcttcgagtcgctacctataaattctagctctattttcccgttttgtcaaggcaaaataaactgatgaccttacttctgtcttatttggtatcaatattctggttttatctatcatattcaaacataattattttcttgaataaaaagtaaattgccttcatcatcaatattgatttcagattctataagagaatagttatcagtttcagattgaataatgagtgtatttccacatttttcaactttttttcctgatgtccctacgggtttatcgataataatatcaatttctaaaaattcttgagctaacatttggttcatttcttctccaagttgacttaataaaataataacatcaactccaagattctttaatcttttaactatgaaatctgccttatcaaaagggttagaaaagatagtctccgcactcggatgtgagcgataaacaatatccattgttgtcaaaccaaatattcctattttcttacctgatgttgtatttttaaggagataaggaataaattttccttcttttactaaaggatttaaaagtttatcatcttcaaaattaacattagcgactaaaattggaaaatttattttatttagattttccactattccttttgaacccccatcaaattgatgacttcccaatgtcgtcgcatcaaaaggaaatttatttaggaggtctttctcatcatttttgtgctcaatgttattaaaaatgctatttccatctcctaaaactaaagtttctatgactctttttttattttcttctttaattttattaattaaagaaaaatccttatcaagggtgagatgagtattatttatatgtaaaatgctaagtttcattatcacaaccaaacctatatatagtatttaatatctatattttatcacaaaaagcacaatatattgtgttttaaacttttttctaaaaataaaaagatgacttgcgtcatctttttaatgatttcgattataaatcacactcgaaataaaggaaagaataatgaatacagctcctagaagtcctgtaacaacctcaccaatctcccatttaatacttgctaaaattaaaaatgcaagcgtgagaatggcccaatgtgctccgtgttcaagatatacaaggtcattcaatgttcctttttgaacaagataaagcgtaagacttcttacaaacatcgctccaatcacacctaatcctaaaagaataataatcgggtctgctgtaattgcaaaggcacctattaccccatcaaaactaaatgaagcatctattacttccaaatataagaataaagcaagtccagccttaccagtcgcaatcacactacttgttgtgtttgcagctttgctatgactcatcgtttctccaaaaccgtcaacaagcatgaaagttaggattcctaaaattccagcaaataaaacagcgtgagcatctttagcaataaattccgatgtgattaaaagcaaaataatcgaaataattgcatttgctgccggaaaatttccaattctttgaaggattttctctggtattttaagccaagtatgtgcccgttcatcaaagaaaaatcctaaggctagcatcaatagaaacattccaccgaaagctgcgatttgtggatgagcatggtgcaaaatataaccataggttcctactgtattgggatttcctttttctaaagctaattttaaagcaccgatagggtcaatttgggctgacactccaacaatcaagagtggaaaaatcaaacgcattccaagaaccgcaatcaaaactcctaaggttaagaaagctttttgccatgcagaactcattcgttcgagaatacgtgcattcacaatagcgttatccatagataaggaaatttctagaacagcaagaataagcgtaataaaaagtccattccacccggcataaacaaatgcgataattagggcaattaaactaacaataaatgagcctctgaatattttcataggtctcctcttctaaaataatcttctcatctattctaacatactttttacactctcactgtgcctagaactatgctttgcctgataaagattatcgtaagaatgagcaaaaccgtaaaagaaattgtcaaaataaggtcgacttttgcttttgaaaagacttttatgagtaaataatagaaacttattccaagtaaggctccaagtgagttagtgatgaggtcagtaatatccgttgcaccaatggcaagaagatattgtagactttcaaatgaaaaacttaataaaatggaaattgccagtttatttaaaaaggagatttttggtgcattcatagtcaataaaataccaaaaggaataaaagctagaatattaaataaaacctcgcgacgaccgccggacatggctaaaggtgtcagattaagacttcttgtattcgtcatttcaagaaaagcaagtggatgaaaagaaagtttaaataataccagccaaaccagtcctaatatataaatgaaaaataaaagctgtgctaatttttttgtcatttttctcctttcttaagaaaataggttttcgattgttgttcttttagtattttaactgatttaacttaaacagaaacctttatcagttatgatataaataaaaagggaattctccctttttaaaatcaatattttatgacaggacttcaacttctacttgttgactgtccccttttttcatgcttatttttccattaaaagtttctgtcagtaaattcatgacttcgtcaaccttttcttcatcaataagacattttactttgatatccgacaaaaactcactatccgaaattttgattttttcgtcaattaaaaagcgctgtaagctgtcatagaggctgtaatcaagatttaaaagaagctcacgttggttgataaattcaactaaaccagcagcttcgatggcatgatttacactgcccgcataagcacgaattaaaccaccagcacctaattttattccaccaaaataccgagtaacaacggcacaaacattgattatttcttttttctttaaaatttcaagcatcggaacaccagaagtccctgacggctctccatcatcacttgttcgttgaatttcttgacggtcacctaatgtataggctgagcagttatgattggctttccagtgttcttttttgattttcgcaataaaatcacgcgcttcttcttcagatgaaattcttttcaaatggcaaataaatcgtgattttttgatttcctcttcattgataaaatcagtttttatagtgatagtcatgctaatgattttaacaaattttgttacattttaacagcattttcgtatagaatagtatgagcactaatcaagaaaagttatttggccgtttattattaaaaaatgatattttacaacttataaaaaatactgacaagatttctgtcagtaaaatttttagtaattttttgttagaaacaacagtaaaatcaattttggggatgactttaatttcttccaataaaataaaatgcaaccgttgtgggactgttcatattaaaaattctgtcaaacttccaattggtgcattttactgtccaagttgtattcaattaggtcgagtccgctccgatgaattcttgtactttctgccacaaaagagttttccaaagaaatcatatataaactggtctggaaaactgacagagaatcaaaaatcagtttcaaataccctctgtcaggaaattaattctcatcagcaaataattgtccaagctgtgactggagctggaaaaactgaaatgatttatcaagtcattgagcaaattttagaaagcggtggagttgttggtctagctagtccaagaattgatgtttgtcttgaacttcatcagcgattatcacgtgatttttcctgtaagattccactcttatatcatgatggcgacagctattttcgagctccattaataataatgaccagtcatcagcttttacgtttcaaggaagcttttgatttgttgattattgatgaagttgatgcctttccctttagagataatgaaatgctttattttgcggcagaaaaagcaagaaaaatagaaggaaatttaatatatttgaccgcaacttctactgacaaacttgaaaaaaatataaaaaagcaaaaactctatcctttgtttctcccgcgtcgttttcacaattttcctttagtggtgcctaattttttttggaaaaataaattttataagaaattaattgagcaaagaaatagtggctttcctcttcttatttttgctgctgaaattgaatttggacaagaatttgcaaaacaactacaattgaaatttcctaaagaaaaaattgcttccgttgcttcaacaacaaaagatagattggaaattgttaaagcttttagaaataaagaaattactattttaatagcgacttcaattcttgaacggggagtcacttttccaaatgttgatgtttttgtcatcaacagtgagcacccaaacttcactaaatccgcactgatacaaatggctggacgtgtgggtcgtagtcctgaacgtccaacaggcttagttagtttttttcattacggaaaatccaaagcaatgtgtcaggcagttagagaaatcaaaaaaatgaaccaactgggaggtttttcatgataaagtgtttgctttgttcaagaaatattgctcaaaactttctatttagtgaacttttcttactcaaaagtcctcaaaatcttttatgttctaaatgtcaaaaaaattttgaaaagatccctgaagctcactgtcctcgctgttgtaagccaaatgtccatgagatctgtactgattgtcaaaattgggaaaaaagaggatacaaaatcagacatcaggcaatttttcactacaatcaagcaatgaaagattattttagccagtataaatttgtgggagattatcgattataccaaatttttgaaccctattttaaaagtattcccccaaaatcctctttggttccgattcctatttcacccaaaagattagaggaacgtggtttcaatcaagtgactgcttttcttcaacaagataattttattgaacttcttgaaaaagagaattcggtcaaacaatctagccttaatcgaaaagaacgattggaaagtccaaatccttttcgattaaaaaaaggactaaaagtccctacaaaagttatattaattgatgacatttatacaacaggtaccaccttatatcacgcatcacaaattctaaaagaagctggtgttcatgaaataaggagcttttctctctgccgttaatcattaaatcaaataaaaaaacctttcagctttttatcaattctttatttcatctgaccattcaataatctttaaattactaaatctttcttgccacctagcaaccttattttcataaagtattcgattattatcgacatgataaattggccgaattgttttagtaaaaatatcttctaagccatagggagcaaaaatttcaatattgcgtgaattaccacttatgcctacagcatgaaccgtagcaatccaacgctcaatcgcattttctgtgtttttatacggtactttatttccattatgccaaagatgcatgtatgcttcattatgaatatcaaattgatagggaaatttttcagataaaactttttctaactttttatcatttttagcagagctgtcagcagaaatctctttatcaaagtacacaatatcaatatcgtgaattcctgtcattaaattatttccgtcagaataattccaaaccgtttgaaagacacttcctgcggctagataataattaggcaaatttaaaacaaaaacttcatccaaaatggacatcaattcggagttctttttcaatatttttagaaaatcattttttctattcatttccgcttatcctctaaaagaaaagatgccaaattttaggtaaaaatacaatcagaccaacaatcaatgcaaatcccgaaataactaaaactgccccagctgccatatctttggctcgtttagcacgcatataaaattggtaatctgatgctaaatccaccacattttcgatagcagaattaaaaagttctgccataaaaactagaaaaattgacaacaacaaaaagagccattcaaattctgaaatttgaaaaacaagaccaaaaacaatggctaaaaaggctgccaaagcatgtttacgcatgttacgttcttctttaaaagctgtccaaattccagacagtgcaaagtctaaactcgaaagtaaattaggatttttccaacgggccctatcctcttgaacaggtcttttaccattattaaaatcctttttcttaaaaagttttacatctttatcttgtgagtccataggcagttaaaatctcctcttgcaaaccaaacatttctgactcttcttctggtgtgtagtggtcataaccattgatatgcaaaaagccatgaacagctaaccaaccatattcacgttcaatcgagtgaccataatcagcagcctgttcagcagccttgtctattgaaataaacaattcaccaataaatggatccatttcttccaacaattcctctggtaattccatatcttcatcaaagaaaaattctgattcatcaggtttgtattctaatgagataacatcggttggtcggtcagtttcgcgatattgcaaattcaactcatgtgaacgagcattatcaacaaaagttactgacatttctgttgattctttcaagttcagttttttagcagcaaaagctaaaacttctttagtttgttcaataatatcacttggcacttggcctgtttcatcaactaattctacgtacatttttttccttatttaattactgacaataattcataaaatagccctaagtagctcaatattttagctatttctattattctgtcagtaaattttaatgacagacagaactgtcagagaatttctcattcaatctgtcacttacaatcaacaattactttctgtcagcctttttttgcaacatttccttacaaaaggacaaaatgggacctcttgtggcaattaatatatcttctggcagattatcaaaggcaaaccattgacagtcaagaacctctgattcttctaaaagaatctctccagaaaaatcattacaagtaaaaacagtatcaacaatatgaacttcatccccattaggatagaaaaagtgttgttctgtcccagaagcgacagtgtacaaatttatttttccagcttttaagccaacttcttcatagagttcacgtttcgctgcttcttcaaccttttcattcggttcaactgacccaccatgataacaccatttcccattatctgcccgtttttgaagtaaaattccacgattttcatcataaataatcaagcttgcacatgcaattaccattgggacatgcccaatttttttgcgcaaatccatgacataaccttcggccattattgtttccttcttatctagaaatttgatcaatctgacattaacaaaagttccaaactattcatcaccataggctttgataatttcagcaacaactggatgtcgaacgacatcttttgccatgaaataaacaaaatcaattgatttcacatgacttaatttatctttggcatcaatcaaacctgattttactttattaggtaagtcaatttgtgaaatatctccattaacaatcattttagaattaaagccgagtcgagtcaaaaacattttcatctgcatcgttgttgtattctgtgcttcatccaaaatgacgaaggcatcatcaagcgtacgaccacgcatgtaagctagcggagctatttcaataattcctcgttccatcatgcgctcagttgccgtctttcctaaaatttggaaaagggcatcataaactggtcgtaaataaggatcaaccttttcttgcaaatcgcctggtaagaacccaagactttcaccagcttctacagctggtcttgtcaaaataattcgtttcacctgaccattacgtaatgcttgaacagccatcacaacagctaaaaacgttttccctgttccagctggtccaattccaaaaacaatatcatgatgtttgacagaatcaacataagttttttgaatcagattttttagtcgaattgactttccagctgcatctttcgtcaattcaacttcataaagtgcagtgaaattttcaatatcatcatttaaaaccatctttattgcaataatgacatctgacgcatgaactggaactcctcggcctactagtacctgcagagcttggagggctttacgagctcgctctcttgtcaattcatcctcagaaacgatttgaaccgtttcgccacgataattaatctcaacccctagttgagattcaactaacttcaaatatttatcttgtaccccaaaaagtagacttgcatcttctggattttctagtttaaattcaattgaatttttagtcaaatacacaatctccattaatcattttcttacattatagcacatttcatattttaatttaaatcacaccttactgaatataaagaaaaactctattttaaaatagagttaaatcaattttagtaagccatcatttttttatttcctcgataaagttctacgattgtccaaattaataaaaggagaactccaaaaataagaaaaccagaaataagatgagatagtccaagattatgaggtataaagttggcaatttgatctggcaaaccaatcaaattaagataggtcaaagcaataactgaaaaccatcccaaacatttaataatcaaattatttttaaaatcacccatctcctttttactattagtcagcatcaacaaaggaatgattgaaaaaggtagagcaaaggctagaaaaacttgagaattattcatcaaattattaattgcttcatgctgtgctttcaaagtttgtcctcttgtcatagagacacaaatcaatactggaacaactgaaagcaaacgtgttactaatcttctggcccacattggcattctcatatgaatgaagccttccataataacttgacccgttagagtccctgtaatagtagaattctgtcctgaagcaagaagagctacggcaaacaaagtggataaagctcctgtttttgctacatcggcaagcagtccattgcttaaaacagttggattagagagggcatcatataaaccaaagaatgatggatcatcaatcactcccgttttgaatacggcaactcccatgattaacaagagggaattcacaacaaaagccactgtcaattgaatattagaatcccatgttgaaaatctcaccgctctagcaacatctgctttatcctgatgattgatttttcggctttgtgaaatagaagaatggagatacaaattatgaggcataactgtagcaccaataatccctaaggcccctgttaaaggagacatccctgccactgttggtgaagaggcaaacgtccggctattggggataaatccctcaataattcctttccaatctggatttgataaagcgacttgataagcaaaaatgaccaaaatgactaaaatcaaacagataacaagggcttcaatttttctaaaaccaactctcgtcaataacaaaagcaaaaagacatcaagaactgtgataaaaaccgctaagattaatgggatattaaataaaagataaagagcgatagcagccccaattacttctgcaatatccgttgccattatggcaagttcagttaatatccataaaacaattcctagagatttacttgttcttgctcttatagcttgagctaaatccatttgactgacaatacccaattttgccgacatatactgaaggagcattgcaattaaacttgacaccagaatgactgaaatcagtaagtattgaaagttttgtccgccagttattgatgttgaccaatttcctgggtccatataaccaactgcaaccaaggcaccaggtcctgaataagttagcaacattttgaaaaagccaacatttttaggtacttctactgtcccatttatttcctctaaggattttccattcgtatgataaatcaatcgatgacgttgatgttctttatcattcattatttctcctagctctaagttgaataaaattcaacaaccattatgttaagtatatttttatagtaattaaaataaatcaattattgatttaagaaattattaaactttttaatctataactgataataaaaatattatagcaccaccttatatttttttcaaatattttagcacatatttataaatgtatttaaaaagtacaataaaaagccctcaagaggactttattcattaatatataataaaaaaacctgtcaaagacaggtttcaaaattcttatttagccactactggataaactgatacgtgttttttaccacgtttcatttcgaatttaacagttccttcgattttagcgaagagagtatcgtcgccaccacggccaacgttagtacctggatggatatgtgtaccacgttgacggaaaaggattgaaccgccgcttacaagttcaccgtcagatgctttagcaccgagacgtttagcttgtgagtcacgtccattggaagtagaacccccaccttttttgtgggcgaagagttgcagattaagttcaagcatgttattgccctccattttcaaatttaagtgtaatgtactgaccatagcttttctcaactgctttcatcgaatttgcaaaagcttcgagcaaagtttgagccaatacgccttgtttttcaggtatgctcaaaggaatttcaacatacaagtaaccatcttccatctgagtcacaggtttaatgtgagccatctcgtagatattatttgccgttgtaattgatagaacgctgaccgccgcacaaaccacatcgtgtccatactcgccagattcagcatgtcctgagatttcataagaaacaattttgtctctttttgtcctgatacaagcttcaatcataattaagcgttaactgatttgataacaactttagtgtatggttgacggtgaccttgtttacggtgtgagtgttttttaggtttgtattggaaagtaacaactttcttttgcttaccatgtttttcgacttcaccaacaacagttgcgccttcaacgagtggtgcaccaactttagttgtttcgcctccgacaaagataacttcgtcgaaagtaacggtttgaccagcttcaacattgagtttttcaacgtagattactgaaccttcttcaactttaacttgtttaccaccagttttgatgattgcatagtttgacattgtgattcctccttgttagatttcatcgcttttaagtcaagcgactgttagactcgcctttgttcgtgggcatatgccacttaatacgaaacttcgtgcggttgcactttatgagacttcacaaagacaactatattattatactacttctttttctacttttcaagtcttatttttcacttttttcttctatagaattaagcgagactttataaatctttttcgtattccaaagcatattaatcaaagtatttaccagtaagagtaaccaagcaaaagacaagctaaaagaaagaatttcaaaagccgttaatgtcaaataatgaataggatgccataaaacataagagattaagataagacctacaataaaataagacatacgatataaatttggatcagcatttggtaaaaaccaacgaattccaagtatcgaaatagccataaataagactattaattgagcaacaatgtcatgagcaatatgcatccagcctggatcattgggaattaatccaactaaagcaattgaaatagcacaaagtgtcaataaaacttgcaaaatattttgtcgataatgactgcccgctttttgtcttaatgaaacaaaaatataatcaattaatgctgcaaataaggctgccgaaacaattaacgtcagattaaattgccagcttgaacgtgaagcctgagttccaagcaaactaaaattcctttgccaccagtactgatttccattggtggccatacttgagacgaaaccaccaacagaaaccactaaaagcattgttaccatcatattaatcgaaaaagtatctacaacaaaaatcatgacataattaatgattccagaaaaaatagtaaagattaaggtggaagtaaagagtccaaaacttacaccataaaaaatttgacctaaaaaccaaaataagcccatcgatgctaaaatgacgataagtaaaacagataaagtgactgtggcaaatgtccgccagtaacttcttttggtcatctgtttataaaattcttttcttcgagagaaataagcagaaataaaagtcagcatccctattgcattagcaattgtaataaccgccgttgccaaagattcatttccagaaagagcgatgacatgaggatgctttaggacaaaggcaaaaataataaagataaatgcagaaataatcgttggaataataaaccacttgggcgccttatctgattttctggcattgatttttcgaatggtaaaactatcagccgctaaatcgacgatttcaatttcttcgttttctttaaggtctaatcgttcatatatttctttaggtagatgaattttatccatttgtttctccttccacactttgctctttccagtcaattctcaaatgataatcggctattttttgggcaccttgcgaaagttggtaattaattttaattgtcctgctctcatgatcaatgcttaaagcatttgtcagaattgatagttctcctaaaccttcatattcagttaaacctggaatttctggatgaaaatgcattttgataggtcgctttgcaaagcgggtcattatcacttctttttcatcaaatttaagtaaaactttttcatttgcagcattttgatacttgagtaaggtctgatgttctccttttttcaactctccctgatatatttctttgaccaactcttcttgctggtcaattttaattctattcctaattataatttccataatcatattttactataattccttgaatattaaaaacatagtctgtgctaaaaagattaaggtgatgagggtctgcattttggaagaaaatagggtataattaagataaaataaggaaaaatctgattaatttttaatagagaatagaccttaaattttagagggggttttattttggaaaaagtctttcgtgacccagttcatgactatatcacggtgaatcatcctgtaatatcagaattgattgacactgctgaattccaacgtttaagacgaattaaacaacttggtacatcaagttttaccttccatggagctgaacatacccgtttttctcattgtttgggtgtttaccacattgccaaaaggattactgattattttagtcggaatttccctttggaatggaatcctgatgagaatcttttaactcagtgtgcagccttattacacgatgttggacatggtgcttattcacacacttttgaaggtttatttaatacagaccacgaggcggtcactcgagaaataattacttctcctgatacagaaattaatggaattttacgcaaggtctctcctgattttcctgaaaaagtggcctctgtcatttctcatgaatattctaatcctcaagttgttcaattgatttcaagtcaaattgatgctgaccgcatggattatctccttagagatgcttattttactggtgctgtctatggacaatttgatttaacttggattttaagagtgattgttcctacggaaaatggaattgcttttaagtactcaggaatgcatgcagttgaagactatattgtcagtcgataccaaatgtatatgcaggtttattttcatgcttcttcacgctcaatggaagttttactgcaaaagttactcgcacgtgctaagtttttatatgccagtcagccagactattttgcgatatcaagtccttgtctcgttccctttttcgagcaaaatcataatttacaagattatttaagacttgatgatggcgttatgaatacttattttcaagtttggatgagtcatgatgatgaaattctcgctgatttagcttctgcttatgtcaatcgtcatttactcaaatcgattacttttgaccccaagactgtagaattggaagatttagaaattttatcttctttagttgaagaagcaggctttaatcctgattattacactggtattcatagtaattatgatttgccttatgatttctatcgaccaagttctgaaaaaccgcggactgaaattaatattttacaaaaaaatggttcgcttacagagctgtcagtactttctccacttattaaaagtttgacaggtacaattcatggaaatagccgattctattttccaaaaattatgctagaaaatcctgaatttaccaagtatattgttaatgacagcttggtgattaatcaaaattttactgacagaaattctactgcctctgaaaatactgacgactctgtcagtaaacaattatcacttgatgacaacctataattgctaaatatttaataaattgaaagaaatagaaagagaaattcttatgattaaacttgttgctattgaccttgacggaactttacttgatcctaatcgccaaattactgccgaagtaaaaacggctgttaaaaaagctaaagcggctggcgttaaaattgtcattacaactggccgacctttacctggtgttgttgatattctaaaagcacttgaattaactgaccaaagtgattatgttattacttataatggtgggttggttcagcgagcaactggtgaagaatttatcaaagaaactttgagttctgaagattggcttgacttagatgctgctgctcgtaaaattggactaccgattcacgcaatcactcgcgagggaatctatactccaaatcatgatgtcggaagatatactgtccaagaagcccaaatggttaaaatgccactttatattcgccaacccgaagatattgctgctttagaaattgctaaagtaatgatggttgatgaacctgcggcacttgatgacggaattgcataccttccctttgaattctttgaactatataatgtagtgaaatcaacaccgttttatttagaattcatgaataaaaaagcaagtaaagggtcagcagttcaacatttggctgagaaactttcttttgacttggatgaagtaatggctattggagatgaagaaaatgaccgttcaatgcttgaagttgcaggttgtcctgttgtgatggaaaacggaaaatcggaattgaaaaaaattgctaaatatgtaactaaatcaaatgctaaatcaggcgttgcttatgcgattaatgaatgggttttgaaagattaccaagattaattaaaaatttatgagcattattgttccctactgaactttttagcgttataatataagtataaaaagataacaaatagatgaatttacaagtcatcttttgatatatagtggaggtaataagatgaaaattacttttgatgaaaaaacagctgataaaattaaagcatttggtgatgttgatttagtttttgattttgaccatactttgagtgaagtcaatactgaagttgacgcttgtgcaggtggaatttctcgctatcgtattgttgccgtggaaaaaggaaacgttcctgaagtctttgatgcaagtattgattctgaatttggaccaatttattataaaggctatggttcttacttcttccaagatgaaatgtctaccaaaatcaatccttcatataatttgattgaattgcgtagtacagctgaattgcttagccctaaccttttaatcgttgacttccgtggtaaacaaaaagctagctaattagttccaaccaaaaaggccctccaagagggtcttttttatatgtcataaaatggatttgtcttttcttggctttcataaatcttgacacccatatcaaaagatcgaagcttgtcagcaactaatccaataaaagcatgctcaatatagtgaccagggtctattcctaataaaccagctgaaagcatatcatgaccaacatgataataaatatctcctgttatgtaaatatctgcctttttttccaaagctttagcccataattttccacctgaaccaccacaaattgcaattcttccaattttttgagtcaaattatgatcataagtgataagacgtaatctatctaacccaaatgctgatttcactttttctgtcagcactgataattctgtcagttcaatatttccaacacgtcccaatccttcttcgtcatctagcacttcaatatcagtcattccaagtaactgactgaaataatcgtttaaaccaccagtaaccacatcaatatttgtatggctggtataaacagcaattccagctcgcgccaaatccaaaactaatttttcctgatcattcattgaagtcaatgcagaaagggggcggaaaatcaaaggatgtttagcaataatcagattcacacccagcgcttttgcttctgccactgtttgctcacgaatatccaaggttaccaaaacttttgttagttcatcgtttgggttcccaacttgtaaacctacaggatcaccttcaacagctaattctttggggcaaaatttttcgtattcaagcataaaatcagaaattttcatcgaagcacttcctcaattctcgcaatttgatttaaaacctcttgacgtttttcagcttgttcttcaggcaaacgagcaataattttattcaaagtatttaattccttttgccatttttgttgaaaaacagttgatttttctttagataaaaaagggccaaatgttaaatcatttactgacaacttttctgtcattaattttgagagtggttcggcaacaataatctcgtaaaacttaccagcctccaataaaatctcttcttttttaatgacaaattgatgattcactaaccactgacgtagactttcctcatgattattaggctgcaaaatcaaacgattaacatgacttaacttttctttgcctgcctctaaaatttcggaaattaatattcctcccataccagcaatcacgattgtatcaatcttgtcagtattttcaatagcacctaagccattggccaatcgaaccacaatccgatcacttaaatcagcttctgctacatgatttttagcaatttcaaaaggtcctttaaccacttctcctgctattgcaaaatcaatgacagctttttgcatcaaataagttggtaaataagcatggtctgagccgatatcagcgagccttgctccattgtcgacatagtcagcaactgctttcaagcgttttgaaagtttaatttcattcattttttaaatatttctttccaaatttacaataatctaaaacaggacaatctgcacattttggttttttggctgtacaatgatagcgaccaaagaaaatcagatgatgatgtgcttgaacccatttttcctcaggaattagctgcatcaacttttcttcaacttctaaaactgttgctttttggggaacgatatccaaacgtttagaaactcgttcaacatgtgtatcaaccgcaatccccggaattccgtaagcttctgctaaaacaacatttgctgtttttcgacccacccccggtaaagtttgtaatacctttttatcctttggcaaatcaggcaaaaggtccccaaagtcggtcactaacatctgtgatgtccgtaaaatatttttagctttagtcttgtaaagaccaattgtccgaatcagcttctcaatttcttccacatttgcctgcgacattgtttgtgcatctggaaaagcggcaaaaagagccggcgtcgctttattaacccctttgtcagttgcttgggcagataaaatcgtcgcaatcaatagttgaaaaggagtttcccactctaattctccgtgagcttgcggaaacatgtcttcaataatttttaaagcttcaagatatctttttttacttaacatcgtgcacgtccattatctctattaactattccatggtccatccaaaggaatataaaaatcttcttgtggtttctttctcttagcttcttcgcgttccatttggcgagtctcaatcgcttgaagagaattcaccccatcatttttccaatttcgtaaaatagctttaatgtaatttaaagataccttacgattgaggactgcttcacgcaaagcttgtttaatcaacgaaaagtcataaccatcttcaaacagccaagctctcaattcttccatttgtacaggagaaatcatgcccatttctgcttcaaacatgctaactaattctttaagctgcccctcttcttgaactttttcattctctggagttgaactcgcaacagcaccacccaaaatttcatctaagtgcttaaaggccgggctaatatcaaagaaagtttccatttctccatcaatttcaattaaagtcaccttcattgctccaaatttggacagattatcaatggcctgattgacctccgataattttttacctgttttttcagcaatttcactaggtgcaatatcttgattttcaaaaaagtataaccaaatcaaaaaatcaaaagcagaagggaacagcttactaaaatgtgctaaaaacacatttggtaagacaagatgccctttgctatattcatcgtaataattcatagaactattataccatagtctgacaatgctgttcaatggagttactagttaataaaattaaagtttttcattactttattaaagtaaaaatacgctccttattaaatctcttaattactaatcaactcagctgcacatctttatcatccatataattaaagctgtctctttgagcgaagatggatacatttcaattctcagtttcatccatgaaaaaaacaagaaaaagtttttttatatctttttcttgttttttaaaatttaattttcaaaccataaataaatcgattgattaatgttgtggatttgcaaaattttggtttttcaaaattaaatgaacagtatcaacactttcttgcgtaattgttttttgagtccatgggtatccgcctgtagtatgagataaaattgcattcataacatcgtcatcaatgttaatacggtagccatctggcattccatagtattgtcctcctgaagtatggtctaaacctagcgaatgaccaagttcatgtcgaattgtaataaaaagtaaattaacatcataatctggtgcctccgaatcaagcgcccagttgactagtgtactttcaattccagtattgccacttgatgttgcactaccatcgccttctggatttggagaaatcactaaggttactggttcagtcgattcacttgattttataattgtgggttctttgggattgattgcggcattccaactttctgcagcccggtcaatttctttattaaatgctgcaagagccttttctggatcagattctgctgcaaaatcttctattttcgcttttgattcataaatgattttaccttgtgaattataagcattagataccatttgagaattggaaacctcgggatttgagccataagttattgttgagcctaaaaacatcccatcaggtaattttattcctgaactatttacacttggataagttgcagccaaatccaaattcaaagcatgttcatctacccaataccaattatcaccttctaaactaacatttacaaaattggtagtttgcccttttttatcaccagaggtataggtaacaggcactgtttctttattataaagtgtctttcctgttagattccccagagaaatgatattatccgtatcgagttgaccattttctaattttgaataaaattgatagtcattattaagtacaacgttatatctataaggattcaagggagttgtagccgtgggaataaagtcagaaagtggtttatcattgctataatcagtaacttctcctaattccatttcgctaccagacatattttgccatacataagtatctgccatcgttgctgcatcaaagtttgtcatgaattcacttgaagtccaaatatgatctcctgttggattatctagcgtgccagaaccaacattttgccatttacctgtgtagccattcgtgactggtacatttgctaaattcatgtcagaatttaattgacttgccagacctaattttagattttttagattatttgtttgactaaacattgcttgactatccgtattttcagaaattgtaaaagaactcaaatctaatttttcaagtgctttcatcctactaaacatactttccatgcttcttacgcttgctgtattaaaattatttatatcaagatgttcaagtttttccgctccaagaaacatataattcatatccgttactttacttgtatcaaaattagaaagatcaagactggatatattactgacactatcaaacatcccagccatactaaccacgttactggtgttaaaactagaaacatctatttgtgtgatttttgacaactttacaaataggtaagacatatccgttactttacttgtatcaaaatttgaaagatcaagactagtcaaattactggcaccatcaaacattcctcgcatgtttgtgacattagacgtatcaaacttggaaacatctaacgtacttgccttaattccaaaaaacatatactccatacttgaaattttactcgtatcaaaaccagctaaatcgatttcctctaaatttgtagcacttaaaaacatagaatcagtacttcccgagtaatttaaattacctaatttcaatactttttggagttctggcaaatctacaaatgctctagagatgttattagcacttgtttttgttgtaaattcgatactttttaccgctgctgggtctatatttgcttcacgcaaaacttctggtaaactttgacttggatgtccgatatttcctccaaaaaatattagttctccatcattggctaaaacccaattagcctcaccccattttccagaactggcttttacatccgcagaaatagtaacagcatgaggattaattattgttggtccatagcttacaataccaaccgaaaggctggcgagcgttgccccaagaagtaacatttgagtttttgacaagttttttttcataaattctcctccttttaataagataattatagcatttaaattataaataaattataaatatggtcttttgttaatttttttataatcaattatttgtaccaaatcagttatacccatcatccactcaaactcccaaagataatttcttctttgctactcaacaaaaaggaattgtttgctttttatccaaaacgcttcatttcaatggataattcgattttgtttttttatagtaattattttcttcaattacatttttgtaagaatttagcaagcaaatccttgatatactatacttatagacaaaaggacatttgaaaggaaataaacaatgaaaacacaaacagaaaaaattactcaaaaagtagaaaatgaaaaatcaatcaaagataatttagaaattatccactcacttaatgacttactctacaacggttctttatattgatgtaaagtaacacaaaaaaaggacctatgaaaattaatttcttaggtccttttttttattatttcgcttgatagactatttttccatcacatattgtatatttgacttgcccttgaactttttgtttaataaatggagaattggtcgctttggagtcaaatgtttcaccgatctgatactcattttcagcatcaaaaatgacgaggtcagccggtccattttctgcgaggtaacctacatcaaaattataaagtttagctggattaacggtcatttttgtcagtaattcactgagtgttaaatggccttttgcgactaagtttgtcaatccaagttgcaaggaagtttctaatccaatcattcctgaaggagccttatcaatgctgacatttttctcttcatgagtatgaggagcatggtctgtggcgatgacatcaattgtcccatcttttaatccctcaaatattttatcgatatcagccgttctacgcagtggtggattgagtttagcatttgttccctgctcataaatcatttgttctgtaatcgaaaaatgttgtggagtcacttctgctgtgatttttgctcctaaatttttggcaaatctcaccacttcaacagattctccagctgataaatgttgaatgtgcaagcgagcgcctgtttcgtaagcaatcatagtatcacgtgccatcatgctgtattctgaaacagtcggtgcccctgtgaagccatatttatgagccacttcgccatcattcactcctaaagttccaatcaaatttggatcttcttcatgaattgaaatcaggctgtcagttaatttcgctttttgcagcgctttacgtaaaactccagcatctgtcagtggaataccatcatcagaaaagccgattgctcctgctttaatgagtgcatcaaaatctgttaaattttctccatcaaaatcttgcgtaattgacccaactgcatcaatcttaatgtcttctttgtcagcaatttctaaagtttctgtcagcacttttggcgtagataaaataggttttgtatttgccatcatgactactcttgtaaaaccaccagccgcagccgattttgcaccactatgaatcgtttctttatgcgtttgtcctggttcacgaaaatgaacatgaacatcaattaaaccaggggcaacgactaatccccttgcatcaacaatttctgcattttctactgacaaatttaagccgatttttactatcttgtcattttcaatcagaatatctaacacttcatctcgatttgatttggggtcaacaagtcgtccatttttaattaataaagtcattttctccctttcataaattactgacagaacaatcagctttgctgacttgttcatttatccaccgattcaaagtctccctttggtcgcattgaactgacagatgttccagaacctaataatttactgacaggctctttgaatttctgtcagtaaattaatcttgccaagtttcttgattttctttgaactttttaagtaattctaattcttcttttgtcacataacccgtttctttagcaatttcaatcagctcagaataagttgtcaatgtggctaatttaacaccagcctcagtaaatttactgttcgctttttctaattcataagtgaaaattgcaaccacaccaagaacatcagcaccttcacgttctgcggctgcaacagcttctaaaacagaaccaccagtcgaaatcaaatcttcaaccacaaccattttttggccttttgccacacgtccctcaacctgatttcctgctccatggtcttttggtttgctacgaatataagcaaatggtaatttaagatagtcagaaataattgcaccatgaggaattcctgctgtagcagttcctgcaatgacttcaacttctggaaattccgctttaatcaattcagcaaaagccccttcgatttggtttcttacttccggataagctaaggtcacccgattatcagtatatattggcgacttaattcctgaagcccaagtaaaaggttgacttggtgagagactgaccgctttaatttccaataaatctgcagcaatggcttttgatattgacatgatttctccttctcaatttactgacagaatggtcagcaataaaaaacacttgccaagaatcctagcaagtgtaaaaagtatcaaaacaaattcacttttactgacagaaaatcctgtcagtaaaaatagaatcaatttttcctgatttcaaccttgctagcctctctggactagtttaaaagttatattgtttattagtttaacaaacttgagccagatttgcaagtcttattttttcgatttatgataattggaatcaaaaaacattgtaataatattgaatgcaactatagacaagccaacccatttcattctattatcagccgaatagtttgtatagacataccaagccaaaaccataaaaagaagtcttaaaatgatatctgctaaaaatataaattttttcattaaatttcctcattgattgaaagcaaattctacgcccataagctcttttctcttttcttttatttagatttcctataagcattaattgcttctggtatgataatgagaagcagaacagcaatataaaatatttgtactaaaatattttgatgaaagaaaaatatacttatgcttgcacttattacaagcactcctttaaaaattggtaagattcttttcatagctaaacctccaaatgcttattggaattgaaccatttctataaatccccagccctaaccctatcatttatttctatgaaaagtttgcatgataagacttaaaatgctaagaattactgcaatactcgcaaaaatatatttaagtatgctaaggccatttggaaaaataaaaattaaaacaccgagtattacggcaaatatactactcagatattgtacgattcttatactctttttagtaatcattgccattcaaacccccagactcctccacttggcattccagcagtaaaattaaatacaatgcctcctggagttttagttaatgctgtgccaataagatatgagacaccactaataaagctacaatacaccgctgcttgaggaagcttaagtcctaaaactcctgccaaagcgcctgctgcttcggctgagtgaacacccttttgtccaattttccgtgccaatgtacgggaaactcctaaacgagttccccaccaataagtatgtaaataggtcttcccctcatgatagattgtgattagagttgcttgactatcgctagctatttcttctgcagttttcggactatctccaattacaactgaattcccgtcttgcaccacattggctttaggaacttctaaaatagtctgcttcaaagagacatttgattgcgaaatcaatttatcaagctctgtcaattcaagctttgtcgcatttattggtaaagtcttttgatttattgaaaattgattagtttttgaatctaagataacagcattattgaaacgattgataaatgccgaattaatttgaccattattcgtcgttggcgtagttggttggcttactgccaacaagtcaatatcaccagaatagtttgaaacttgatttacatttttagcttcgagtttttgtgatgagaccttattgtgtgtagattgggcaagtccaagacttccacccgttacgagtaaaattgttagacttgaaaatactagattattttttaaatgtgacatattttttctcctttttgagatgcgatgcaaatcaatagagattttgcatcactgctacggtgacatttcttctttcaagatttgtaaccctccttttaccattctgagtgagcgacactcaagattcatgaatcattttctaaaatgattatatcaaatcaaaataccccaaaaggccttttccgaaatctcggaaaaattttttataaaaaataaaaagggaactcaaatcccttttatatcccactagttttttacagattcatcaaatattttttgataataagccttcatctctggcaaacccaattcatcaaaaagacggatagaactctccattttagctttcccatcgacagctttgccagattgataaaacaataagccaagagtaaagcgagacatattacggcaaaataaatcctttttataaggtattaaagcaatattaacatcttccaagagtttttgagcaatggaaaatttattctcactaatatactttacagctgctcggcaaacaatttggacaattttttcacgatattttttaactttgagatagtgcaaattttctttccaaaagtctttcatcaaagagagagtcaaacgggtattcaagtgttctacaacaaacgaaagaatacttaactcaaaatatgaccaaacttcgatattaaacattaaatcagtaacttcaacttcttctcgctctgtcaatccatatagcaaattttgagtcgcaagaaatatcagtcggtttccttgttcattatcatattttctagattcattattaatcgcttttaattttacagtatcttgcatataattcgcatcttcaatttcatcacaaatctcaacaaaataatcagaatggtaattgttaaaaaaatattcaaactcagaaacttcaatatgcattaattctaaagctgcatctaatttatcaaatctaagaataaactttccgctttcaaaatctgacagtgatgattttgaaagacctactttttcaaagtcagttaatctaaagtttcgttgcgttcgtaaatcatagaaaatttctcccattatagagattgctctattgttttttaccattccatattccagcgtttcaatttttttgatcaaattttactacttttttaacgaaaaagcaacaataatttcactttgttcaaatataagttttttagattacaaaacaaaaaacgcaaagctttcaagcttcgcgttttagcttatttccactaaatccacttcacagtacttacaaattttccaattcttccatcgcttctaaaagagttagctctagctcatctttttcatcattaaagcggtcaatttcagcttgtaattctcctaatttaacaaaatcagcggtattttcttgcatttccaataaaagcgctgcgatttttgtttccaaatcggctagtttctcttcacaagccttgatttcgcgttctactttacgtcgattcttttgagcttctttctgagctgtaaaatcttgttgagctaaactttctattggttccccattttctgaagaattactctcagcttgtacctcttcttttttctcaacataataatcataatctcccaaaaattctgtacttccttcgggagcaatttctaaaactttggtagctactctattgatgaaatagcggtcatgagaaacaaacaagattgtccctggaaaatcaatcaaagcattctccaagacctcacgtgaatcaatatccaagtgattggttggttcatctaaaactaaaaagttatcgtgatccattgctaatttagcaagtaaaagacgggctttttcaccaccagaaagcatcccaaccgttttctttacatcatctccactaaaaagaaaggctccaagcatattgcgaatttcaacttcattaagtaagcgatgctcattccataattcgtctaagacagtattggaagctgtcaatcttccttgttcttggtcataatatcccaaagtaacattggcacccaattttgcttgacctgctaaaaatggaacctgtccaacaattgacttaatcaatgttgttttacctactccatttggcccaacaatagcaagggactcgcctttacgctcgtcaatgttaatcggaccagagagaagattatcttcataacccaccgttgcttctgaaacggttaaaacaacatttccagacgttttttcaggagtaaaagtaacattggccgatttatcatcacttgttggtgcgtctaaacgctccattttctccaactttttacgacgtgattgtgccattttagtcgtcgaagcccgaactaaatttttggcaacataatcctctaatttagcaatttctttttgttgtttttcaaaatttttgagctcagtgagtaatttttgctctctttgttcgacatagcgcgagtagtttccagaaaaacgagtcaattctcctcgcgacaactccaagacctcattaactactttatccaaaaagtagcggtcatgactgacaatcaataaacttccttcgtaatttttaaggtaattttcaagccaagctaaagtttcaatatccaagtggttagttggttcatccaaaatcaaaagttgtggtctttcaagcaacatcttagcaagagccaaacgtgttttttgtccccccgataaacttgaaatttctctttcccacattgtttcatcaaaacgaaacccatttaagacagacttaatttcagattcataagtaaatccatttttaatccgaaattcttctgataaagcatcgtaacgtttcatcaaagctgtcaattcatccccagcaagttctcccatttgcaattccatctggcgcaattgtttttccatttggcgaagcgaatcaaaaacagagagcatttctgcaaatattgtccttgaggaatttagcccagtatcttgcgctaaataattcattgtcaaatctttggtcttggatacagttccgcgactcgcttcttcaactccagcaataattttaagcaaggttgacttaccagctccatttcggccaactagggcaattcttgaatggtcttgtaaactaaaattgatattttcaaataaaatatcgccaccaaaagtgcgtgcaattccattcccttgcagtaaaatcatgatatttatcctcttcgttaaatctcaaagcatattttttaatacttcgtttttccttttcatatgatagaaaagcagtccttctattatagcatttaaggcaagctttttgtagttcttccaaattcttgaaattaaaaagcttaccaaatctgataagctaaaataaaattaatattagactaaaattaatctttcacgcaattcaattctcctaacttctggtggaataaacgctctgattccatcctcgttaaaaccaatcaatagacagtcctcgtcaaaaattaatggtcgttttagaagacgtggattttcctgaattaatttaaatgctttttctagtcctaattcatcgaaattataatttaaagatgcgtatgttttccctcgggtcgcaattatatcctcaaatccgttttcagtcaaggataaaattttgattaaatcatctttttccataacatcttttgataaatttatttcttcaaattcaatgtgacgcttacgcaaccattttttagcttttctacaagatgaacatgaaccactaagataaattttaatcatattttctccctgtctattttttcatatttctattttaacatgaaagcgcaataattaaaagagtaaaataaacatttttttagaattataatttatttctcattttaaacaaataatccattccttttgtttgataatttcacaaatttttgataaaattatcacaaagaaactaaatattaattagttttaataaaatcgaattaaattttgaggtataacaatgactgatcataaaccaagcaaaagcttgcctaaagcaactgctaaaagactcccacagtactatcgactgtttaaaagtcttgtcgaagaaaacgtgacacgcacaaactcacaacttatttcagaaaaaattggagtagatgctgccacaattcgccgtgatttctctttatttggtgaattaggccgacgtggatacggctatgaaacaaaagtgctccgtgatttctttggagaacttcttggccaagaccaagaaacgcatatcgctctaattggtgtcggaaatctcggtcgtgcattacttcattatcaattccaagatagaaataaaatgagaatcacgcaagcctatgatatttctggcaatcccttagttggaacacaaacagatgatggaattccaatttataatatttctgatttagaaaaaaatgttaaaaaatcggatatcaaaacagcaattctctctgttcgcaaagaaaatgcccaagaagttgttgacactctagtcaaagctggtatcaaaggtttcctaaactttgccccaattcgtttgaaagtcccttcagatgtggttgttcaatcaattgacttaactaaggagctgcaaacactactatttttcatgaacggtaacaagcaagaataaaataaatataaattaaaaacggcataatatagccgttttttctattttaaaaataactaaaaactatagaaataaaaaactcgtacaacaaaattacaacatatcattagatttaatcttgttttgttgtaaatttacaacagcaaataaaaataaaaaatgccagcaaattgctgacacccatgtttaagattttcattataacatataaaacaaataaaaaagccgctccgaagagcagcttaactatagaaaggagatgaaattccacaatcatcccgagtatattatagcataaaaaaacgcccaccatttggcgagcgttttaaagagtgaatacatcacaaaagtaaacatctagagtatatcatttttacaatatgttagcaagaattagaattaaaaaaagcacctctatttaaaaggtgctcagaaagatattttataatatacttttagggtaaatttattatataaaatatttttaattcattcaaataaaaagcctccaaattatgaaggccgaattgaaattagtgttacggaacaaattatacttaatgcccgtttccgttgtaaagaaaaacgcccttaccttgaaaaggacgctcactgtgcttctaaatatttagctatttgtatttggaaggacaactatgatgattgaattatatcaacatttataaagttaaacagtaacatttgttaacaaaaaagacccccaattaaggggtgtcagtgttagaaacttaattatagcaaacttcttaacgagaacaaagaaaaacgccccggagggcgagatcttacttcgaaattaattatttctagagacaactgcttgagggaaagcttcttttttagtataaataatttttatttgtttagatatagggctataatttttgcttaattcttttacaatttctaacatttctttactcataattactcctcttctaatatcgaaataaaagattttgataaactacttagattattatctcataaataagtatattaatcaataacttcatctacgacttttaattctttataacctttagtagacataaatacattgaattgttcagatttagaaaatttcttgaatatcggccatgacatgaaatcatttatcatacttgtttcatcttcatatgcttctttatcttcatttattacctcttcaaattcttttattgcctcttcataattttcatctaaaatttctaggcacatttgatgtcgatgatcagctaaagaaaaatcctcttctttcaataatttttttaattcttttgttttatcaatccatttaagactctgcatataatttatacacaataacattttctcagaagctttcagggcatctctgtctttccatagcatattataaatctcatatgcaactttattttcaccaattttcagattttcatatgcaattgtttgataaaaagaaaagatttctttcctatttgttgcaaaatttttcttagtaacatagtagctagattttattcctacgatataaattaaagataagttttccagtaaatattcttcgtttacagagattctacttccaatcatttttttcttttgttcatccgaataatcatttttaagtgtatttaaatattttttgttaattttcgaattactatgtataattaaatttctttttagaaaaaagtcaacaaagcactgttcttctttcccaactaactcgttaaaaaattcttttgatgtatttttcccgatatattttaaccaatgaatttgactccctcgcatgatatcttcaaccgttttttcaattagatagtcttttgcttcttctaagccaccaagttcctcaatttgcttaaaagtaagagttttttcttgaatttttactgattcatcttttattactaaaaatgatattaagttcgaaattagtgactcaaaaacattactaatcgtaatcagagaggtttcattcaaaagccttgcttgctcacttctttttagctgctcatcttgatataatttgatatttgaccgcatgtttctatcatcgatactcaaaactatagaattcgattcattatcaatagagaatacaaccccttcttttatcccattcgattccttcgagaaaatgctcaaaatctcatcaaaaatttctttcggttctgcatcaaaatttattttttccatcaaaaagttattctcaagttttttcaactcttcaacaaaccgacttgaatttgctcggagatcaacatacattttattcaataagttaaataaagtaaatatggcttgttcttcttctttcaagtcaacacttaatttaaaagttgtccccataatttctttaatcgatttaatataccttctgtttgccaacatttgtgatgagaattgttgagtattctcaaatacttgctccatattttttccatatcccctttaaataatttattatacattttataccaaaaacacccgccgaagcaggggatatttaaataaaatttaaagatcctagctttggacaagggattcttaaaataagacgctaattagaatttagttcataaagaggatatgggattcgaacccacacacgcttttacacgcctgacggttttcaataccgttaccttcagccagactttggtaatcctccgaactactaaattagtatatcatttaattttagatattacaagagaaaaacgaacgtgtaacatatacattgctttttttcgtttaataaattaaaaaagccctgaccgaagtcagggttaattttaatattttaaagtttgaccagcataaatcaaattagggtttgaaataccattcattgaaactaaactttgaactgttgttcctaaacgacttgcaattgatgaaagattatcgcctgagcgtacggtataacttcgtgatgtagcttcagattgaccgcctgtgaagcgaataacctgaccagagtaaatcatgttcggattagataaactgttctgacgagccaattcttgccagtttgtgccccaatttgaagcaattccactcaaagtatcgcctgattggacgatgtgagtttgagtatttccagttgaattacttcctcctgtatctagtgcttgaacatcacttgcggcaacccagctcatgatattatcaagcaagactttactgcctgatttttgaaggaccttgtatgagttttccttaacccatttaggaattgcttgacctgttgagtaattcgttgcactaaacttggaatttttttaagccttcaatgatttcctgttccagaacttgggctttttgtgccacttcaactcgaggaataatctcaccttttatatcaatttttatcttatttttaaaaagtgaaacagcgatttttgagtttttaaggtaatcattttcttttactttttcacctacaaaaccttcaatggcagacttttttaaagttaaatctccattatttgaagtgagttgtacatccatataggttcgaggataaaaaagaattacaatcaaggcgagaattaatatgactgttaaaacgatgttcccccaaaacaaatagtctgtcatatattttcctatgaacggaatgttactagaggtcgttgtcctccaatcatactccatgaaattgtaataatcccaagtcattggtagaacaagcgtaagtaaaaggagatcaaggataatgagtattattttctttccagttgccaaaactcctcctttctagatcctaagatctactaattcattttagataggacgaaagatacaacagcaaccacaatcactgcaccaacaatggatgggattagcgccataccagctagcgagggaccccaagttccaagtaaggcttgacctacaaaagatccaactaaccctgctaagatattagcaatccagcccattgaacttcccttatttgtaatcgcaccagcgattaatccgattaatgcaccaataattaatgaccaaatcataagccacctctttctaaaaaatgtaatttatttcttactttaatttaacacatatagaaagcgcatacaagagatatgatttgtttttttaatttactaataccaataattgtggcacttcaaataactaaaaaaaataaaaaaagccagcattgctggcacttatgtttaaggtactccattataacatatctctctatttttgatcttaagactatctatatggtattattaatttgtatgttttaaatattaacttcttaatctatgaacatgcaccaaaaaactgcctatcattatgtgctgtgataggtggtttttatataaatcttttaaatataaactttatttaataaatattgaaaaaaccactctatattagagtggccctaatttatgcatgggaagtgtgagtttcctcttgctggctaagtatatcatactctctcataattgcaactgaatataaaaaaactgaagtaatgactccagtttttgcacgattttcagatataattatgcttttgtgatattaactgcttgaggtccacgttgaccttcttcaacatcaaattcaactttttgaccttcgtcaagtgatttgaatccatcagattggattgctgagaagtgagcgaacaaatcttgaccatcttcagaggtaataaaaccaaatcctttagtagcgttaaaccattttactgttccatttgccataatatttatttcctttcgacaaaaattgtaaatctcattttgcgaaaagtgaatctataaaacattttactcatgacaaaatctacttcttcatagtaacactaattatactcaatgtcaaactactcactcattaataaaatccatatcgtaatgacatggattttatgaactgtagggaaagcaactaatcttcccctcactcagtataacattttaattcatttttgcaatagcaataaataaaaagcacaggacatcccatgctttaaatcatttatcttttatgtacgtttgaagcataacgcccacgagacgtcattttgatatcaaaagtaaccttttgaccttcatcgtattttttaaattcatttccttgaatagacaagaggtaggcaaacacatcttgcatatcatctgccataataaaaccatagcctttgtcagcgttaaaccaatttattgttcctttattcatataatacatcctttcgcatcatctgtaaatcctattttgcgaaaaagtgcattcctaaaacatttaaactcgagacaaaacctacctcttaatagtaacacctattcttaccaaagtcaaattggtctatttaaaacttattgatcttcttatgattcccaagattttcatgaggatttgctttagcaagtgtcaaggtttctctatccacaactctgacatcatggttttctaattcaacaattaatgcattcttatagagattaacatctccagaaacgactgttgcttgttccccattagataatgtaattttatctcctgttttcatttttcacttccattctaggctccgcctatttaacgaaaaaatttcactttagggtgagttttttataagaaaaataagggctccctaaagcccttaaaatattgcgggaataggatttgaacctatgaccttcgggttatgagcccgacgagctacctagctgctccatcccgcttcgcaagtataacactaatatcagttaaagtcaatttaagccttaaacttcgataattatttaactaaaaaatgttcttgtgaacagaactcaaaatttttctcacatcagaaaacttattactaggtatataactaatatacttactacaaacccaaaaaatagtaagcttataatcgcttttttctctttattcttattcgttagacattcctcactcttattagcaacttaattctttaccactacacattattttaaaaaagctactcacaattgagcagctaatgatgaaggtgtggtgctttcgctaaaccacccatgagctaagtatatcactttaattccaaattacaatagtaatcaaaaatagaaaccaattttggtttctattctacaacagagactgtgatctcataaaattaagtatagcaccttgttaagctcaatactgattattagtttacaaagagaaaaacatatagcttaacaaaataaaaagttattagttcaattcttaatgactctttagtttattttttgttgaaatcttctaaaataatatacttagttccttaactttataaactcaaaaattcaatgagattaaatcgtagctatgattttatactataattgccccaaatttgtcccattttatttttcaatttaagaggttttctatgaaacaggtttataaaggcttatagaacctgaatttaactttgagagctacctaaataatcccctcttctccttacaatatatatctttttttataactattttgtatttttataattttacacttgttttttaagtaaatataaaattattaagagtttttctagtatcgatttattcggtaaattttattttaatttttataatacactgttacaaaggcagtcatgaatattcccatatttgaaataaacgctcaacgcgtttgcttaatattaaaacacataaaataaaaagtcactaaagtttagtggctctttattttataagttttctattgttttcaataatgtctagttgatttatatattttaaattttacccactatttacccactaaattttattttagtttctataatgcattgctacacaggcatccaataatattcccatatttgaaataattttgggcatttcaacttttcttattctaaataagataatacataatttgtgaaatactgccttccaaagtaagacctagaaatttacttttctcatacttaaattattaggtatttagcatcactaaaagaactttcgattatgttgcaaaaagttaaaagataacaaagaaatgaaacttttttatagttgtaatattgccttaatatttacaattaccattatattttgttgaactacatgctagaaatatatagattttatattattattcttttgtaaataaagaatatgctaaatagaaatttcctaacgttgctgaaccattttctttgacagttggtaagcgaatatacttttctacagaacaaggcagatctatataattattaagcatagaaatgaattgtttttgtataagtgatatcatatttggtttttccattacaccacctcccaaaattatacactcgggagctaatgtcaatgttgcattaatagccgcttgagcaatataatagcttaagatatcccagataggatcatctgaagaaattttttccccaagtattcctgttctagcttcaagactcggacccgccgcaactccttcaagacaatcaccatggaagggacagattccttcaaaagtaagatcatctctatgacgatttattctttggtgccccatttccgaatgcccaatgccaccaataaaatatccattttgaattgctccccctccaatacctgtaccgattgttaaataaacaagattttttattcctgtatttttcatttcaccataggctgaggcgtttacatcagtagtaaaatatattggaatatcaagtgcttcttttaattggccaactaaatttatatttttccaaccaacttttggcgtcgaagtaatgtaaccatacgttttacttgaaaggtttagatcaataggcccaaatgatcctaaaccaatggcagaaactcggttttctttaaaatatttaatcgtcttacttatagtttcttgtggcgtagtagtagcaaatttgaatttttttataatattaaaatgttcatctgcaatagcaagtacaaattttgtaccaccagcctcaattgatccatagtatacggacatagttcgctccctctagttcaataatagaattttttctccaactttgatatcaacattttcactcaatggcaaaatctcattgtaacttgctgaatttgtaataacaataattacagtatcatcgaatccactcttcttgatttcttctttatcaaaagatcctagtaaatcccctgcttttactttctggccaactttaacattttgtatgaatccattaccattcattgaaacagtatctattccaatatgtaaaagaacttcacctccattttttgtttttataccataagcgtgacctgtttcataagcaataataatttctccgtcggctggtgagaaaagttctccagatttaggcttgattgcaataccttttcccataatttcttttgagaaaacagggtcacttacatcagacagaggaatcacaaatccatttattggagcaaggagttcgccacttttaactggatcgataataactttctcaggttggtattgagttgttgcattctgtttatttttttctttcgtaatagatttagcttccatccgccgaccatagattgaggtaacaacaaaagcaataagaaagctaataaatatcgaaatcataaattgtaagttatagccagctttaatagagataaagccaattaatcctgcggatcccagactaaccgcaaggacatggaataatcccataaataatgaaccaattgctgaagccccaagagcaataaagaacggatattttagttttagattaatcccaaataacgcaggttctgtaatacctagaatagcagatacaccagctggagctgcaagagcttttgtcttaatgtttttagtaacaaataaaattgcaaaagttgcaccagcttgagccatatttgcgcaggccgcaactggaaaaataaagtctccaccaataccactgtgttgatagtttgtgattaacattgtttcaatggccggaaaactctgatgtaatccagttactactattgccgagtagaagcctccaaacacaagcattcctagtgcccctaatgtgttataaagtccaaccaaaccatctgtcaagccatttgatacaaaacgaagtgctggtcccacaatagtgaatgtgagaaatccagttatgatgactgaaagtaacggagtaaatgtgaagtctatagcatcgttaaggtatttatgaaagaatctctcaagtttagcaaggataaaagccactccaattacaggaagaacttgtccttgatatccagcctgggcaactttaaaaccaaaaatatcccaataagtcattgtatgattagagattgcttcagcaacattatatccattaataagcccaggcattaccataatcatacctataacagcacctaaatatgggtttccaccaaacctttttgtggcagaatatcctattaaaattggcatgaatgtaaatggtgcggcactcatagtattaacaatatcagcaaatcctttccacataggaaacatttcaacaagtgatttcgtcgcgaaaagatgttcagctgttagcgcattattaagagccattaacagaccaccagctacaagagctggtatcaaaggaacaaaaatatcagaaagcagctttacaagtgccattactggattttgttttttttgacttcctgcaatctctttgagatctgcagttgatgcctcacttattcctgtaagtttaataaattcttcgtatacagtgttgacatcacctggccctacaataatttgatattgaccagctgcttcaaaagtccccttaagatctgggtcattatctagagccacttgatcaataacgccagtatcttttaggactaaacgtagtcgtgtcgcacaatgtgcagctccttgaatgttatcacgcccaactgcatttaaaatgcgttcagctacctgcttatgattcataattttctcctcaaataaaatgatttcgcttacagaagttattttatcatttttctgatatatgtcaagcgtttgccatatttttttattttttatttttccgtgcttatttatattgatttttttataaaaaacgtttatcataaatatatatataatttagtaagtgaggaaaaaaaatgaaatggtctaccaaacaacgatatcgtacctacgatagttattctgaaaatgatttagagagtttacacaaactggcactaaaatctccttggaaatcaaattttcatattgaaccagaaactggacttcttaatgatccaaatggattctcttatttcaatgaaaaatggcatttgttctaccaacattttccttttgggccagtacatggtttaaaatcatgggtacatctagtctcagatgatctcgtccactttgagaaaacagggctagtcctttatccagatacaaaatatgataatgctggagcttattctgggtctgctttagcttttgaaaactccttatttttaatatatacgggtaatcacagaggcaaagattgggttagaactccatatcaactcggagcaaaagttgacaaaaataatcagttagtcaaattcactgaaccactaatttttcctgatttttctcaaacaaccgaccattttcgagatccccaaattttttcatttcaaggacaaatttattgcttaattggtgctcaaagctctcaaaaaaatggtataatcaaactttataaagcaatagaaaataatttaactgattggaaagatttgggaaacttagatttttcaaaagaaaaaatgggttatatgattgaatgtccgaaccttatatttgtcaatggtagatcagtattagttttttgtccacaaggactagataaatcgattgttaaatatgataatatatatcctaatatgtatgttattgcggatgactttactactggttcaaaaaatcagctaaaaaatgcaggacaactaattaatttggatgaaggttttgactgttatgctacgcagtcatttaatgcacctgatggctctgcttatgccatttcatggctaggtttacctgagacatcataccccactgataaatacaatgttcaaggtgtcttgtccatggttaagaagctttcaataaaagacaacaaattgtatcaatatccagttgaaaaaatgaaagaattaagacaaaaggaacaagatctcttactagcagataataacattattacatctaactcttatgaacttgaggtcgattttcgtcagcaaaactctacacttctatctttaatgacaaatgaaaaaggggatagtgcacttaaagttgagatagataaagaaaataatactattacacttataagaaattatgaaaaacgtttggcacatgttaaaatagaaaaaatgaatgtatttattgatcaatcaatttttgaaatttttattaatgatggtgaaaaagtattatcaggtcgtgtatttccaaataagaatcagtattcgattagaagtcaaaatccgataaaaataaaattatgggagctaaaaaagtgattaaacttgaagatgttgcaaataaagctggggttagtgtaacaacagtttcgcgtgttataaatcgtaaaggatatttgagtgacgcaacaatatcaaaagtagaaaaagcaatgcaagacttgcattatattccaaacgcagccgcacgttctttgcaaggaaaatccttaaaattaattggattagtatttccaactataaaaaatattttttatgcagaattgattgaaaaaattgagcaagctcttttcaaacgaggttacaaagctatgttagcaacaacagaacatgatgaacaaaaagagcgagactatcttgccttactactttctaaccaagttgatggaattatttatgggagtcataatttaaaagcacatgattatatagcaattgaagcacctattgttgcttttgaccgtttattaacccctgaaacgactgttgttagctctgataattttgagggaggaatcctagctactaaagctttgattaactctggaagtaaaaaaatcgccatatttactgggaacgataataccaattctcctacatatttaaggcgtgatggatatttgcttgagctagaaagaaatcaattaaagcctcatataataaaaattccttctcaatggactcttcttcgcaaaaaagttgagatcaaaaaaatactagaaaacaatgattttgatggggtgttttgtacagacgatttaacagctatattagtaaaagatctggcctcaaatttaaaaaaatcacttaatgtggtaggttttgatggaactgaatttatagagaactactaccctaacctaacaacgataaagcaaccaataaatgatttagcggaactcttagttgatttaatcatacgaaagattgatggagataacattgatattacatatcaacttcctgttcagctacattatggtatagattaaaaatatattttactccttcaaaaagacactgctttaattctgcagtgccttttattttatatacttttctattttttatgtcaacatgatatatactatttcttttttaatatgaaatggcctttgaaaatatcgaagagtaactttccaatattgttacccttctcttctcgaataggtaattcacttgacgctactgcatatgtttgagtaattaaataagcatattgttcgtaatttaatgaagtaaaaattaaccctacttttgttctctctttttttgatataactcgcctgataacactctctaattcatagccatttacggaaagaataatcttttgctcttcctttagttccattttattattagactctattctaatgattttaacttgtcaattttaggctaatgaagagtgatggtatgtcgaggtgtttaaagaataatccaacttctgtttaatttgaaacattcagaactcaatcgtttacaattactcatgataaggtcacttgtcccccctataaatatttatttatctatctatttgtttttgtcattttaacgattggataataacaaaaatcaccaaaatagtaaatactatcatgagactcaatgactgagatacatttgataaggtcactgctggactgacggtgatttaaatctaagttattggcgtcaaacttatgagaaattccttaaaacacatagtatttttaaacccgatatgccaattatttgtgaagaatacaagcttgtatacaaaaaggaaatgaaacaataaaaaaatccaagtataaatacctggataaaaagtctaacttttggagtgcacatcagttcatttatttagactatctcacttaagagttgtttgtaaatttactttaatattttaaactgcaaaacctactataaattttacagtaggttttggataaagtagatgctgtatagttttgctttggttagttctttggttcattttatttttatcaacaaaacatcttttaaaactgggttaaaacgcactttatatgtgtatcaaaaatttccattatcttatttgaaattccttctccgtaattttttaagcaaaaaattttccaatttattactagagtttttttcttttttattaatctgtcattgattaattaattttacttttatttaatcaaccctaaaacatattttcatttttttccaagacaaaaaagtcaataagcatttatattataacatatctgtatatctctttcatctcttcctagacccctatattattttttaatgctttctatagatatcattctgataaagcagcttgacaaatgtcatataaaaaaatacaatcgtaaacaggaggaagaaaatggataattcaaaatatttggcgaagccgcgaatgaagaacaactattgaaaaatgattatcgtaagtatcgtggtgaaaacatggatatttattacaatgtagcaatttgtgaacatgcaggtgaatgtgttagaggaaatcctttagtatttgaagttggccgtaagccttggattatccccgataatggcgatgtcgcttccaatcaatcagtaatcaatagatgcccttctggagcactaaaatatttggcgaaggagaaaaactaatgaacattattgaaagagaaaatctatttgaactcctgtcagataaaggagaagtcattggtgaaatggcctatatgcctatgaataattcaataataatcactcatactggcgtttcacttgactatcgcggtcaaggcctagccgaaaaattagttcttgccggaatccaaaaagcaagacgcgaacaattaaaattaggagccacttgcccctatgccgtcaaatatttcagagaacacaaagaagaattaactgatgttttgaaataagctaatctttaaatataaaagaccttttagcggggtcttttttatgtattctaaattaagcaagagaaaaaattttcttcaaactttactttaacactgaatttacttgataattttaaagacttaataacatcaatcgtcatgttttctataaaattgtgttgtaaattcacaatttttttgctataataattcattattttatctatcaaacaaatcaattataaggagtatttatgaaggaaaaattagctggtaaagattacctctttatagggtcaatgttattcggacttttttttggtgcaggaaatttaatttttccaatacatatgggtcaagaagccggagccgctatttcacaagcaaattttggttttttaattacagcagtcggctttccctttttaggaattatagctctgggaatttctcaaagtaatggggtttttgagttagcttcccgagtcaatcgtatttatgcttatatttttacaattttactttatctcgttattggtccctttttcgctcttcctcgcctagcaaccacttcttttgaaattggaatttcaccttttttaagtcatgacctccaagctccactattggctctttttagtatccttttctttggaaccgcctggttcctgtctagaaagccaacaaaactcttagattatatcggaaaatttttaaatcccctctttttggttttgttaggtattattttggtcattgctttcactcatccattaggaaaagttagccaagcagaaattggtaaagcctatcaagcctctcctattttgacaggttttacacaaggttacaatactcttgatgccttggctgccttagcttttggaatcattatcatcacaactattcgccaacgtggcgtaaaaaatcctaaaattattgctaaagaaaccataaaagctggcctcatcagtgtaggactaatggctatcatttacacctgcctttcttacctaggtgctatgagtcttgggcaatttgctattagtgaaaatggtggaattgctctcgctcaaatttccaaccactacttaggaaatttcggcatgattatcttagcactcattgtcatcatcgcttgcttaaaaacagccgttggcttaatgtctgccttttctgaaacctttgtcgaattatttcctaaaaaagaatatcgtttttatctgctcatcgtaagtattcttccttgcatctttgcaaatataggtttaacaaaaattattgagctttcagttccagtcctcatgtttttataccccttagccattattcttattttattagctttattaagcccgctttttaaacattctagactcgtctatcagataacaactgcttttacacttttagcggctattatcgacggacttaatgctcttccagccaatctccacacaattactttcatatcagtaataattaattttgctaaagactttctaccctttttctccctaggaatgggttggattcttccggcggttttaggctttatcatcggttgtttatgtcaaatcacgattactgtatataaaaataaaaagtcttcaacactttcataaaagttgagagcctacaatatataaaaaggagcttcaaataattgataactccttttcttttacatcatctcagataattaaatttttgattttctcctaatataaatcattccaagacccccagaaatcaatagaagtattcccaacactttgaaaaaatcccttgggttatcccccgttttaggcaactcttcagaaggttctgattccattgaagaagacgaaaccgacattacttgtgaggatgaactaggagtaataattgattggtcgggtttttcaggagtttcttctttaacaggggtgattgtatttataaaattatacccctcctgttgactcatgtaattactaacaggcacctcttttacctcataatcgtaaagtttcccactttcatcatacttatccaaattggtaaacgaatatttccaattttctttagccgtcacatctcgtgaatcaactttctctccattccgatataactcaatactaataaaacttggtcttaaaccacgtgcattattatcatcaatccaagttttcactccagaaatagaaagtttcatacttgcatttccatttccaccattgttaggagtatgaacttccactacctgtttttcaatattttctcccgtcaattctcctctattttcatactgttgagaaagccccccatccgttgccttcgttgaataatcgataataatcgtatttgaaatatcacctaaattcacggtaaatccgttcacgccattttctaaaatactagcctgaggataatagctatcaacattataattctctccatcactactatatgtcacattagctactgaaatcgaaccagaaactaaattctgattcccaccaataatatcagtataaatagctttctggatattttctttagcataattgatccgaacctgccaatgaattaaggttgaatcattctcgtcaacccatccccatttataaagtacctcatctttatccggtcccgttgctggaccaatgttaatctctgttgttcctccatctttccaatcaactactaccgttgtgtcttcctctactttttgttcatcccaattaacccaaacggaaaatgaacctttaatatctgaagttgcattttcaacaagttttgaaaaagtaacagttaccacccccgtaaggtgattagtaaccgccgttccgataatatttccggcttcatcttttatttcaaaagtaatatcttttgataaagttaataaatcaggaacattgacactcattgtatccccctgagaaacgcttcccactggaatatcaaaatcccaatgagcctgaacatcatcataaataccaaaatctgttttcggatttcccaaatcatcagtcaattcatgtcccgttataaatttatttccatagtcagcagcaaatacatttgaagttgtaaataaattaattccaaccaagcacatcaataaactcagaaccattaataatttaaatgacttattcttcgccttcatgaatatctccttcttattttctcttactattgtgccccttcacttaagagccaatgtttgatagttttccaattatccttcgtaacaatcaacctaggaatattactatatggtgtttcattagtcactacacctggagatagtgtgaatattccttgaattccatcttgtagcatataatcttctaagtctttattttgtgctccataaggataagcaaaaacttttcctttttgatctaacttctcatcaaatgctttctgacttttttggtaatctttttgcactactttttttgaaatattagtagataaaatcggttcaaagttttcttgataatgtaagtcattcgtatgtagtcctgaagtaaccaaaggattttcattcattttctttatttctttccaagtcgacatttgtgacccatcaatggtttgtccaactttccccgtaataatgaattgtgtaaagggtaagtctaactttttcattattggataagcgttctctggcaaagatttatcaatatcatcaaaggtaaccactactgccttgccaatcacctcttttttattaagcttctctatcagttccgaactagtcaaaactttaatatgatttttctttaaaaatgtcatttgctgttcaaaatcttgcaagaatacattatattcatggagttgagaattatgcgaaattgaataagcgaaatttgttatcaccgtatcttttaacacacggtgataacaaagaacaataattccatcattgtctttaagcaaactttcataagcaaaatctggctgctccttttttccatcttgtacatatttttttgtttcacgtgtggacataaacaccaatatagcaataagagcaaacatcaatatcaaaaaaatattctttttactaaatttcatattataaatctaagcctccttcgttaaaatataaagactaggaatcgttaatattgaaaaaagacaaaacaaatcataaattatatcttcccaatttgttattggaaacccaatgattacaaaaacagagataattccatcactatatatccctagcaaagagattaataaaagaacgaaaacaattaatataaacagccaacatagtgaaacagccaagaattccaaaaaatgtcgttttttcatttttttacgtattactaattccattattacacccctctatcaggactttcccattttcctttatttgtccgattagttaaaacaacaatttcagcagaaagagcactaatcaaatttagaaaccaataagcaacaagataagttggaaatattaatttatcagtcaaagataagcggctctcccctttatcattattaagtcctaaaaagaatacaaaaaatgaaataagaacaaaaatcacgataatttgacccgatactttgaattcttgatttaacagcatttggagaaaatactgataagattctattaagaaaaaccaactccaaatatgactacaaatcatttcaatcaaaagaaacccatgtttaaattctcctcttttaaaaacccatgataaatttgaaattaatacttctactccaccaactgcccatcttctccgttgctttaaaagagattttaaattttcaggaacgagaatatagcttaaggctttaggtacatatttgacattccattgattacgatgaagtcgccaagtgacatcaatgtcttccgtcatcacttcggtattaaagccaccaatttctttcaaagcctctacacgatacataacaatcacacccgatacggtcattattgcacctagaaaaagactttgtgctctcttaatcgcatcaatcacacataaatactctaaggtttgtaatttccccaatagagttgttctgtttctaacaataggtcgtccagtcacagccccaatatctgaactagaagttaattcggccaataaataagatagagcatctttagaaagatatgaatccgcatcaataacaagcatatatttgctggtaacttgttgcaaagcaacatttaaagccgtggcttttcccttattttccttttgctcaagaatagttaatgcttcccaatcgtcgaaagatttttttacttcataaagtttctccaaagtgcggtcactacttttatcatcaacaataaagatttctagggaagggtaatttagattacgtagtgataataaaacttcctcaatcgtttcttcttcattgtatgcagaaataacaatactaattttttcaaattcttttgcttcatcaattgctttcttatctctttctttccatcgagataaaaaagcaccacttgcccaaacgaaagacaagataatcggataataaacagcataaacatctaccattgttgagattatcatagttttatttttcctttctttctttttttctcttaaaaggaaaatttaaaacttttcccacaaaaattcctagtaatgccgcactagtaaaggctactggaataataatcggtcctgctatcactcgttgacttaagtttggaatttcatgcttaaaaaattcatagacaaactgatccgttaaatcagatataagatagatagtcaaagtggcggtagatagagcctttagcaacctaacgctccattttggaatgggaattctccacaagattgctataactaatactgtcattatggctgtttgataaccaaaataatcattgtggtctagccactggaattcctgattccaacttgcaaaagtgtccgtcaaagtaaaaaccgtaagtgcacttaagaacgctgtaacaagttttcctattgaaattttctttatttcattttgataggtataaaggtaagctccgataaaataataactgacaggataacaaatttgccaataatccggaattacttttccaaaactatttaataaagagggtaagaatgttagcaaacttgcgataaagacaatatataaatgataattttttatttcttgtttataattccagataatatttaataaagggataaagagataaagtcctaaatacatttcaacataccaagagtaagaatcggttgaataatcaaaaattccatttatggctgtagagaagtcgcttccttttccaacaagagatagaactccccatactaataaagatatgcctatatatgaaatgatgacaggaactattcccagaacatattgagcacttaactcttttcgattcattaaaaatccagttgctactaaaaacaagggcacacaagtaattaaaatcgttcttatcccaatccaaaaaatccctaaagtggaatgaattgtcatatcataaaagcccgaatttaataaaaaatggaccgaaataacaaagaatattgcactacttttcattaaatctattgatggattacgtttcatttttttatatttatagcagaaaaattttgctcctataaatcctttctctaatttgggttataaaccgctcaattcaaaccttgtaattaattttcttttacattactaagtcatctcgaattcatgttattctcctaactttattttagtatggatttataattatcgaaaatcattaatttttgattgcaatccaccaatttatcacagtataacataacaaaaagaaatattgtaatatatagcttacgaaaatcactcattatcatcatatttttcatttttaattattattaaaagctataaagtaaaatatcaaacaataaaaaaaaacgaaaaaacccttataaaacagcactctcgatatttttaagtatattaggtaatgctctaaattgcaaatttagaaatcaaaaacaaatatgagtttgtaattagtaacatacaaaaagcacttactcaagtaagtactttttgcatcaatttaccatatttttattttaaaaacttcttttattcctgacaatattaatgtaggtagagcaggaataaaaatcacaagtagatatacaggtaatgttaactgagcagttcccatcacactattgaaaaacggaatgattgttactaaaaatgaagaaacccctgcaaataacactgctccaacaagtctaatattcccaaaaggattgcgtctaaacagtgttctggaacttctcgcatcaaacacatgccataattgtccataaactaaagtcagaaaagcaactgtttgtgcttcactagcgttcaatccattttgagcagccaggagaaatccaagataaaccatcgctcccataactgttcccctaatcaaaaccctagaccacgtgtggttagcaagaatagattcattagggttccgtggtttttctttcatcaaatctgtttcggcaacatcataacccaaagaaaaagatggaatcgcatcactcaccatattaacccaaagaaccattaaagcagtcaatgttggagtcattgctgcaacatttccaacactacttctaaataaaactaaacctaatacaagggccaaaacttcagcaacatttgttgtcagttcgtgtctcataaagttttttatattagcatagatagtacgaccgctataaactgatttttctatcgttgtaaatttatcatctaataaaatgagatctgcagaatctttagttacttctgtaccagtaattcccatcgccactccaatatcagcagctcttaaagctggagcatcatttactccatctccagtcatagcaacaacttgttgatgattttggagctgtttaacaatacgttgcttatgctctggtgtcactcttgcataaacattaacattttttacttctgcataaagctcctgatctgacatttcttcaaggtcaattccctttaaaactgctgcatttttttcctttacaatccccaaatcataggcaatcgcacgagctgttttttcatgatcccctgtaatcataaccacattaatatttgcatcatgaagttgtctgatagattctttcacttcttctcgtggaggatcaattattcctgcaactcccgttaatataaaatctttttctacgtcttccgtggctccgtataatgcctcttcttcatcaacttttttgtaggccacagccaaggttcttagtgcttcatccgcataatcatctaccactttaataaagttatcttttgactgatcagattggtcaactatatctccaatcaaaatccccgaagctttttccattaaaacatctggtgctcctttggtataaacgtaaaatccttcatcattttgaacaatgacgctcatcatttttctactgctactaaaaggaagagttcttataattttattgttttttaataacttattcttactatagctggctttactgccaagaacggtaagagcaacttctgtaggattaccaaaagtttttacttgcccctcaacttctttgacacttgaatcattacacaagacgatatttttcataaattgagcaaaatttacatttttttcaccttttgatgccaagtgaatttcaccaatggaacgatatcccagaccatccacattatacagttgaccattagcataaaattttgtaacggtcatctcattttgggtcaatgtacctgttttatcagaacagatgtaagaagtactccctaaagtctccacactacttagtgttttaatcagacctttattttttgacattttgactgcaccgattgtcaatactattgagagaacaactggtaaagcatctggaatagaggcaactgcgagagcgattgaggttgaaaatactgaagtaattgagttaattgaaaattctccagaactgattaatccaaatacaaaagttaataaaacaatcccagcggatattttcatcagtgttttagtaagtttttttacggtttcttgtaatggagatgattttattccctcatctttcatcaactgagaaattttcccaagttctgtgttttctcctgtggctacgactattccaattccctgtccatttgaaacgatagagccagaaaatcccatattcgtttgatcaccaatttcgacgttttcattaatgacctctatattttttattatagcatcagcttcacccgttaaatgagactcaattaattgaagttcatcaagttctaaccatcttatatcggcctccacaaagtcacctactgtaacttttacgatatcaccaacaactagctcatttgatgaaattttttctaaggctccatttcttagtacagatgcaaaacgattgttcatttcttttagtgaatttaaatttttacgagcactaatttcttgccaaaaacctaaaaatgcatttataataatcaaaatagctatagcaatcgcttcatataaagattctaaaccatgttttttatctccaactatttggaatgaataaaatgaactaaaaaatgatagagcgactgcccctaataaaacaatgattattggttctttaaaacttttaaaaaatacttttaaatagctttcttccttttcttctggaagtttattttcaccatatctttctcgattatctgtaacctgagtactcgaaagtcctctatctatcttaacatcataactatgtaataattcttctttggatttttgataaaatttcatatcatccctttctagtaaaaaacgacaaaaaagagcgcaaacctcaaaacaatctcctcacccttggagatgtgtcttgaagcttgcgcccaacctagtcgtttatttaattaattatattttaacattatccatatcataagtcaatccattttatattgttttgactacaacacaatgtataattatattaaaactcaaattacccctccattctcaaaacaaataagttccagtagcccctttattaagttaaatggtaaaatattattagaatgtatgaatttataatatgtactatataaatgaattttccattattttaaagctagaaagaatatcatgactaaaaattacttagaaatccctgaagaactttataataaattaagtgattatgcagaaaatggccaactatcaatccgtttagaaaatcaacagatattattagaaaatccgaaaattaatcataccaataaacaaaatttagctttacactattttatagtacctagtttagcatctggaataattgcattgcttatctttttaagtaccaatcatccacaaatcgcatttacggggagtcgtcacctctctgttgcaagtttgagcataattctatcaactctctttggtttttttggtttcatatggacatatcttcgcaaaagttgtgacttatccaaatctaaatttaaaatttttagagaaactttaacgttatcggtagcctatacaagtatttctttcgctgttcaaatcattttttggtacataattggcaaaacatttagcggagtaacttttgacccctttactgcagggtttcttgtcttagtatttgttggaatcatcttttattttcttatttcagcagctctttccatcactttacctaatcttattttgctcctctttaccactttcataggaggtattcttgtttcaatggcaacaaacaatcaaaaagattggtggcaacataatttcagcttcttaggaactggtgaagccacacagcactggcagttcaatatcaccttaatattttctgctcttattcttcttaccataactgattttctatttgctgagttttctaagagtagcctttacaattataaatttaaaataattcgtgttttttatattctcatagcatttttgattgctttcgtcggaatttttccagcccaatcatggacaatgcctatacataataattctgcatttggtctggttgcggttgttcttattatgattatctttcttaaatggttagttcccaccgtttctaaagaatttttagctttatcttggactgctttgatagcactaattttgtctgccgttgcctttatgggaattcactatctctcattaacggtctttgaaattattgcatttgctatagcttttacctggctcgttatgtttatcaattcactcaggggaattattcaagaaggaaacgaatggcaagtaaagctccttcaaaagtaattacctcaagcttcagataagaaaaaaacaaaaaggttgaattttcagaaaattgtgttataatattttcacaaatacattttggttggaggtttatcatggaatttaaaagtctactgctcctttcacttgctgcagtttctgcagttgatccatacttacccacaatttttatttcagccacaacacttgatgatattgaatctgaaagataacaataaccataaaacatttttttaattcattttcttttattatccaataacaattactatgcactcaacaaaaaaccattgttcctttctggcagtggtttttttcaataaaaaaagacgcaaatgcgtctataaaaattccaataaatgaatattttaattatgaattaaattgctgaacgcaaacgagcgccaccattttctaaaacacgaactgtacgaggtaaaaaagcgcgaatttcttcttcattatatccaacatgaagacgtttttcatccataataattggacggcgcatgatttgtggattttcagaaataattttaattgcttgtgaaagtgaaatatcttcaaaatcaacacccaaagtcttcacaaagcgatttctacttgaaattaatccttcaacaccatcgtcacatttttgtagaatttgactaatctctgttgttgataaaggatccgcgatgagatttctttcgttaaatgggatgtggtgatatgaaagccaagttttagcttttttacagctcgtacaagagggtgctgtatagattgtgatcatcgtctctccttcgtgtatatttatttatctaatagtattaaacatcaatgattgtacaattataccatatttatagacttaaaaaaagaccttttcaaaattttttcacaaaatttttcaataaaaaaaccactgaaatcagtagcttttttcactgctttagatattataatgctgttttttcaacattgatggataaacatttttagccttttgtaactctcgtttttttgcctcaatatcatcagtaatttcgacagaaaaattctcgaaaattgtacgagactctttgaaaatgtatcccccatttttcaagtcctgctcgtcatcaaatacagctaaatggtgagagagctttttgaaaaatgtattcaaaaagtaagttggaatgtataaattatacattgaagtgtagttcttcaaaaaattataatcgtaaaaaggaacttttacatcactttgaggattaattaattctttatcactcccagtaattgggcgattaagaatttcaatcactttttgattaagtgtgttacgaacttcaatttcacgaagtaatttttcaattgttaatcgtttcttataacgattttcatcataaattttgtaaatgtagatgcctgcaaccattagccacgcgccaataatcagaccaaaaatcattgcaataataagttctgtattcatgtcataattataacaaatttgaaagcgttaagaaagtttaaactctttttttatcaagttttaggaaaagtcataaaaaaagacaatattctttgaccttttttgaccaatgagttataatatagaaaaataaacaaatgaattcaattttatctaaaattaaattcatatcttatttataaaggagattcaatctatgggttatttagtacctaccgttattgaacaatcaagccgtggcgaacgtgcttatgatatttattcacgacttttaaaagaccgcattatcatgctgacaggacctgttgaagatggaatggcaaattctatcattgctcaacttcttttcttggacgcacaagataacactaaagatatttatctctacgtaaatacgcctggtggttctgtatctgctggtcttgccattgttgacacaatgaattttatcaaatcagacgttcaaactatagttatgggaatggctgcctctatgggaacaatcattgcttcaagcggaacaaaaggcaaacgattcatgttgccaaatgctgaatatcttattcaccaaccaatgggtggtacaggtcaaggcactcaacaaactgatatggctattgttgctgagcaacttttgaaaactcgtaaacgtttggaacaaatccttgctgataattctaatcgttcacttgaacaaattcacaaagatgccgaacgcgaccattggatggatgccaaagaaactttggaatatggtttcatcgatgaaattatggaaaataattccttaaaataatgatgtaaatcttaaaagccctgatttcagggcttttttatttttctgattttcaatctatttttttaatatgtttttataaaatcaattaaaacgtcggaaaattttgaagttgaaagttttccacctaaatcagctgtcaaatttccattcctgaatgaaaatgaaagagcaattttgattaattcagctacctcttgccagcctaaatactcaaacatcatcactccagataaaattagactagaaggatttgctatattttttccagcaatatctggagctgttccatgagttgcttcaaaaatagcatgaccacttttataattaatattagcacctggtgcaattccaattcctccaacctgtgcggcaagtgcatctgaaatataatcaccatttaaattaagagtggcaattacttcaaaattttcaggatttaaaataatctgttggaggaagttgtcagcaattacatcatctacataaatttttcctgattttaatgctgcttttttctcattttcagcttgtaaacttcctctttcatttttgattttatcgtattctagttttgtaaaagttggatattccttagcaacctcataggcccaatttctaaatcctccttcagtaaatttcataatatttcctttatgaacaaaggtcactcgttttttgttcattttcagagcgtactcaaaagccgcattaaccagtcgtttacttccttcaggactaacaggttttattcctagtgctgaagtttttggaaagcgaatagaatggacattcaattttttttctaaaaattttaataagctgtgagattcatttgtttcactagcaaattcaatacctgcataaatatcttctgtattttctcgaaaaattgtcatgtcaactttatctggcgccttaactggggattttattcctttaaaatattcaactggtcttacgcaagcatataaatccattttttgtcttaaagtaacattgattgaacgaaagctttcaccgaccggggtcattagtggtccctttatcgcaattaaattttcattaatatgagcgagagtttctttgggcagatattctccacaagactcaaatgcttctcctcctgccaataatttttgccattctattttctttttttgaccataaatttttagaaccgcagcatcaaaaactttttgcgcctgaggaaaaatatcttcgccaacaccatctcctctaatataaccaattgctggataatctggcacaactaattttccatttttcatctcaattttcataataattttcacctatttttttattttttgcgaatcacataaggcattataccgtcattagcatagtaatctaaatccgcctgagaatcaaagcgtaaaagaacctcaaagtttttttcggcagtacttacagtaattttttcatgaattttgggattttctggtagctctatagaaaaactttcgttaccacttaatcctaaagtttcggcattttcattatctagaaactgtaggggaagaacacccatcatgacgagattacttcgatgaatacgttcaaaactctcagcaattacagccttgactccaagtaattttgttcccttagccgcccagtctcgactggatcccattccataatccttaccagcaagaacaattaatccttgtccttgttctttatattttttagctacctcataaataggcaatgtttcattattgaatagagaatagcctccctcaagaggagcaacaagctgatttttgatacgaatattagcaaatgttccccttgtcattactttatcatttcctcgtcttgacccaaaactattaaaatccttataagcaagacctcgagaacttagataatccccagctggggattttaaaggaatattccctgctggactaatatggtcagttgtgatagaatcaccaaattttgctaaaacattcaaatttgaaagtgaagctatcggtttatttatcatagttaagttttcaaaatatggtggattagaaatataggtagattcagatttccagtcataaacttcacttttctttgttttgatattattccagactgtattttcatcaaaaaccttagcataactttcagcatataaatcacttgttacgtatttttgcactaaatcattcacttcatcagaagttggcagaatatctttcaaatataccttttcaccttctagattagtccccagagcaacagttgttaaatttttacgaacagaacccgctaaagcatacgaaactactaatggaggacttgctagatagttcgccttcactaatggatgaattcgaccttcaaaatttcgattgccactcaaaacactcgttgcaatcagttctttatttctaatctctgtttccatttcacttaaaagtggccctgagttacctatacaggttgtacagccatatcctactacataaaatcccaacgtttcaagataaggaaggagacccgctttctctaaataagaggtaacaacttttgaaccaggagctaatgaagttttaacccaactaggaaccgtaaggcctttttctactgcattttttgcaagtaagcccgccatcatcataacgtgtggattactcgtattggtacaacttgtaatagcggcaattgcaatttttccatcctcttctttcagaggtttttgttttttagcaaagtcttcaaagttatttgctaactcagacaattcaagcatatcttgggaacgagagggaccagataatcgtgttgctacttcacttaaatcaacattaattatcttattgtagtatggttcatgtttttcgtcataaaataacttatttgcctttgcataggtttctactcgcgcaaccacttcctcagaacgatttgtcgcccgaagatatttcaaagtttcattatcaatcggaaaatatccacaggtggcaccatactcaggagccatatttgaaattgtcgctctatctgctaaacttaaattttttagtccttctccaaaaaattcaacgaattttcctaccactttttcatctcgtaaaatttttgtgattgtcaaagctaaatctgttgcagtagcaaatgctcctaacttacctattaatctaactcctactacttctggaacagtcaatgaactaggctctcctagcatcactgcttctgcttcaattcctcctactccccaaccaagaacaccaagggcattaatcattgttgtatgactatctgtaccaaaaacactatctggatataaaacgccttttttttcggtaattacttcacttaaatattcaatattaacttgatgaataatacctgtcgctggagggactactctaaagttatcaaaagattgctctgcccattttaaaaattcgtaacgttcacgattacgttcaaattctttttttgaatttaacagaaaagcctcttcatttccttgaaaatctacttgaacagaatggtcaattaccaaatccactggaatttctgggttaattaattcaggattctttcctaattcaaccattgcgtctctcattgccgcaaggtcaacaatagctggaactcctgtgaaatcctgaagaacaacacggcttggtaagaaaactgtttcttggccaacttccccttttaaatagtctttaacggattgaatatgagcctgattgatattctcatcatttttctgtctaatcaaactttctaaaagaactcgtaaactatatggaaagtcttcaattctttcagtttctgagatatcataataatggtatattttattagaaatacttatttttttcatctttcccccaactttatataattttttgattctaagacactttcataggctggacgaataatcttattcatattaattagttcttctatacgatgtgctaaccaacctacaattctagcaatcgcaaataatggagtaaataattcttgtggaatttccaatattctatagacaaagccagagtagaaatcaacatttggacaaatcgttttatatatttttcgattttccgatattactttaggagctagccttgcaactttttcatacaacttgaattcctcttccaatcctttttcttttactaaaatctcgacataggatttaaaaacctcaaatcgtgggtcgcttacactataaatggcatgaccaataccataaattaatccttgcttatcaaaaacttctttatttaagattttatggagatacctttctatttcagcgtcatcttcataattagaaatattttcttttatattttccaacatttttgctgccttaatattagctccaccgtgtttaggcccttttaaactagagagggcagcagcaattgcagcataagtatctgttccacttgaggtgaccacatgagttgtaaaagtcgaattgttacctccaccatgttccatatgaagaatcaaggcaatatctaatactttagcctctacctctgtgtaatggcagtctgggcgaagcattcgtaaaatattctcagcggtcgtcatttttggatcaggataatggatataaagactttcttttttaaaataatgaacataagattggtaactgtaaatcgcaagaagtggaaaatcagcaataagtcccaaagattgttctaaaacattttcaatcgagatatctgaaactttctcatcgtaactagcaagagctagtatacaacggctcatcgaattcatcacatcactcgaagggttggttaaaatagtttcacggacaaaaaattctggtagagttctcctactggctaaaaggttttgaaattcctgaagttcatttgccgtgggaagttctccaaataacaatagataagtcatctcttcaaaaccaaaacgattttcttttcttaaatcattaataatatctttaatattataagctctatactctaaaataccgggaatttggtttccttctttatcaaaagaatgtatcgccgaaatattggttaatcctgctaaaactcctttcccattaatgtctcttaaaccttttttaacattgtactttttgtaaaattcactaggaatctgtgaatttttaatcattttttcttctttacttaataaattcataaacgcctccatctatttcattattatacactttttattccgaaaattatatattttctgaaaatttaaatatttttttgaagaaaaataaaaaacctacccaaaaggtaggtttaatttatattaattaatttcgattaacaagtcttgagtttgaattgcctcacctttaaccacatgaaggtcaacaatctcgccatcaaatggtgcttcaatagttgtttccattttcatggcttcagtaaccatcaaggcttgacctttttgaactttgtcaccagctttaactaaaatttcaagaacagaacctggcatagtagctccaatttggtttggatttcctgtttcggctttgcgtttagccacaacttgagtttgtacagattggtcattaattacgacttctcgacgttgaccatttaggttaaagaagagaacacgatttccagcgaggtcaggttctcctatttcatctaaacgaatgctgagtgttttacctttttcaatttgtacttcaattttttcattgagacgcattccatgtaagaaagtaggagtgtcaagtagcgtaactgctccaaattctctttgcattttttgataatcaaggaaaacttgtggatacatgatatatgagataacttcgtgatctcctggttcatagccaattttttgttctaggtctgctttaacagtttcaaaatcaactttttctgcgtgtaagcctggacggtcagtaattacggctttatctttcacgataattttttgtaattcttctgggaagccacccaccggttgtcccaaatctccacggaagaatgatactacagattctgggaaattaagttcgttaccacgcgcataaacatcttcttctgttaaatcattttgaatcataaagagagccatatctccaactacttttgaagaaggagttactttaataatatctccaaacatcatattaactttacgatacatttgtttgatttcatcaaaacgatgtccaagaccaactgctgctgcctgagattttagattagtgtattgaccaccaggcatttcatgcatgtaaacttctgtctgaggacttgtaatacccgcttcaaatggtgcgtaatatttacgcacatcttcccaataatggtcaatttgttcagcattttttacattaattgaggcatggcgaggaccgtgttcaagtgcatagtaaatagattgcattgatggttgagatgttccaccagcaagactcgctgttgctacatcaataatgtctacacctgcttgagttgcaccagaatatgtaataattccatttcctgaagtatcgtgtgtatgcaaatgaattggcaaatcaacggtatcttttaattctgaaatcaaacgataagcagcttgaggtttcaataaacctgccatatctttaactgccaagatatgagcacctgttgcttctaactcttttgctaagtctttatagtattgaatattatattttggtcggcttgggtctagaatatctcccgtataacaaattgttgcttctgcaatttttccattatcgcgaacggcttgaatggatttttccatttggggtaaccagttaagactatcaaagatacggaaaacatcgataccttcatgcgccgctactcggataaattcttcaatcacattatctggatagttttggtaaccaactgcatttgaaccacggaagagcatttggaacatggtatttggcatgagtttacgtagtttacgcagacgataccatggtgattcattcaagaaacgataagccacatcaaaggttgcacctccccacatctcagctgaaaaaagttctggtagtccttggtcaatcgcttgggcaattcctttcatatcttgtaaacgtaagcgagtagcaagcaaggattgatgagcatcacgtaaagttgtatctgttaataatacttcttttgtattttttacataatcaacaacagcatcagcaccttgttcatctaagatatttttggctgtctttttcttttcaagattaagaaggggttgacgtggttcttcaaaatgacgtttttcagtattttcaatccctgggaagccattgacagtaatcattgataaataatgcagcgtctttgttccacggtcacgtaagtgtgggaagttgaacagacttggtgtattatcaataaaggttgttgttgcttgaccacttgtgaagttttcattagcaataacattaatcaagaaaggaacatttgttttgacgccacgaatacggaattcatggagaacgcggtccatttttcttacgctgtcactaaattcattggcaaaagtacaaacttttactaaaagtgaatcaaaatatggagttacttcatatccagcatatgcatttccgacatctaaacgtacaccaaaaccacctggtgaacggtaggtatcaattttacctgtgtctggcaagaatccattttgtggatcttctgttgtgattcgacattgaattgctgaacccaaaagcggaatttcagactgtgctggaagtccaatttcgctatgtaagtctttaccttgagcaatcaaaatttgagcttggacaatatctacacctgtgataagttccgtaattgtatgttcaacttgaacacgtggatttacttcaatgaaataaaatttatcatctttaacaagaaactcaactgtaccagcattaacatagccaacatttttacaaagtttgactgctgcttcacatatttcgttacggaagtccagtgaaagtcccacggctggcgcaatttcaatgactttttgattacgtcgttgtactgaacagtcacgctcatggaggtgaataatatttccatgactatctccaagaatttggacttcaatatgttttggattttcaatatatttttcaacatagatttcgccagaaccaaaagctccaattgcttctgatttcgctctatcataaccatcatgcatttcagcatcattacgcgcaactcgcattccgcgaccaccaccgcctaaagcggccttaatcataactggataaccataagttttagcaaattctaaagcaccgtcgatatctactgctccatttgttccgggaattcctggcacttttgcttcgtcggcagctgctttagccttgattttatcaccgaaaatatccaaatgatgaagttcaggacccacaaaaactaaacctgctgcgcgaactttagtagcaaattcgagattttcagataagaggccataacctgggtgaatagcatctgctcctgattcaagggcaacacgaatgatatcatcaatatccaaataggcatcaattggtttttttccttgaccgattagataagattcatctgctttaaagcgatgaacagaatattcatcttctcttgcatagacggctacagtagaaagtccgagttcattacaggcacgaaagacacgaacggcgatttctccacgattggcgacgagtagttttttcattttgactccttaatgaggcttgcttggaaaggtaattggtcattacctttcactctttcatatattataaaaatcttttatacacttttaaacgactgacaattgtcaatcgttttcataagttgggacactgctactataatgatttgagagctcagaaatttctcttcgtttctcatcagctgaaatatttaatgcaaatgcaattcccaacgataagacaaggaaggacgaccctccttgtgataggaaggggaaggttactcctgtttctggaataattccgattgctccacccacattgacaaagacttgaactaacaataaaccagataccccaatcataatgagtgagttaaaggcacttttagcacgaattccaacaattaacattctgcttatcaagaaaaagagaatagctagaataataattccgccaatgattcctaattcttccacgacaattggaaagataaagtcagtttgagcttctggtaagaaaccatttttttgaatcgaatttcctaagccacgccctgtccaaccgccattaactatagcatagtatgaattagctagctggtgtccagaattggctaagtctgtaaaaggattaacaaaggcttcaaatcgtttattgatataagcgatgggtaagaaacttggaatgatatttccacctacaatgaaaagaaatcctaagaaaatggccatcaaagatagaattaattttgaatagccggaataccaacgccaagatataccgctggctccaatcattatcaaagcaactgcagcaataatcaaagtattacctaggtcaggcatgataaggtcaaccaataaaatggcaactacgggtaatcgccaaccaccaaaaagtttttgaaagagcgtctttcctttaaaaatctcatttatatcacgtttttcaatttcttcttgttttgttgaaaaaactgaggctaaataccagataataaaaactttggcaaattctgctggctgtaccgttccaattcctggaatatgaatccaacctctggctccatttacgggtgctgtcagagcaaaactggaaggcattattctacaaaatattaatgacagaatcaaaataaccattattgttcctatcatttttctattcttaagggctctaagtttcagacggtaaatcactgcaatcataatgagactcaataatacgaatgctgtttggttaattactaatttataaggatttaatcctttttgtaactgatcaggaaccgtggttgaaaaaaccatcacaataccaattcctgcaagaattaggtatggaatcaatatagagtagtttaaaaaattattcttatttaaattcattatctttttttcctcattcatattattatagcatgagttgaataatttataaagattttcaaagtgcttataagtttctaccatccaaagataaggtatttccgaatatattttttaaactgaattttttcttttataaatagtccataaaattatgattaaaatttttatctgtctccatcaactgctattataatgaaaaaataatgtcattttttgcataaaacacctctaatgaaatattgtttactttattatataatattatcacaattcttaataagtgtacatagtaaaaacttattataaataaaaaaacagcaagataattcttgctgtttaaccttcacgatgaagtgtaacaatgcgttctttgggacaaaacttcattgtttcaactttttccggatgggttgctttatttttgctactaatataatttttgttcccacaagaactacaaattagtgtgatttttactctcattccataatactccgtttccgcagatattttcggaaattaataaaggaccaaataatattaacaatgacaaaaagacttgtccctacaattgctgctcgataactgatataacctgcaattgctgatccgaccaatggaccagttaccattcctaaattagaacacatttgtgcgtaagcaaaaattctgctgacaccttctttgggagtaatttttgaaagtaacgaatttactgacggcatcaaagcgccagttccaaaaccaagaaggaagcgtaatatcccaagttggagtgggctttgcacaaaggccattggtaaataaataataaatgtaaaaacaagtccaatcaaaattaaacgatgtgaaccgtatttatctcctatacgtcctagaaaacttgatgataacattgccgacaatccaactgctgacacaattaaacctgaaatgaacatcaaattgttcgtgcttgtcgtcagggttttgatatacaaggtcacaaatggttcaatggattgcgaggtgatttgaataataaatgttgtcactaataatccaaaaagaatttgtttgttactgactttattaataatctctttactagataacatttcacctttagcaattggttcaaagttttcatgaacaaagaaaatggtcagtaaagttgctagggctaatagagcgccgacaatcaaaaagacatttgccatgccaaaccactcagctagtaacccaccaagtgaaggaccaatcagtgttccagaaaccattgctgttgctaatgttccaagggcatagcctgatttatcttttggagcttgtgaagcaatcattgctgttgagttagggatatagcctgagaaaaatcccattagcaaacgtaatccaagtaaccaccaaacattagggacaaaagctattcctcccattgttagggtcatgacgatactggcacgtaccatcatcactttacgcccatgctcatcagctagacgtccccaaatgggggcaactaaccctgaagctaaggctggcaaagaaaaagctaaccctgagtaaagttcaacatttccaccgcttactcccagtccttgaatatacaaggggagaaagggcatgacgagtgaaaatgatgaacctacaaaaaagcagccaatccatgttataaataaattccttttccaattaactgttttcgtgcgattcacctctatttctgttcttctatcctagctagttctcgctggatttgtttttttagtgcttcaatcgttccagaattatccagaatgacatcagcgactttttgtttttctgacaatggcatttgtgaagaaattcgtttttttgcttcttcttccgtaaacttatttcttgccatcagtctttctaattgtattttttcaggtaagctgaccaaccatatttcatcaaagccggtataattgtattcaattaataacggaatatccataaatattggcttatttactgatagattttttccttgactctttgaatcaaaatttttactgacaggcttgtcagtcattttttttaataagtcatcacgtctatcatataattctgtacgaataatttcatcttgtaagtttgataatttctcgcgctgttttggatcagaaaaaactaaagctcctaatttttcgcgatttaactgtccattgtcagcaataaaatctaaaccgtaagtttctactattgccttgtaaagttttccaccaggttcttgtaattgacggacaactttgtcagcatcaatcacttgataaccctcagaaatcaaaaaatcaaccaccgttgatttcccactcgcaattccgcctgtcaatccaattaccattttcattcatctattttagcataaaatttaactttcttaaactaaaaacaatagtttttaactattatgattaattttttcgtaaaaaaagtctgtcagtaaaactgacagaccgaatattcattaaattttaagaattagatgtttgaagtatgcattacttcttcatcatcgtttgaaagtacttcatggaagacacgttcagttaattcttgtttttgttctggtgtgaggtatttagtattgacacaataaccagagatacgaacgataacatcttcaccacgcatgattttatcgtaaacatctttaaggtccattacgttcaagttaacgtgttgacctgcaaattcagtaccattaatcaaagcacctggcgtgaagtatccatcaagaatttgaaccaagttatccacttgttcatcacgagttttaccaagtgcacgaggtgaaacttgagtagtcaatgaaataccatcatttgcatctttgaattccaatttagccaatgagcgaaggttttgcaaccaaccacccttagctttattagatgggttagcacctggcgagaagaattcaagtttagatttatttactgtaccatcttcattgaggaatactcctttatgtactggagaattaccagtttgtttagagtaagcaacgttagatgtaattgtcaaaagcgaaacagtagcttcagcatttttataaagtttgtgtgaagctaatttttcatggtacattttcatgacaagtttagcaatatcatcagcacgatcatcatcttcaccataacgagggaaatcaccttctacttcgtaatcgtagatatagccattttcatcacgcaatgttttaactttagcatatttaattgctgaaagtgaatcaactgtatttgcgaatccacagataccaaatcccatgttagcacgaactttagtaggcaagaaggccatttgaactgcttcatagttatacttatcagtcatgtaatgaatgatattcattgcatcaacataagtatcagtcaaccagtcgagagatttgtcaaagttttccataactgtatcatagtcaagaatttcgtcacgaacaggctcgatgtcgaatactttataatctttatgaacgtcatcataaccaccgttcaaaccagtcaacattgctttcaagacgtttacacgcgcaccaaagtattggaggttatgacgtccttcttcattttctggatcaagtggtgagacacaacaagagatacatgacatttcgccatatccatctttagccattgtttcaacaccttcatattgaatagaagaatgcttgtggctcatagacattgaataacgtttgaatgagtaaggcagtttagaatcccaaaggactgtcaagtttggttctggagcgttaccgatagtatcaagagtgttcaagaaacggtagtccattttagtaacacggtgacgtccgtcattacccataccagccatagatgttgtgatgaatgttgggtcaccagaataaagttcatcataagcagctgcacgagcaaatttcattgtacgaagcttcaatacgaaatcgtcaacaaattcttggatttcttgttcagtgaatgttccacgagcaaggtcgcgttctgcaaagatatcaagaacgattggaacacgtccaagtgaagttgcagcaccgttgataacccgacatacagccatataagcgatattaacccattggatagcttctttcacgttcatcgctggacgtgaaacatcaagaccatacaaagcaccaaagtttacaacttgttgcaaggcttggtactgcatgttaatttcttctttaagacgaatattttcatcgttaatttcagtgattgcgtcccattcacgtgctttttctttcataaggtaatcagcaccataaagcgcaagacgagcataaacaccaatgatacgtccacgagagtaggcatctggcaatcctgttacggtatgcgcatgacgtgctttacgaattgctgaggtgtaagcgcggaagattccatcatttacagaagtcattgtttgtgataaaacatcatgcaaacctgggtcaactgaaagaccgtgctctgtcaaaatcttttcagcaacacgaagtccaccttttggcatgaagtttaagcggaaaagttcgctattttgcatcccatagatgagttcaagttctttatcattagcatcgatatatccggcagggattttatcaatagaggttacgcggtcagtatcgaagggaaaaccaacttcttcatagtgagcttttgtatcttcaataattttctttactttaagtgtacgttctgttggcccagcgagaaagctttcatcaccatcatatggtttgtagttttcttgtacaaagcgagtaacgcttgctttatcacgccagttggttcctttaaaaccatcccaagcttgttcaaagatattttccgtaacttcggttttcattttgaaatctcctttgttctttctgtttcaaattacaatttcattatatcatacagtttgagaatagcaaacagaattcaagagaaattacagattctttactaatacagttccaattattttaatatctgttatacttttttaaaacgttttcacaaataattcacaaaatagttttaacaaacattgctaacttcataatctgcaatcactaattaattttttcacaaagagcaaaaaaaatggagatttttctccattttataacatatcttttttatgtaaccaccaagtgacccaaacacataataaaattcctagaactaaaataagccaaaccatccaattaaaattttgaccaggaattggaacattcattccgtaaaaaccaacaattactgctggaatccctagaacgaaagtagctgatgtcatgattttcatgacaatgttcaagttattagagacaatgtttgagaacaaatctcggagattttctagtaacttgagctgaatcttggtttctgtataagcttggtctgtttcgacaaaaatatcataaatcttttcagcaaaaccgtcttcatcatcttctctcaagtaatcaataaaatcctgaagtacttgcatattattgtgcaaggcatcttcaaaataaattaaacttgcttgaatggcaatcaaatcaacaatttggtcattctttgttgaatttttgattccctgttcaagtctgcgacgtcttgttcggaaatctctcaaataatcatgaaaagtgtgtgtcatttgatacatcacttgaaaaataacttgatgtttgtagcgtttataatcatattcacgctcgaaaattaagccattatcaatctcatgattaagtgctaaaataaccgattcatttttagtccaaaccaaagaatatggaaaagtcgccacttctccataattagaaagtgcaggatattgtaagagaatcagattattatcattatcatctgtttcaaaacgggcattttcataatcatccaaaattcctgataaatagtcaaaagggaagtcatagtattcagaaatattcccaatttcttcacgtgttggattgagaacataggtgaaattcttcatttcagaggttgaaattaattttttttcgttggatagttcataatttttaatcattttcctatctatcccttcttttcctgataaaagaggattggaatcctcttagtgtccctttaattgtagcagattttagactttttttccgagtattttattctctacgacttaagaaaacatttacattaactattggtctaaagaatactttgtgatataataaacttattgacttgaggagattttttttgaaattcaaacacgtacccctaaatttgtatctaaactttaaaaaatcagctgaacagtttcctgatagcccaattatctttgatgaggctgttggagctttccctgaattagctcttgaaacaacttaccaaaagactcatcaagcaattgttgataaggcaagtctcttatctgagttgggaatcaaaaaatcggataaagtcattatttttaaatcaagtgcttttgatacctatcttttagctgttgctgtttcttatctaggcgctgttccagcaatgatttcttatcatcttcctgccgaaacaatggatattttagctggacgtttaggtaatccttggctcatttatgaccaagttactgacagaactgtcaataaaatgaaaaatattgaagattctaaaaaactttctgtcagtaaatttgctttggaaaaacctactcaaattgctgacagtcagcaattggctagtgatgagattgcttatctcactcatacttctggaacaactggtgtaccaaaattaatcgctcactctgctaattcaatgggttggcgttgggtgcttcaaagaactgtaatggattggatgcctgataaggaagagattttagctttccatatttctcctgttcattctcgtttcaatataggggtttcatcagcaatgacctttgggtttggacttatgcccctcaatgatttagcaaaagataatcttgtcaatctttttgctaaacatcagccttatgcctttgaaactcatccaaacgattttgttcgtctagcgaatcttgcaaagcaagaacctgagatttttgcttcaattcattaccttcactcaacttttgatgcaattaataaagagacaatgcacacttttctttctgcctctaagcaaaaagatccagtctttctacaaatttatggacaatcagaatgtggcccaatgatttggaaaaagcaccgtttatcaactttagcagacacgaatgcccgtgaaatggggattggtatgcctggattatctaaagcacgtattgccgatgaagatggaaatgaatgtcctgcaggtacgcctggaagaatccactttctctcaaaaggaagagctttgacttactataaagaagaagaacgttttaataaagaagtctatggcgactggtgggatactggcgattggggcctcatgaatgaagacggaattctctttttacatgacagacaagttgatttaattgataaaattgaatctaatttggcaattgaagatcttctgttagaccaacacgacttcttagatgaagttgtgattattcgtgataaatctggtaaaccacaacctattttggctctagctgaaaatgcggaaatggattggtcagcttggtgggcttcaattgttgacttgccatttttaaatgaacctattcttatggcttacgatgaaattcctcgtacagcaacaatgaaagttcaacgattagctcttgaaagagaattagctaaataagtgttcctaattttactgacagagctgtcagccgcttatacatcaacaaatatattatcaaaactactgacaaagctgtcagtagtttttttgcttaaaaaaattaaataattgatgttaatcaatttatttgttagaatttaataaatgacacagtgtcataaattgaatgaatcggagacaaaatgcctaaatcaacctatttcagtctatctgacgaaaaacgtaatcgcgtatatgatgcctgtttaaatgaatttcagactcattcttttcacgaggccaaaattatgcacatcgtaaaagctcttgatattccgagagggagtttttatcagtattttgaagatttaaaagatgcttatttctatgtcctctcgcaagaaactcttgaaatccatgatttattttttaatttattaaaagataattccattgaagaggctctagataaatacaaatatctccttcttgaaaatttaattgattctcctcaataccaactttataaatatcgatttttagattggacttatgaacttgaaagagattggaaacctaaaagttcagcaaccgtcccagctagtgaaaatgataatccagtttcacaagtattaaaatcagttgttcataatctcgtttatagattattcagtgaaaattggactgagaaaacctttattgaaaattatgataaagaaatcaaattagtcaccgaaggtttacttaattatattactgacagaaaaaactgaaaggagattttatgtttttagcactaagagaaatacgttataataaagctcgttacaccttaatcggagctattatttttttaatcgcttatgtagtctttatactgtccggactatctgtaggacttgccagtcaatttaaacaagctgtccttgattggaaggccgaaaaagtcgttttatcaacaagttcaaataatattatttctgcttcacaaattacttctgatgatttaagtaatattcatgtagaaaatggttcagaattatcattgttttctacttctatgcataaatcaaagagcgagcgagacaatattgctattattgccctgcctgataagtctaaaatcatgccagaagttcttgaaaggaaaaaatttactgacaatcatttagaaatgattatctcgaaaaaactggcaaatcaaggatataaaatcggtcaagaagtttccgtgggaaataataatattaaaataaaaattgtcggaatttcaaaagcctcttcttattctgcctcgcctgttatctatacctcattttccgctttgaatcagataaagtttggtgaaaaaagtacttcaacttcttctgttaatgctgtcgttgtaaaatctgggaaagttaagattgattcttctatttcaaatcaatataaagtcatctctatttctgatttaattaacgatattccaggttattctgctcaaaatatgacactcagcgcaatgatttacttcttatttctgattgtactgttgattattggagtctttatgtatgttataactcttcaaaaagttccgatttttggcataatgaaagcccaaggaatttcaaatcgcataataatgaactctttacttggtcaaagctttatcattagtttagttggcgtcttcgttgcttttatagcaggttatggaactagctttatcttacccgatgcaatgccatttgaaattagtcttacaaactggttgctctatgctttaattctcatcatcgtatcaattattgggtcacttttttcaatcattactatccgtaaaattgacccaacgaaagcaattggaggttaaaaatgaaaacaattcttaaaatggaaaacgtaaaaaaatcttttggtagtggtcataatgagattcaggcactcaaaggaattgatttagcagtcaatcaaggggaatttgtttcaattattggtccctccggttcaggcaaaagtacatttctcacaattgcaggtggtttacaaagtccgacttctgggaacatttcaatcaatggcttagattttacaccattgtcagaaaaaaaacgttctaaacttagatttaaagaaataggtttcatcctccaaagttctaatttgattccttatttgactattgaagaacaatttctccttattgataaaatcaatcacgaaaaactaacttctaaaaaagggattgaacttcttaaatcacttgatattttagacttaaaagataaacatcctagtgatctttctggtggtgaaagacaaagggcagctattgctcgtgctctctttaatgaaccaaatttaattttggccgatgaaccaacagcaagtttagacactgagcatgcttatcaggttgttgacttattaagacaagaagctcatttgaagaataaagcaacaatcatggtcactcatgaccaaagaatgattaaaaatagtgacagtgtttataagattgaagatggactcttatcaaaaatctaaataaaataaaaactactagcttactagtagttttttcatagaatattttttataaaaaataatccttctctaaataaagagaaggattatttctaaatcattcgttggtaaaccttattttttaaggttgtagaatgctttaagacctttgtattgagccacttcagccaattggtcttcgatacgaagcaattggttgtatttagccatacggtctgtacgtgaaagtgaaccagttttgatttgaccagcgttagttgcaacagcgatatctgagattgttgaatcttcagtttcaccagaacggtgagaaacgattgctgtgaaaccagcttctttagccatttcaatagcttcgaaagtttctgtcaaagtaccgatttggttaactttaatcaagatagcgtttgaagcattttcacggataccacgttcaaggtatttagtgtttgtaacgaagaagtcgtcaccaacgagttgaacttttttaccaagacgttctgtgaggagtttccatccatcccagtcgttttcgtccataccatcttcaatagtgatgattgggtatttagaaacgagttcttcaaggtagtcaacttgttcagcagctgaaagttttttaccgccttcaccttcgaatttagtgtagtcgtaaacaccgttttcgtagaattctgatgatgcacagtcgaaaccaatcataacgccatcttcaccagctttgtaaccagctgcttcgattgctttaaggatagtttctacaccgtcttcagttccgtcgaatttaggagcgaatccaccttcgtcaccgacagctgtttcaagtccacgagctttaagaattttcttaagagcgtggaagatttcagcaccccaacgaagcgcttctttgaatgtaggtgcaccaactggtacgatcatgaattcttggaaagcgattggagcgtctgagtgagaaccaccattgatgatgttcatcattggagttggcaatactttagcgttgaatccgccaaggtagttgtaaagtggaacaccaagttcatcagcagcagcacgagcagcagcgatagaaacaccaaggatagcgttagctcccaatttacctttgttttcagtaccgtcaagagcgatcattgcacggtcaatagcttgttggtcagtaacttcataaccgatgatagcttcagcgatgatgttgtttacgttgtcaacagctttttgagtaccaagtccgttgtagcgagatttgtcgccatcacgaagttcaaccgcttcatgttcaccagtagaagcacctgaaggtaccataccgcgaccgaatgcaccgtcttcagtgtaaacttcaacttcaagtgttgggttaccgcgtgagtcaaggacttcgcgagcataaatatcagtaataattgacattttagtctccttattatttttaagtgcgtctgcactcttaatacatctttgattttactattttttgaaagatttttcaagtgaaaatcttcgcaaagctaaacttcaaaaggttttgcgcttacattttggttttttatctgaacattaataaaaaaggatagaaaaatctatccttattttttattctgtttcaattaaaccataacgaccatctgtacgacggtaaacgacatgggttccgttactatcagcatctgtaaagacgtagaaatcatgtcccaacatatccatctgaagcactgcttcttcggcatccattggttttaaagcaacatgtttagtacgtacaatatctacgtgatcctcagcaacttcatcggctttttctaatggtgcaaactcatcgccaaaagcttgtcctgttgggacagcattgcgtggtttacggttcatacgtgtcttatatttacgaatttgacgttcgagtttttcttctacaaaatcaattgaagaatacatatcttgtgaagtatcttctgcacgtaaagtaacatttttagctggaagagttacttcaactttagctcgtttttcgctgtaaactttaagattaacataggctgttacttcatgaccatcgttgaaatatttatcaagttttccgattttatcttcaacataagcgcggattgcatcagtcacttcgacgttttcgccacggatattaaatttgatcataagagtacctcttcaacagttctttttgtttcaatgaagcccttaaacttttggaattttcaggacttctgaatcttttcgaactgtcctttcctttatttctaatttaattataacatgaaacagctttcatctcaaacaatttgagcgattttaatttttttattagatgcaccaattgaaacatgattacctgctttgatttcaccagagagcaattgttcacttaaaaggtcttcgacttctttttgaagtgccttacgaagcggacgtgcaccatattttgggtcaaaacctacctcagcaattagtttcaccgctgacggtgtgagtttaacatgaatatcttgttctgccagacgtttaatcaaagatttactcataattttaacaatttgttcaatctcttgactttccaatgaatggaaaacaatattttcatcaattcgattaagaaactcaggacgataatgacgtttaagctcttctaatattcttgatttcatggctgaataatcagctgtgatatttttagcgccaaaaccaactgtcttatcgtcacgaagagcagtcgctcccaagtttgaagtcatgataataattgtatttctgaaatcaactttgcgacctttagtatcagtcacaaagccatcatctagaatttgcaacatgatgttgaaaacgtcaggatgagctttttcgacttcatctaaaagaacaacagaataaggtttattacgaacgcgttctgtcaattgaccaccctcatcataacctacataccctggaggagctccaatcaagcgtgaagttgaatgtttttccatgaattcactcatgtcaacacgaatcatattatcttcactaccaaacacactgtcagccagtgctttagcaagttcggttttaccgacccctgttggtccaaggaacatgaaagaacccattggacggcggctgtcagcaacaccagaacgtgcccgacgaatggctcttgaaacggcagaaatagcttcttcttgtccaacaacccgtttgtgtaattctttttcaagattgattaaacgatcactttcagacttagtcatttgtgtgattggaacacctgtcagtgttgaggcaacagcaacaacagcttgatcagtaacttcttgacgtttatcttcttttactgagaatttataaatcttgtcagcaattttttcaactgctttttcttttgtacgagacgctttgatatcaagtttaatgacagcttctgataattcttcttgagcttccgctaattctttttctaaatcaagacgttttgtttgttgatttttgacagaaattttcactgctgctgcagcttcatcaagtaaatcaatggctttgtcaggcaattttcggctagtcatatagcgaacgctgagcattacggcacttttaatggcttggtcagtaaatttcacttgatgatagtcttcaaatttttcacgtaagccttgcaagatagcaatcgcttcatctggacttggctcgtcaacatttattctcgccaaacggcgttctaaagcctcatctttttcaatatatttttgatattcatgataggttgttgctccgaccatttgaaaatcaccacgagcaagcgctggtttcaaaatatttgcggcatcattgacagaatccataccgccaccagcaccgatgattgtgtgtaattcatcaatgaaaataatgacatctggatcactgctaacttcttcaacaatagctgtcaaacgatcctcaaattcacctctaaattttgtcccagcaacaacagtcgccatattcaaagccataattcgactattcatcaaaccaattggaacttgaccattgacaattctttgagccaaaccttcaataattgctgatttcccaacaccgggctctccaactaagacagggttattttttgttctgcggctgagaatatgaatcaaacggtcaatttcggcttctcgtccaatcattgggtcaagtttacccaagcgagcttcttcggttaaatctgaggatacagagtctaacgttggcgtcgttgaattttctgcaactccctttgccatcttacgttttgacattggagtcacagcttttttactttctggaactttgagtccagttcttttctcaagctcttttcgcaaagatacaatattgattttttgtaatttcagaagttgaagaccaaatccatcttctacttgaagtagggcataaagcaggtgttctgttccaacggcttctgagttattatgaattgctaaaaaacttgccgcagtcatcacttcttctgcacgaggtgaaaaacgtaaagttgaacgtttgaccttaacatgacttgataaatcctctaaatcaatcagtaagtcagaagaatcaacattcattccagcaagaaggctgtaagcaattgagcctgaggtcgttgccattgcagccagtaaatgagcactttcaatggtgccatattgatattggtgagcatactcttccgctttttctaaaattcggtcaagcgttggtgtatattttatattttcaaatttcatcgtcacggtccaatctgtttattatacttttcatcattataccacgagtaaagggactaatggctccgtcagtaatgactaacaaaagtagatttccctcacgttctgtcagtactttctcatcaaagagaagttgaacgatatcatgggcagctttacttgagagattagctggaaccttctggtaaagagccgttaagaattcatgacgagcagaatattgatacttcacaattttgatgtatccaccaccaccacgttttgattccacatcaaagccttttgaggccgtaaatcgtgtttttatcacataattaatctgactcggcacgacatcaaattgattggctaagtccgctcgtttaatttcaatgacttgtgcttcttctaaaagctttctcagataagcttcgataatatctgatgtatttttttgacctgccatcgctccatcctttctttcatccattttctaaataatctttgactattactgactattatacctgaaaaatattatttttaccaaaaatagcaattttaacttactgacagacttaagcgttgaaaaataaaaaaaccgttactgacggcttctttacttattatattctaaaataattagtcaacttttacaattttaactgtcatttcgccaactggaagtgggacatttacgatgtctccaacttttttaccaatcaaaactcgagcaattggtgattcattagaaatttttcctgaaaatgggtcagcttcagcagtaccaacaatttgataagattcttcgtcagtttcgccaacttcaacaaaagttacgtttttaccaagtgctacttcgtctttagcaatttttgcgttatcaacaatttcagcataacgaatcattgtttcaactgttgaaatacgcccttcgataaaggcttgttcatctttagctgcttcgtactctgagttttctgaaaggtcaccatagctacgagcaactttgatacggtcaatgacttctggacgtttcacaagttttaaattttcaagttctaattttaatttatcaagcccttcttgggtcattgggaatgttttttccattatatttctttccttttttataaacttttttcttttttaatcaaatctaaattaatgatagcttagctacttatcttatcattcacatatttttgaacatttgcattttgttcagctaatgttttcgcaaaataaacttttcctgttgtcacatcagcaacaaagtagaagtagtcattttgagcaggatcaagtactgctttaatagatgacaaacttggactatcaacaggaccagggccgaatccagtatttgtgtacaaattatatggtgaatctaggttggtatcaatattagcatcctctgaaagacttgttttttcaccaagtttaccttcggcataaagaattgacagattagaacccaaagtcattccagcattcatacgattatagaaggttccagcaacgttgcgtcggtcatcatcattgttggcttctttttcaaccaaagctgctaaactcaaaacttcattgacagtcaaattcttttgagcaattgtatcatagtaaggagtgagctgggtattggctgcttgaatcatgttttcaatgactgattcaactgtcgatgattttgtgtaatcataagtcgctgggaacaagtaaccttctaactgatatttgattcctgaatcttttgttggcaagcttgcgaacagtttaggataagccttaaccattttagcgataaaggttgggtcttgaacggttttcatgaagtctgcttcagaaaatggcgtttttgcattcttttcattgcttccactattaactgtcacagctttagcaatttgtgttagcgtatagccttcaggaactaaaattttacctaaagttggagcaacaggtttttctgttccgccttcttcaagtttgctagcaatcgtagataagctcatgtttggtgcaagattataatagccgcttttaaactctgaataatttttaaattttgtataatactgaaaaaccattccatttttaataatggattgtctttgcaaaatttcaccaatttgcttactacttgaaccagcaggaatattgattgacttagctgttgcattcttagaatccagaggttgaatgccagattttacaaagttatagccataccaaccagttcctccaacaactaaaactaaaagaacaacaatcacagcaatgatttttcctgctgttacttttttctttttcttatttttgttcttattcttgtttttcttgctagaagaagtttttttagaaggactattggctcttcttgaaggttgatgtttaaccattttttctgattcttttttttccgaaaattgttcttgttcaattttttcatcttgaacttttgattcacttcttgaaaattgaggaggaatattttggttttgaatttcctcagaaaccactccatctaaattttgacgcaatgaatcgccttcttctggaaggttttcattttctacaaaaggttcttcttcgttttcatccgctgctggaaaatcaaagacgggaagtttgaaaggttcaagatcaactttccttggttcgatttttcgctcaggttcttctgagtcgctcctgctgggacgttcgaaatcttcagggtctgggaacttagtttctgcttgtttcgctgcattttcttcaagttggcgaagtattttttctttaaaacttcctcgagaaaattcagttgtttctttgtccaccaaattttttctccttatgattagctttcgctcaataataaaattttacttttcctaattgtaaccgttcttttaattttttacaaataaaaagagaatattcataaaagtgaggctgatgcctcactttttatgtgttttagtcttcatcagtatcgtctgaatcatcttcatcgtcttctacatcgatgtcaacttcttcatctacattatcaagttcaacttctgcaagttctgcgtcataagcagcgacgtcatctttatcttcgtcctctgcttgagtatcgtatgacatgtcttcttcagttgtttcttttgcgccttcttcatcttctggatcgatttcgtcttcgataccaaaagcattgacttttttacgttttttagctggtttttcctcttcttcgtcttcaatttcatcaagagcgataacttcttcgtcaatctcatcaatggcgtaccatgaacgaagtgcccagatattatttcctaatggaatgaaacttccgtctgtattgatttctgtataaaaacgagaaatactagctttaatttcatcatctgatttttccaaataatcttgaatcgctctgatgatttcagagaattgcatttctttgccattttgctccaataaagcatgagcaacttcaatcattgaaagttctgagattttttgtccttctaaggctgtaattttcaagtttttactctctcttttcctaatataaaatataggctcatttcctaaaaaacgaacgctatgtggattttctttttatagtgtatatcaaaattagcttgctgtcaatattttacgccaaaaaacctctgtttacttgcttttagcataactatactctcttgtttttatcaaaagaatactaataacatttattggctaccgacagtaaagaaattaatagtgcattagaactttataatcgtaatctccgattttttcgcgacctttaagttcatcaagttcgataaggaatgcacatccaacaacaattccacccattttttcaacaagttcaattgtagcggcaattgttccaccagttgcaagcaaatcatcaacaattaagacgcgttgtcctggtttgatgctgtctgaatgcattgtgagtgtgtctgttccgtattctttttcgtaagttgcttcaatgacttcacgaggtaatttaccaggcttacgaactggggcaaatcctacaccaagtgcaaaagcaactggacatccaatgatgaaaccacgcgcttctggacctacaaccatatctatttctttatctcttgcatactgaacaatttcggtagcagcatagttataggcatttccgtctgccatcaaagggctgatgtcgcgaaaaactacgccttctttaggatagttttcaattgttgcaatatagtcttttaattccatgtttttgttactgacaaaattgtcagtgctccttttttctaacataagttcgttatttttactgacagctttgttattaagagtatagctgattccgtcagtaactttttataaaaacgaaattatttttctaataaattttgataaatttctttgacgggtgctaaagcaaaaagttcttgcatttttacaattttttctagttcttgataaattgtactctcagaaatttcgcgtttatgggccgttttattaacggtcattaagccattgtcaatgctgacaaattcaagttcctcaaagatttttatcatcttgacaagcaagagatgagggattttcaaataatccgcaagtgattttaatttatagcgaatatcaaattctggaaattgataaattgctttataaagtcttgcaaattcttctcgtgttccacttcctgttaaataatagctatcagtgattttatttttaaaataaatcattttaaaatcatccgacgctgctttactgacagcttcttttaatattgacaaacctgctaaatctccaggtgtctcttcgatgacaagcacatcttccattataccatgttttaggtgattttgagtaaaaatattagcctcttttgggataggaatttgtttacttcttatatcaagaagttcgacaccaactgaatcagcatcttcaatcattaattgaagactcgtatttccattccaactattacttgaaagtgtcgcaactaattttgtttgtgcctgttcgaattccaattcttctgaaccatgttggaaataaacggcatcaatttgttgcttttcttcctgaatttttaatttaagatgagcattgtctttccccatacttcggctttgaatcactttataatcttcgattaaaaatcgaggcttaggattatccatgccaaagggagccaattttgctaaattagtgattgttgagagcgaaatatcgtctaagtggcaacggtcagcaatttctaaggggctttttttagacatatctaaatgattgtccaagatataatcaatcatcgcctttttaaccgcttctacattttccagacttaaagtcatccctgcggcttgtttatgaccaccaaaagcaataaaaagttcacgatgggcattcaatgccttgaaaatatcaaaattttcgattgaccgagcagacccacgcaaaatcccatcttcttgggccagcatgattactggcttatgtatggcttctaacaagcgacccgcaacaattcctaagacacctttatgccagtccttatgatataaaatctgaacaggttcatctgtcagcatactcagagcttcattgtgaattttttccacaatttcttttcgctctgaatttttttggtcaatcattttagcaatttcatgcgcttcatcttcatcccaacctgtcagcaattcaatggctgggtttgggtcatcgagacgtcccaaagcttttaaacggggagcaatttgaaaaccaaccgtttcctcagtgattttatcaaaatcaaccccagcatacttcattaattcttgtaggccggcacgctctgtttgggccaaaacttttagaccatgagccactaaaattcggttttcatcagtcaaactgaccatgtcagcaattgtaccaattgcaactaaatcaagcatttcactgggtgcatattctaaaagagcacaggcaactttgaaggcaacaccaactcctgccaaatatttgaaaggatattgactgtcaggatgttcggggtggacaatggcataagcagggggaagttggtcaggaattgagtgatgatcggtaacaattacatccactccattttcctgtgcccaggtaattgcctccaagccagcaaccccattatcaacagtaataataagattgatattttcattcttaatatagtactgataaacgtcaagatttggcccgtaaccgtcagtaaaacgattgggtaaataaacttgagcctcagctcctaattcatccagagctgacttcatgactgatgctgcagtcattccgtcagcatcatagtcaccataaattaagatattttcaccttgctcaattgctgataaaatacgccccgttgctttttccatatcatgaagtagaaaagggtcatgtaaattttctaaacttggctttaaaaattgctcaatttcagcttctgcatgaattcctctttgataaagcacgcgacttgtcaattcatctaatttatgttttttcgctatctttagaaaatcttcggaaatggctgtatcagccactttccaatcatattttgcttttatcattttaattctctttatcttttctatgctcaattcaattattttagcataaattactcgaaaaaaatggttaagtttagggattatttttcttttatttaataaaatcctaaacttttctataatttactgacaaaaatagcattaagtttctgtcagtaaaaaattctatttgaaattaaaaaatttggcagagataaaatcaaaaagcgaaggaaaaatagctcgcaatttggccgctgtggataaagtccaaggtaaattgatttctcttttcctttttcccaagttattcacaactttgtcagcaactttagatgctgaaattgcatttttccccactttttccagataatcttcattatccctgtgaaatttggtttttacaggtccagtattcacagttgtcacaattaattgtggattttccatacgcaaagcatctgaaaatgtaatcaaagccgccttagaggcagcataaattgatgatttacctgttggtaactttccagcaattgaagcaatattaatcaattgaactttcggttctaataatctggtcaactggattggcattaacgtattaatgacaaactgttctgtaatttccccatcagtaagttcagtgaattctttaaaaataccaaaaccagcattattaatcaaaatatccacaacaaaagattgttcattagtcaaaagttcatcattggtcagtaatgtaacattttcaagctgaccatagcgttcaatcagagccttacggctacgtgaaaccaaaattaaatggtcattttctttagataaagatttgacaatttctttagcaatatcaccagttgcacctgtaattacaatatttctaaccaattttttcctcgtaaaaatccttaaccacaaaagtgttggaatgaacagtttgtgcctcacgcaccaattgtccaaccaaaggtccaacatagcgtgcactaatatgagtcaataacaatcgattaactccggcttctttggcgacgtctgctgcttgcttcgtcgttgaatgaccatgtgcttttgccattttactttcatttgcttcataagttgcctcatgaaccaataagtctgctccataagctaagcgtactgcaacattcgattttcttgtatcgcctaaaatcgtgactattttaccagctttatccgctccgatataatctttaggatcgaaagtttttccttcgtactgaacaatctcacctttttttattttaccaaaaaggggtccgaaaggaagcccagcttcttttaaagcattggcatcgagttcacctattcgatttttttctacgacgcgataacccaagcagaaaatagtatggtcaagcaaatctgtatggacttcaaaactatcatcttcaaagatttttccagccgaatcaatttcatgaaaattgatacgataagctaagcgtgaacccgagattctaagagcggtcaaaacaaaatctttaattcccacagggccataaagctccaaatcagtttgttcatctgaactttgaaaacttctactagacaaaaaaccaggcaagccaaaaatatgatccccatgtaaatgtgtaataaaaatcttagtaatttttcgtggcttaattgtcgtatttaaaatttgatgttgcgttgcttcaccacagtcaaaaagccaaatttcattacgctcatcaagcattttcaaggcaattgcctgagtgtttcttgatttagaaggctgaccagccccagtccctaaaaattggatttccattgaacctccatcagtttcaactcaccttaaggcaaattaaaactttattttctcaaaaatgagaattttttccaaaacaagaaaagattgtgaaacttccccacaatcttttcttcaataaattagtgacccgtgctgggctcgaaccagcgaccctttgattaaaagtcaaatgctctaccaactgagctaacgagtcatgcttaaagcatcattttcacgacgaaatatattataacacagactttctgaaatttctagtctcagctgtaatttttttatttttttaaaatttattatttatttatctctgataatggccacacacaggtccaattaatcaattttttttcatcattaaagggcagtaaaaaatgtgaccaatccaaaaattatacctcgaaagtttgccgttgccaaagctaaatctctaggctttttgccaattccataagtgacccaaagtgtacaattaattgcagcaacaaggggctgaataggatttcctttcattccactaagattgttagcaatttgcggaagatatgacacatacatcattaccgacatcccagtcgctacccaacttaaatacttaataaatttctcttgattcataaaagccctcctgtaaaatgataatatcaaaaaaactcgcggtttctttctaactattttttatatttaaaacctagtctttttaccttcgagtcaatatcttattataacatatttaggattctataaaacgcagtcattggcacatgtttagcacaaaaacaataaaaaccgctcaaccgagcggtttatttacttaattaaatgcgtccggagggaatcgaacccccatctcaagaaccggaatcttacgtgatatccattacactacggacgcgctacaatcactttattctacctaatttcaaaaaaaattgcaagaagaagcttgctataataaaaaaagctatccatcgatagctttccatttttactttatttacctgctttaatggctgataaaatctgagtccttaaactttctgctccttcagctccgcttggaaggaaaatggttgaatttccacctgcagcaaattgattcaaggtatctaaatattggttagttaacaaaatcgccataatttgttcttcatcaagcgccacaccaagctttttgatttcggtaatttgttgagccaaaccgtcaacaatagccttacgttgttcagcaatccctaccccatgcagacggtctttttcagcttctgcttcagcggcagttacaacttgaattttattagcatttgccaacatttggctggcatcttgtttacgttgtgccgcattgatttcattcatagattgcttaacttcagcatcaggttctactttagtaatcaatgtttttacgataatataaccgtaagtttgcatttcttcagcaactgttttttgaacttcaagagcgatttcatcttttttctcaaaaacatcatccaaagtcaattttggtactgctgaacgaagggcatcttcaatataagccttaatttgttcacctggattcattaacttatagtatgcatctttgatggattgttcgtttactcgatattgcgttgcaatattcatcgtaacaaaaacattatccgcagttttagtttcaactgtcatctctgtttgtaataagcgcaattgaactcgagcagcaatccgatcaattccccaaggaagtttcaaatgaaaaccagggtttgcagtaaattgatacttcccaaaacgttcaacaattgcaacagtttgttgtttaacaacaaatacaattgtactcaaactaaagattaaaatgagcaggataattgctaaaacaacgagtggaataaaaatcataaaagttcctccttatatttgaccaaaagttactgacaaacttttctgtcagtaattatgaaaaattcagtcttattaattactgacagcatcgccagtaaccgttttcacatagtctatcacttatcaaagagaaatgcaatttttttgatagtttattaactaacgattaaaaaccttttgtaatatagataaagtgtttacgtccgtcacgcccaaagcataaaggacttaagaagccaatttcttcggcttgttctaataaatcttcaatattatagccggataagcgaatatattccccattttctgcttgttctgttaatgctgttaggtctttcactttctcaaattcactttgaaattgagcaggtttcattgtcaattttccgtcttcttccactaatagataatgcgggaaaatctgtgcaatttcaaacatcaattcggctgtcacttttaccggaaattcactgaaaataattgcttcttctgcgtcatttttatatgaaaaaccaaatgattttccagaaagattgagtcgaataaatctgaaattttcataaccattttttccttcaagttgaaaatctggattttcttcaaaaatatcaaaagctttagaaagttcaaagaaataatctgttgcatctttcggtgagcgtttttgataaagttcagcaaaataagcatttaaaactgatgctggcggagtcaccaaaagtcttttatcttttacatcggtcaaggcagctaatctattttctaaaaagatatggtcttgagccatgaagccaccatatttcattcccaaatcaatccattttttatcagtcattttttctctccatttttaataaaatttacttgtaaagtccttttttcaatctttttcattataacatttttaagaaaatgcgtcagttcaaaaactgagtgactttatcaaaaattggttcaggataattttttgaaaaaacatcttcaaattcgacagacattctatttttaaaccaagtcaattgtcgcttggcatagcgtcttgaatttcttttgaccaactcaacagcttcttccaaactaatgtcccctgaaaaataagggaaaaattctttataaccaatcccttttgccgcttgaacttctggtgcttgctcatacaaagttctagcttcatctaataagccctcacgcaccatttgatcaacccgttgattaattcgatcataaagcacttttctgtcagcatttaatccaataagcaaaaaatcataatcagaacccaaattttcatcttgagagccgaaagcttgcagctccaaaaaacgaatcgcccgtctacgatttaactcagaaatctctggatttattttaatcacttttgcaaacaattcctcatcagataaaagagataattcttcgcgaagtttcatcatctcctcatgattttcctgtccgccaagatgatagccttcgataagagattgaatgtataagccagttcctccaacaatgattggcacttttccttggtcaagaatttctttaattaattgattagcttcaatgacaaaatcatgaaccgaaaaattttctgtccatttacgtacatcaatcaaatgatgaggaacttgagcttgttcagccatagtcaccttagcagttccaatatctaatccttgataaacttgctgagaatcaccagaaataatttcaccattaaatttgattgctaaatcaatgccaagtgctgttttccccacagctgtaggcccgacaaccactaaaactttattatttttcatttattttttatgactcactctcaccattttcattctctattatttcagaaatagcctgtaaattcaagcactgacaagaaaaattactgacagctcaatttctgtcagtaatttttattctattattcttaaagtttttatgcagcaaaaactttttgataaattctttttccacgattcattaaagatttccgataatcttcacgtcccacaatcagagtcattttactaaagatatagcatgaaagtagtgtgaccgcaaagttaggaagtgacaagaatgttaataaggaaacacttaaaacgaccacatcgaccataaacaaaaccttgtcaattttaaagttccattgctcctccaaaattcggctcaataagattgatcctccaaatgttccttcagaaataataactaatcctgccccgaatcctgaaagaagtccatcgaaaattccagcaaaaataacatgtgagaattggaaaccagtaactcctaatgcttcataaatcattaaccaaccactcatggcaagcgctccaggaatgctcagtagtaaaattctccgcggaagcgaacgtcctccgaaaatgaaaagtggtacatttaccaaaaagaaagtcaaggctgggttgatgccaaaaacaaaatccataagtacagaaaaaccagcgacaccattacttgctagacgattagggatgacgaataactgaactgagagtacataaagtccgacacctaaaataagtatgagtaagtccctcataaactttttgtcaatttttacacctataattgtcatatttcttaccttctttctttatcatttatttattacaactgctactaatatatcacatgcacctaatcttaaccttaaccagttaattattaaagagtctttctttttaaaatgtgcttcgttagcgttttcacattttttgatttataatgaagatagagcaatttttaaataaaaatataaaggagtccaccaaatgaaaaataaatttatccaaggctatctcattggaaaatctgtcgaaattcttgttgcaggtacagccctgttaattgccaagaaaaaaggttatcttccttctgctgacaaggccgaatttatcgctcaaaaaagaaaagaagccgctagaaaacgacttgctcgttaaaaattttactgacagaaataaaaacttactgacagaaattttgtcagtaagtttttttatattctttaatgagttgctgaagcttcagcttcatccacctgttccaatcgttcatgaatttccaaattacgtacatctgaaagaaccaagggaactgtttcaacagttacttccgagaattgaagtccaaaccaacgaattggtgaagccgtaattctcttgatttgtgctttagtttgaagaacaaaacgctcgaaacctggcatttgacgtgcattcattagcttttcttcaacaacgacaaagcggaaatctccaactttacgtcctggagtgatactataatgttgatgctgacgtggcaaacgtcctgattccatcaaatccgtcacaattgttcttaaataacgcggaacttcttgacgcatacggaatccaagatagagattcacacgaacaataaagtcagtacccatcatgtctactttatactcagaagtataaggctcgtcagtaacttttacatttacaaaccaataacattctgcacgttttggccgtttatccaagattgaatataagattgaacgatcaatccattcatggtccattttgcttgttaaataaaccacatttgtttgatataaatcataagattcatcatgacgcaaagcattaagttgatttttatactcattaatattcaatgatttgatatatttcatgacaatcttgtgtgacttgttccagatgaacatcacgaagataattgccaaggcaatcagaaccacaatatatgctccgttgataaattggacaagagaagcagcaaagaatgagccttcaatacaaaagagaccgatagaaataaaagcaatggcaatttttggcgttcctttttgaattaagaaataagtcaaaagtgttgttgtcatcaacatagtgatggtaatggccaagctataagcggcttccatatgttctgaagttttaaaatacaaaacaaagaatgaagtcgttacccaaagagcaaaattaactgctgggatataaagttgtcccaaagtttgccctggataataaattttgaacaatggcaaaagtttcaaacgaatcgcttcagacaccaaagtaaatgaacccgaaatcagtgcttgagaggcgataatcgccgccaatgttgataagataacgacataaataaccatattatctggtaaaacagcaaagaaaggattaagtttttcaatgtgttcaccacggtgagctaaaagccaagctccttgtccacagtaagataagataatacaaatcttaacaaatggccagctgacataaatatttccacgcccaacgtgtcctaagtcagaataaagtgcctctgcccctgtcgttaccaagaaaatagaacccaagataaagaaaccagctttattttctggactaaataataagtgaattgcataataaggattaattgcttttaaaattgataaatcgagaaaagaattaatcagtccacttacacccaaaaagccaaaccagataaacataattggtccaaacaaacgaccaaccaaacttgctccaaacctctgaatcaaaaagagaaaggcaaggattatcaaggtggttaccatgaccgttgtttgatttgagtaaacatgtgttactccccttagaccttcaatggccgaggtgaccgttaccgctggagtcaatgctccgtccgctaataatgtcgctccaccaatcattgctggaataatcagccattttctcatccgtctcacaagggtgaagagtgaaaagatccccccctcatgatggttatctgctttcaaagcaatcagaacatatttaacagttgtaattaatgttaatgtccaaattacaagagaaacagcccccaaaataaagctttcagaaagatttgctaatcctccctgtcctcgaacaatggcctgcatggcataaagtggacttgttccgatatcaccgtaaacaatccctaatgcaatcaggaaccctgcagatgtcgctttattaaacgacctattatgtaagtgtacttgacccacttttgtaactcctcaactttcttcaacgaaaatagtcaaataaaataaaacgaagcgtagctcgttttttaatagctttattatagcagattatcccctgtttattcaaaaaaaactgtgggaaattatatttatttatttctcacagttttatatataatacattaatcatcgcaaaagcgatgatagcaacagtaagctatcttttgattgcttttatttcattatgattctcctgaattttcttctaaaattcgttcgtgaatttccaaatttttaacatccgagagaaccaaaggaacagtttcaagcgtcacttctgaaaagtgaagaccaaaccaacgtgctggcgaagctgtaatttttttaatttgctcttttgtttgaagaacaaatcgttcaaagccaggcatttgtcttgcattaattagtttttcttctaaaataataaaacggaaatctccaacttttcgtcctggtgtaatactataagtttgattttgttgtggtaatcgtcctgactccatcaagttggtcacaatcgtccgtaaataccgagggatttcttgacgcatatgaaaaccgagatacagattaacacagacaataaaatcagttcctagcatatccacttcgtattcagaagtataaggctcatctgtaacattaaccttcacaaaccagtaaactttagcttttttaggacgcttatccaaaatagaatacaagattgaacggtcaatccattctttatccattttagccgttaaataaacgacattcgtatgataaaggtcgtaagtttcatctttgcggagtttgtccatttgttctttataatcattaagatttgaagaattaagatatttataaaaaagctgatcagatttatgccagattgccataacaaatagaatcatggcagcaataatcacaacgacataaccgccatgcataaattttacagcggaagctgcaaaaaacaaaccttcaataaagataaaaacggtgaaaaataggccaaccaatacttttttaactttttgatagtgacttaaatagacagttaacaatgttgttgtcataagcatggttactgtgattgctaaaccataagccgcttccatgtgagcagagctttggaaatagacaacaataaaactcgctgccaaccagagtcccaaatttacggctggaatatataattgtccgaaagtttctcctggataaaaaattcttaatcgaggaaggagtttaagacgaatagcttctgacacaagagtaaatgaaccagaaatcaatgcctgtgaggcaataattgccgccaaagttgctaaaattactgaaaaaatgattaaattttgaggaaggacagcaaaaaatggattgatatctcctaatgattttccgcgattttgtaaaagccatgccccttgcccacaataggataggatgatacaaactttaacaaaaggccaactgacatgaatatttccccgaccaacgtgtcctaaatcggaataaagagcttctgcgcccgtcgttgccagaaagactgaacctaaaacaaaaattccagctttattttctgggcttaaaagtaaatgaattgcccagtaaggattaattgcttgaaggacagaaaaatcaccaaagagattaatcaaacccgtaattccaagaaaactaaaccaaataaacatgaccggtccaaacactttaccaacgattgaagttccaaatcgttgaattaaaaataagaccgctaaaatcgctaaagtaataataacaatcggtaattgctgctgaccaaaagcttcatgaaaagccggaattgacctcaagccttctattgctgacgtaaccgttacggcaggtgttaaagctccgtcagaaagcaaagcagcaccaccaatcattgccggaataattaaccattttgcatacttgcgaatgagagtaaataaggaaaaaattccgccttcatgattattatccgcttttaaagcaatccacacatatttgactgtcgtaattaatgtcagcgtccagataatgagcgaaagtgccccaataattgacgtttctgagattcgttcaagccccccttgaccttggacaatggattccattgtgtaaagagggctcgttccgatgtcgccataaacaattcccattgcgatgatgaaaccggcacctgttgctttattaaatgagcgattagattcataacccattctaatttcctcaactttctctagttccataaaatttatcaaagtaaataattcacattcgattacctaaatcatataacaatttcttgattttttgttaaaaaatggtctaaagaatactgcaaaatttataagaaaaaaagctagaaaattctagcttttaattaattatttttcaacttagtcttctgtataccagtcgtagtggaagattccagctttgtctgtacgttcataagtgtgagcaccgaagtaatcacgttgggcttgaatcaagttagctggaagattttcagaacgatagctatcgtagtagctgattgctgaggtgaatgttggaattggaattcctgcttgaacagcaagtgaaactacatcacgaacagcttcttgataacgttttgtgatgtctacaaagtagtcatcaagcaagaggttttcaagttcgctatctttgtcgaaagcatcagtaatattttggaggaattctgcacggatgatacatccagcacgccaaatttgtgcaattgtaccgtaaggcaagtcccaatcaaattcttcagaagctttacgaagttgggcaaatccttgagcataactcataatttttgagaaatatagcgctttgcggattttttcaatgacttcttttttatcgcctgagaaattaaccgctgggccagataaaactttgcttgctttaacacgttcatctttataagttgaaatgtaacgagcaaatactgattctgtaatcaatggaagtggtacaccaaggtcaagggcagactctgaagtccatttaccagttcctttgtttcctgctttatcaagaattttatcaacgatgtagccttcgccttcatcatctttacgtttcaatacttctttagtgatttcaatgaggtagctatcaagttcgccttcattccattcttcaaaaatggcttgaatttctgcattgctaagaccaagaacacgtttcaacaaatcataagattcagcaatcaattgcatatcgccgtactcaattccgttgtgaaccattttaacgtaatgtccagcaccgtttgctcccatgtaagccacacatggtttaccatcttgaggagctttagctgcgatttgttcaaaaattggtgcaaccaaatcgtaggcttctttttgaccgccagtcatcattgatggacctaaaagcgcacctttttcaccaccagaaactcctgtaccgatgaagttaatacctgagtctgcaagttcagcattacgacgcattgtgtctgggaaatgagtattcccaccatcaatcaagatatcacctttatccaagagcggtaaaagtgatttaattgtcgcatctgtcgctgctcctgcttgaaccatgagcatgatacgacgtggtttttcaagacttccaacaaattcttcaagtgttttagtgagaacaagattcttatcttgatgttctttataaacttcttcagtttttgaagtcgtacggttgtaaattgcaacggtataaccacgtgactctacgttgagtgcaaggtttttccccattacagccattccgacaacaccaaagtttgcttgtgccatttgaaatcctccagagtatttctttatattctatactatatagtataacgcaatttatttccaattaccatagttaagtatgtaaatattttacatgacaaaaaaatctgccttaaagacagattttaaattttattctttttcgtcaggaaaatttgttaattctttggctttgtcagcaatttttttcgcttcttcagcaagagactcagtatcaatatcttctttcacttcatctttggcatcactgaacttagccacaacttctgcggcttcttctgagatgtctgattcattttcatcaaagagttcttctccactgtctttcattgaattaattttttcaacgacagcatctttagtatcattgaagaaatcaacaactgaatctttagacagttcacctgagtcaactttttccatgattaaatcacgttttgaaagtaaaaattctttggccttgtcagctgaaatttcacctgaatcaaatttttctttgatttcattaaatttttcagctgagaaatcaagagcagtatctctcattccagtcaatgtttcttgagggttttcttttaaatcatcataaatttttccagccccttcgcggagttcgcttccttttttaggagttaaaaatagagcagctgcggcaccaactaaagcaccaactagaaatcctgttttttttgacatcggttaagtcctttctttcgtaagcaagtttaatttacttttacacccgcttcagttttatcttttttgacaaagaattttttggctgtttttgccaaaacgactgctgaagctgaagttgtttttcgttttgttgaacctctattaagacgtgtcacaagtttacgacttgaagcattgatatctgaaacactttcagacaagtcagcaaccgctgtaaacaaagggtcaatcgtggcgactttcccattaacatcatcaagcaaggtattggctttagccattatgccatcagcttgatgaagtaagacatctacatcgctagaaactaatttgaccgtacggttggcttcttccacaaccttagaaactttatgtaatacaataactaagaagaccaccaatacagcaaatgctatcgcgataatcaataatgcaatatttcccacgtttcctcctctttattcgggtataaaatcagcacccatttttcaatcttctttcattttgatgaaagcgattctatttgatttcattataacaaattgtttcgctattttctaatataacttacatttttttatgacaaaaagtctatccttcaagatagacttcttaattttttttcattctgcgataaataaagagaacaagtcctacaatcactaataaaactgaaagccattgtgacacacgagcaggtcctaacattaggctatctgttcgcattccttcaacaataaaacgaacagctccataccagacgagatagaaactaaaaatatccccacgttttaagcctttaattcgatgtctaaagaccatgaccagaataaaaccgcttagtgtaccaatactttcaaataggaaggtaggcattcgataatgaccatcaataaacatttgatttctgatgaaagtaggtagccagtctaaatttgaaacaattttcccataggcttcttgattgacaaaattcccccaacgtcccattgcctgagcgagaaaaacacccgggatagtaatatcaagcaaatctagcggatgaatcattcgatagtagctaaagacaaagaggacaattgctccagcgattaagcttccatagatggctccgccaccatcccacatggcaatgatttgtgaaggatgttgactatagtaagaccattggaaaatgacataataaagtctcgctccaacaattcctaaaggaaaggcaaagagaacaaaatcaataatatcgtcggtttttatattacgctttggggcttctttacatgcgagccaaacggctaatgcggcaccgcccacaataaaaatagcataccagtgaatggctagcggccctaattggagtgcaatcttatttaaagctaaaaagggaaatagattattcatattttttatcagttttctaaatttactgacagaattttcggtcagtaatttctaagttttatcttatgattctttattatgactgattaaatcagtgagacggtcttcaaaagtttttgttgcatcaaagcccatttgcttagctctaaaattcataaccgcagcttcaacaattactgacacattccgcccagtttttacaggaatgcgggtttgtgggacttcaacatcagaaaattcaacaatagtcggtgcatttcccaaacggtcaaaagctttttccttatcatagtattctaaatatatagccatatcaatatccgttgaatctttaacagcaccagcaccaaaaagactcatcacgtcaataatcccaacgccacgaatttcaatcatattgcgcaaaatttctgcgggttccccacaaagtgtgaatgcatcccgttgaaaaacatctacacggtcatcagcaactaatcggtggccacgtttgactaactcaagaccagtttctgatttaccaatcccactagccccttgaataagaacaccgaccccaaaaatgtccatcaaaaccccatgaacagtcgttctttcagctaaacgttcatcaagaaatgaggtcaatactgagttcaaacggctggttgcttcacgtgattgaagtaaaacaatgtcagactttttagctgctgccaccatttcactaggaatttctagattacgtgcaacaataacaaccggtgtttctttggccatgacttttttcaagaggtcatagcgattatctccaactacagtcatcatgtatgaccattctttcatcccaaaaagttgaattcgttcgggtgtgaaataatcaaaatacccagccatttctaaacctgggcgcataatttctgaagttgtaatttcttttgctaatgctgtttctgttgagtaaatcacatgaaaatgaattttgtcaagtaaatcttgaactgaaaccgccattgtaagtctcccctattatttcataaataagaacaactgacagagaatgttttttcgttataaaactttgtcagtacttttataataaaaattgtgataaaaatcacattttcatatcacgtataaatttatccaagcgataagcaaggaagattcggcgtactaaaagaaagccgaaaaacgtggctaaaaaccacgaagcagataggaaggaccagctaaaaatccaagcttcaagtaccgttccaatcataaaagaataaaatcgttgtttaggcatgcctctattatgacatttttaagccagaaatgtcaatggattgtgttgaataatacttaataaaaaaggctttttattttctaaaaagcttttcaattgatgatttatttagcaaagaatttgataattaaaaagataagtccagcatcaaccaatagtcccacataccatgagaaattgaaataccattttctagttttatgatgacagagatgcccagccaaaattgctccaatccctccacctaaaagtgcttgtgcaagtaaaactttttcaggaattctccacagatgatgttgggccttgtacttatccaccgcataaaaaacaaaaacaataagattccaaactgctaataaaactaataaataaagaatcatttttctcccttcacatctatactaaatatcattagatcttaaattctttcattttctcaactcgaagagcccctttttgaccactaaaagtccaacgttgtttaaacgcccgtctttcctgagtatttcccgcaataatttgaccagaattaacagaaacaaggtagtcaatagctacaaaatagaggtcaacttcaaattgattatcttttacttccttataacgcatgattccatccaaaaccacactacgcgtgtgattaatttgacctttgtcactcatcttttggagaattttttcatgtttttcatataaattatcaccataaaatgctgacaaagctcgtaagtcttgtttatcccaagcatcttgaacttttagaaaaattgcttctatttctgcttccaaagctgaatcatttaaggtcttttcctgataatactctctttttctaaaaggaagtttaagattttttttcaaaaaataaaaagctaggccgattagtgcaacaagcccactaaaaatactatttctattatacctgctccccattctagatgtcctagaattagaagtatagctattagaaacagtattattataatggctgttagtatttccacctccaaaattaccgccagttctcgtacttctatttcctccccctcgaaatcctcctgctgttgcaaaagcatgaggtgtgactaaaactaagccactgatgagcaataaaataaccactttcttcatcatttgattcaaaaattatttccttttctttgtcactgattttattatatatattttgttattataccctatttccctttttatttgaaacatctgttaaattactacttttagtggagtctattaaaagagtgtgatataattacctcatgaaaaaactcatgaatctttttaaatctgaaactgttagatatctcattttcggagtcctagcaacagcagtttatgcctttgtcaaatggttaacttggcaagcttggcattctggctggggttcagaaactgccgctcaagcttcaagtattatttttgcattttttaccaataaactttttgttttcaaacatgaatcatcaaacttattacgtgatttcataaattttacttcaggacgaattgttcttttactcctatccatctttattaactggtggttcattgaccaacatcctgatattttgatgaatctttttggactttctaaaaataatatggttgctgctcttaacctcgtcgttcaagttttaattattgttattaactatctttattcaaaattctttgtcttcaaaaaagataaaaatttaacagaataactattttttttactgatagaaaattactgacaagatgaaaaaaatactgacagattttctgtcagtatttttttcatttttattagtattttttattttctaatttccttgatgaattcaacaatttcaccacgtcgtgtttcaatcttaccaacttttgttttttgataaacagcatttaatatggcaccaataatcaaaacgcgggcgatgaaaataaaccaaatcatcagtgcaaagacgaccaatgacccaatcaatttcaagtcatctaatcgttgaagagcaaagctaacatattttgcaatccagttggttagaaaaacaagaacaaaggttgaaaatattgttccaggcatggtgtatctcaattttcttattttaacatttggtaggataaaataaagcatcatcaaagataaaaaggttgctacagcaatcgctggtaaagtcatattgtgtaacgttcggtagagatggtcatcaaaaggaaataagcgatgaacttgttcaagaattaattgtccaaaagtagagagaacaattgaaaagtaaagaaagagtaaaatcgcaaatccggcagctaaaccgataattcgactgacaataaaatctcgatgattaaagacttcataagctttattcattgacatttgtagagcagataaggctcttgaaaaggtccaaaaacctgccaagacagagagtgaaagtaaacctgtatttctttgatttaagagattattaatgactggttcaattcctttgtaaacatcacttgggagttgctcagacaaaaaactcaataaagctgttgtattgatatgtaagaagggtaaaatatttccaacaatcaatcctagaggaaagattgcaagtaaaaggtaataagcaacagcaattgaagacagactcatttctgaacttttgaaaaaagtcataaaagttgtcgttagttcagcaattttttgtagaacttttttcatctttcctctcatctgtttttcctttacttcttaataagtccgttcttcgccttgagaagtcaaaatcacaggaccatctttcgtgataacaaattggtgctcgtattgacatgataaacttccgtcaagtgtaacgtaaccacgttcaccatcatggtcaatttcccaacccccagtgttaatcattggttcaatggttaagaccattccttcgcgtaaacgaagtccacgtccagcacgtccgtagtggggcaccattggttcttcatgcattgttggtccaacgccatgtcctacaaggtcacgaacgacaccatagccacgactttcagcgtattcttgaatagctgccccaatatcaccaatacggttgcctactttggcttgttcaattccaagatagagacattcgcgggtcacatccatcaagtttttcacttcgtcagaaacttggcctacagcataagcccagcaagagtcagcaacgccaccgcggaattcttcttgatatttaaccattgattcagcatcgtcaaaattaagttttgaaacatcaacagaaccatcttcaaccaaaccgagaaccatgtcaaccttaatcaaatcaccatctttaagaatttgatgacgtggaaatgcgtgagccacttcatcattcaaacagcagcaagtagcataagggaatggattataatttccttcatccactccgatttgtaaaggtaaaacatttttttctttacaaactttgcggacatattcttcaatttcccacatatcaatccctggtttaatcaactcacgaagcccaatgtggatatctgccaaaattttgctactacgttccatttgctcgatttcacgttgcgattttaatgtaatcaatttattctttccttctaaagttctgagaaaaactcagttctttttatttaaattaatgttttgaagtgactcatacttcatcgaaaaataaattttcatttactggggttactgaatccttataagatagtatttatgactttatctataagaattttcttcgacaatcatgagccttttcaaaattactttgaatgctaattcaactgaacagatttttttgtaatccaaaacagtctatttagtataaatacactttattttaccataaatttccctataactaggtgttttttatataaattggcagtaaaacttcatctaccaattcattaatttgcttatcattcatggattgaccttcaaggagcatatgataacgggtcatctggaaaggtaaaagcttagctgtttgcccaattttttcacgcgcttcccctctttcctgagcccttgcaagcaagcgttccataataatcagattacttggaaggacattgccaacggtcgattcaagaacattttttccttgcgactgcataaatgaaacgaaggccagaaatcctttgggatagagtttaaaattttctctcataaaggttaaaagttcaattaaatcttgccgcaagctcccactgttaatttcttggtctatcacatttcctcgccactcaggattttgtgaaatattgaaacggacagcttcaaaaattaagtcaaaaacatcatcccaataacgataaagtacacttcgagtggttttggcttcttttgcaacattttgaaaggttactttttcatagccttcattttctaaaatatgaactgccgctttataaattgccttcttaagttcatcccctcttcttctagaatgactaggtgattttttttctttttcttcaaacataagagacctcgtgtttcttaattctattataacatcatctttatctaataccaaaaaatcaaattagatacaaaaagaatcttattattgacaaaacttattcttaggtttataataattttgcacttaaggtacaaaatgtatgttatttttaaattataatttctaagtttcgataacttagttttcgttcagacgaaagaaaggattaacgatggcaaaatcaaaaaagaatgaaaaagaaaaattgccaaaggaattgacgcgaaatgcttggattttagtcgttggtgctattgctccaatgcttgattcaaccatggtcaatatcgcaatcaacaaacttcaaagtgacttacatacttcactagacatgattcagtgggcaattacaggctacgttcttgcacttgctgtagccgtccctgtctgtggttatgttgtcaatcacattgatggaaaaaaagtaatgcagtggtcactccttagttttggactttttagctttttatctggaattgcttggaatattgatagttttatcattttccgagctgttcaaggatttccagctggttttatcactttactgatgacaaccctgctaatgcaaattacgcctccagataaacttggtcaattgatggctgttgtctcaactcctattattcttggaccaattatcgggccagtacttggtggtgcaattgtatctggagcaaattggcactggattttctatgttaatattccggtagtaattattgcagtcctccttaatcatttttatctaagttctttcaaacctttcaaccctaaagctaaactagattggtttggaacactccttttggctggcggttctgtgggattaatttacggaatgatgaagggttcaactaatgctaaaaattttttcaatagtcaaatgattacttttgtcatcattggcttagccttgtttgttatttacggaatttataatcgcattcgcaaaaataatactgttcttccgctcagatttttcaaatctaaaaacttcactgcagcgaatattggaatctttttagctggaattgcttctaatggacctatgcttttactgccacttttctttcaaaatacaaaaggctttacagccgttgaagcaggtctaatgttgattccccaagggcttggtatgatgatgacccgacctttgattgggaaaatgattgaccgtatgggagctcgtcctgtagtacttgtttccctggccacttcccttcttggaacaattcctttcatttttgttcacgaaaatacaaatttgatttggttgggattggttttatttgttcgtggaatgggaattggtggtttgcaaatgccaatgatgactgatattttcattggtttagacaaacaagatattcctggtgcatcagtaggacaaagaatcattcaaaacgttggttcatcttttggttcagccgtcatctcggcagttgtgacggcggttgtgacgtctgaaattgctggacagatgacaactaaactacatcaattagcggcgatgcacaccaatttaacaccgactgtcattgcaagagcaaaaacttctgttgaaaaagcggtcacgcttaatggttatcaacttggctttcttgtctcttcaattgttttaattgtgattgctattccagccatgttcctttcacaaaagaaggtcaacaaataaaattcgtagtttttagctttgatttcacttgttttttgatataattgaattgaattatctcaataatagatagatgaactttaatcaattaactgagcttggagcgctaaattgtatggctccttgcatcttataggagagtgaaaaaatgccattagcaaaaattgtatatgcaagtatgacaggaaatactgaagcttgtgccgatattgtcgctgataaacttgaagaattaggttttgaagtagaacttgacgaatgttcttctgttgatgccgatgagatggctgatgctgatctttgtatcgttggaacttatacttacggtgacggtgaattacctgacgaaattgtggatttttatgaagaattagctgaggttgatttatctggtaaaatttacggttgtttcgggtcaggtgatactttctatgatgacttctgtatctgtgtcgatatgtttgaagcgcaatttgaaaaaactggcgcaacaaaaggagctgagcttattcgtgttgacttgtctcctgaagatgaagacgaagctcatctcgaagcctttgcggaaactttggcggctcactttaactgattgagttaagataagtgataaaaaatactgacaggttttctgtcagtaattttttatttatttgaccatttcaatctcactgtcaaaatattgctcttgaaaatgaactgctttttcaatttctgattttgtgaaattttcagttggactggttagtacccatttgtcttcgacatcatcttttctgtggataatagcaatgagcttgccagtaaaatttgtcagggctttttgattttctggcaaatttgacaaaatataaacatcttgttcttcgccatcaccagcaataattccttcaatgtatccgtaatttattggataagttgttccatgatgaacataacccattgggcggtccatttttgcagtgtaaatcttcatacccacctccattttttactgacagcaccgagaaaatttctgtcataggatagtcgttagcgcttgagcgcttacgaatatgctaggagtttctgtcagtaattttataatgaaaacatcaaaattccagctgctacagccacatttaaagattctgcttgccctgacatgtcaatatgaacgagtttgtcagcagctttaacggcttcgtcagaaactccggccccttcatttcccataatcaatgcgaagtgtggttcattgattactttataagacacagaatttgctgacagcgtggtcgtcaatattgaaatgccggcttttttaagttgagcaaaacaatcttctttagccattcgtacaagcggcaaatgaaaatttgagccttgcatagaccgcatgacctttggactgtaaatatctgcggtttcgccaagtaatataacagccgaaaatccagccgcatcagctgttctaatcattgtccctacatttcctgggtcttgtacgttttctaaaagtaaaaattttgctgctgaaaaatcaatgacttcttcaatttttgtcacttcagcaatcagtccttgtggactttcgctgtcagctaaagatttcaacacttctttactgaccagatttacagataagtctgtcagtgatttttcagacccaatcatttctgtcagtttagtcagtttattttcttcaacaaaaatttgctttattgaacgaccagctttaagtgcttcctccaacaaatgaaagccttcgatgagatatgaatttttgcggtatttttttgtcagcaattttcttgcttctttaatttttttattatcttttgaactgatgatttccattctccaattatatcatagccagtaaggcgaaacaaagttttacattgccagtatccactgcattgataatccaatgaagtgcaggatagctgttgccactttactggcttacagatatgctagttgttcatctaaaaaggataatttcccactgagtgattgtgacttatgaaaaacatagatccctttggttttgacaggaaagcataagcagtgaaacttttatcagatttttgctaatcttgctggtgcttatgttataataaaagaaaacgttttaactattatcatttcaacaaggcaaagctaggaggtattaaaatgttcaaagtaaaaatgattgtttctggacgcgttcagggtgtcggatttcgttattttgttatcataagtgcgcgtgaactgggcattttagggcgtgtttggaataatgatgacggtacagttgaaattctcgcgcaaacagaggatgaaaaaaaattagaagaattcactgccattgttcgtggggaaaaatcaagtaaaggacgtctttcaccctttgctaaagtcactgatgtcaaatcaagccccgcaaattttcctgatttcacagacttcaatatcaaatattagaaattaaaaaatactgataaaaaccttgtcagttcaatgcgaccaagctacaaaatcacatcttagatatgagttcagcttgtccaagaagtcaggtcgctaaagctaccgaccctatggcaaggcgagcattgaagcggcagataagaaaaattactgacaaaaattccgtcagtaattttttacattttattctttatcagcaagtttatccacaaattccaaaacggtcagtaaatttcgcttatcaatatgataggaaacagcagctttgaccgcaggttttgcacaaaaggcaatcccaataccagctgtatttagcattggaatatcatttgcgccatcacctacagcaataacctcagataaattcaacttattttcatttgcccattgtttgagcctatcaactttgaaatctttatccacaactgtcccatgagtttttcccgtcaaatggccattttccacagacaaacgattagcaaaaacataatctatttttaaatctctcgcgattttatctactatttcatgaaagccaccagaaacaaggccaactttccagcctttcgcacgtaatgtttcaattaatcccgttgcacccttagttaaatgaagttctttgtagacatcgtcaaaaatagttgttgacaaaccagaaagcaaagccaccctttctctcaaagattccttaaaatcaatttcgccagacatggcggcagccgtaatttctgaaatcttatcacccatacccgccttttcccctaagagatcaatgacctcttcttcaatcaatgtgctatccacatccatcacaagtaatccttttgcagccattttcttccttttccattcgttttttaaactaaactctggttttcaattaagcgaacacgaataatattatcagcagcctcaaaacgtgaaactaaagccgccaactttccttcatctttttcatccaaatcaagtaaagtataggcaaaatctccttgaccacgattaacaatattagcaatattaatattttctgctgccaccgcaagtgaaatttgagccacaacattaggcacatttttattgattaaggtcacacgataaggcgtattcaactcttgcaaaacacgtggaaaattgactgaattaataatttcgccagttttcaaataagtttgaacagaatccagagccattcttgtgcaatttaaactcgcttccgccgttgaaccacctaaatgaggagttaaaaaaacttgtggatgatgataaaatttttcagaaccaaaatccgtaccaaaaaagcggacaattccctcatcaatcgctttaagcactgcttctttatccgtaatctcatctcgtgcataattgagcaaaatcactccctttttacacttagataaatttttccaattgagcattttcgtcgtttcatccgtcgctggcgtatgaaccgtgatataatctgccttctcaaaaatctcagccaaatcattcactcttttaacatgatgtgacaagttccaagcgtgctcaattgaaagataagggtcataaccaataactttcattcctaaacgctgtgcatcattggcaacttttgaaccaatattcccaaggccaattacccctaaagtttttcctgaaatttcagaaccagaaaacgcctttttcccatgttcaaccgccccatcaatggtattatcatcgcctttttgaccagtcaaccatttgtttgctggttttaaattacgcgttccaaaaatcatcattgacaaaactaattctttaaccgcattggcattcccaccaggcgcattaaagactacaatccctttactggcacacttttctatcggaatattattaaaaccagcaccagcacgtccaatcgccaaaagcgctttggaaaattcataatcgtggaaaggctgagcccgacaaataaatgcgtcagattcagcttctgacacttgattaacaagaaagccttcgccaatttcatctagtgcgatttggtcgatattatttccaattgttttgatatgataagtcatttatattcctcttcaaattctttcataaatttcactaattcaacaaccccctctaaaggaaaagcgttataaatacttgctctcattcctcccacggaacgatgacctttgagtgatttgaaacctttttcttcagctttttgggtgaatagctcatccaattcttggcttggacttgtaaaaacaacattgcaaatcgaccgctcatctttatttttgattgggttctgataaaagtcagattggtcaattaaatcatacaacaattgagcttttctctgattcatttcttcgagtttttttacaccaccttgtgcttttacccatttgaaaaccagcccgtccacataaatagcaaaagtcggtggggtattgtacatcgacccatttttagccaaaatcttataatccatcattgatgagaggctttcagcttcattcagtaagtcttcacgaataatgacaatggttaaaccagcaatacctaaatttttctgagctccagcgtaaattaagccaaatttactcacatcataatcaaccgccaaaatatttgaactcatatcagcaaccaaaggaaggcttgcaaactcaggcaaattttcaggaaaaatacttgttccttcaatcgtattattcgttgtcaaatggagataggccccatttttttcatcaattttagatttatcaattttcaatagatgattataattatcttttttagttgagcccaaactaatcggtattaaatcaaggaaatgactcaatttcaccgcttcatcataagccttttcaccaaaggcgcccgaaatattgtaataagcctttttgccaattgccaaattcattggaaccattgaaaattgactggaagctcccccttgtaaaaacaaaattttatagttttgaggaatcgacatcaaatcacgcaaatcgttctcagcctcatcaattactttttggaaagccttggagcgatgcgaaatttccatcactgacataccacttttttcaaagtctaacagttcttcttgaaccttcttcaagacttcctttggaagtacactgggtcctgcgccaaaattataaatcatcgatttcacttcctcaaattatttattaatcactattatagtataattttctgataattcaaatataaaaaaatactgttcgacaaaaaagcacagtcaactgtgtttttctgccttaacagtaatttaccaatttaataaatcaagtaagagcatgttccattcaacctctttggcataaaaaatattcccaccattagagtagagttttcctttattataaatcaatgaatccagagtcaaatgataataagtttcacctgttgtatttcctaaacttggcgcaacgacatcacgagaataatccttagaaagagcgattgtgttctttccaccatgagcagctatgtaatcaacataggccttcccatagttataagcctgaactcctgcccaagcgtcaacctttttttgtgaagcatattctaaaacttttgacaaattagaaataccttgtttaatactttcttgttctgttgagaaagtatttgttgtgccattcaagctttcacttgattgcataatatcaacttgttttcctttagtttctgtataaataattgccaaagccaactttgtatcaccactcaagccttgtgcttcaagggttttttcgacttctgcctcataagacattacgtgtttcacattttcatgcatccggtaaacataaaaaccactgaatacaagaagtatcagtactattaatccaattaattttttaaacatttcacttacctaaattttctgactgctcttattctttactagcacatatcattatttttttttgcagtcattttttatataagttctattataacacttctcttttaaatttagcttaacattaaaaaattagacaaattttctttgtctaattttttgatattataagggaaattgacgagtcagttctaaagctgctttcctaacttccgcaagtttttcttgattatcgtgattaaccaaagcttctgagaccaattgtgcaacttttttcgcttcaatttctttaaatcctcttgaagtaatcgctgctgctccaattcgcacacctgaagttttaaatggtgataatgtttcatcaggaattgcttctttattgagtgtgatgtgaacactatccaataaatcttgagcttctttcccattaattcctaagtctaaaactttaagattaagcaaatgattatctgaaccaccagctatcaatcgtaagccttccactttagcaaattcctcagccattgcttgcgtatttttaatgacttgttcaatatagatcgtgaattctgggtcaagtgcttctttaaaagctactgcttttgctgcaatgacatgttctaaaggcccaccttgagttccagggaagattgcagagttaattttcttggccaaagcttcatcattagttaaaatcattccaccacgtggtccacggagtgtcttatgagttgttgttgtaacgacatcagcataaggaagaggattagggtgcgcaccagtcgctaccaatccagcaatatgagccatatcaaccattaattttgctccaacgctatcagcaatttcacggaacttagcaaaatcaatcaggcgtgaataggcagaagcgccagcaacaatcagtttaggttgaacttctttagcaatttttaaaatttcatcataatctaaaagctcagtttcagaattaactccataaggaacaaaatgataagttttccctgaaaaattgactgaagccccatgagtcaagtgaccgccagcatttaaatccattcctaagactgtgtctccaggttgaattaatgccatataagctgccgcattggcttgagaacctgaatgaggttgaacattggcaaattttgcaccgaaaagtttttttgctcgttcaatagccaaattttctacaacgtcaactgcttctgttccaccataataacgtttcccaggataaccttcggcatatttatttgtcaaaacagaaccttgtgctgccataactgcttttgaaacaatattttctgaagcaattaattcaatattttgttgctgacgaatttcctcagcatgaatggctgcccacaattctgggtcaaaactttcaaaatcttctttatcaaaaatcattggttctccttgtatgtcttttgggatattttaaaaaatataagtagaattttatagtcattagcgctataaacttaatcagttaattttagtttactttcgcaagcaaactttcaactctaaaactattatatcggctaaaggctcttttttgaaataagttggcttgtaaatctcatcattgccaaagaatgttcggaaatttttagattacttttttcagcttattttattcaatttgaccaagttcaggaacttttttaagtaattcttctttagtaacggctccttgacgcagtaattttggtttttcttgcgtcaaatcgatgattgttgtatctagtccatagatgctatcatcttgaacagagactgcggcattttctaaaatttcaggacttaaatcggcaaagaaacttggacttttagaaccacttaaattggcagaaggtccgaccaaaacaccgacttctttgataattttttgggttactgcaatatttggcattctaaaaccaacagtactttttccaatatgaatccattcaggaacatctttagatgcctctaaaataatggttagaggtccaggaagaaaggcttccacaattttttggagataaactggttgattgattgaatattttaacatatcttcaaagcttgaaatattcatatttaaagctttttctgttggacgtcctttaactgaatagagtttttggactgcttcttcattcatcgcatctgcaaagagaccgtaaactgtttctgtcggtaaaatagctaactgaccagattttagtgctttgatagctctagctgataaacgatttttattattattctctttttctgactgcttgtctagttctttttgtaatgtttttgcttcaataaaaagattttctctaatatttttcaaatcatctggtactttgtagggacgacgaaagagaaaaccaataataccataaaatccaccttcgactttttcaagttcgttagcaaaattattgagtcccccttgcacaaacttcaaattttctttagcttggtctatcttgtttgactcaaccaaagttttgatatcttttaattgcacttgcaaaaaagaagacattgttcgtaaatcattttcaactttcattttaacttctttcttaaatatattttatcttttaactgaacttttccttcaaaaataggatgatcataattatcaagaaaataattggaaatttcatgagtaattgtgaagccgcatttttcatagaaagctacattgtttgaaacatcatctgtgccaagaattagctcatcagctgctaaattttctttcaaatatgtgatgagttgtttcatcatttgctgaccgaatccttgtccttgaaaactagtttctacagcgaaattctcaatttcaaaagtatttttttgtttttttatgactacagcacaggcaacggtcttgccattttttaaagacagagtaaataaatctccattttccagataattttctaaatgtggtccatcatcagctaataataatattggtaaaaaatcttctttttgctgaaatacttgttcaaaaattaaagaattcatttttctccttaaatatagcaacagtagcttttatcatttgatattaatcattcgatcttttccaaatatatcctgatgaatactaacaagcttgccagtaaatttttcttgaaacatagcttggacagcttgcccttgcttatagccgatttccaaataaatttttccattatcggtcagatgattgaccgcttggtcagcaattttttgataaattgctaatccctgattttccgcaaaaagcgctaaatcaggttcatatttaatgacagaattatccatttcgtaagtttcatcaaaagcaatatatggcggattagaaacgataatatcaaagctgtcagtaatcttatctagtacatctgattgaacgaattccaaattagcctgatttatttcagcattttcagctgctaaagttagtgcctctttagaaatatcagaagcttttactgaccaattttcacgcgcttgagctagagaaatggcaatcgctcctgaccctgttccaatatctaaaattttgagggaatcattctcattttcagccaaaatcatttccactaattcttcagtttcaggacgaggaattaaaacacgctcatcgaccttcaatttcaaatcacggaattctgcccaacccactatatattgtggaggctcattttgatgaagacgttctgacacttttgtcagtaattttaattcttggtcagtaattttttctcgcattaaattcaaccaagataatttatcaagttcatgtaaatttcgccagacaaattccaactcaaaagggtcttctaaatctgctgacaaagttcgcacagcttcaatccaaagcatttttctttttctactttccaatattaattatttttctaatatctttttaaattactcttccaagtatagcaaaaaagcccaataaaatcaggcttaatcaacttttcagtttaatgtaaatccttgctttttcaaaaatttggcaacatcctcacgccgtggatttgtcagaaaattgctcatttcctgcgtccaatcagtagacttttgatgatgactccgattggcatagtaagctgaagtttgttcattataagcctgtaaatcactcactgccacacgattataagcattaactgacaaaatatttgttcttggtaaacgtggtttaacttcatttcgtgtttttggcatcccaattgtaagaccaaaaagtggaacagtcaattctggtaaatccagtaaatctgccactttagcaatatcattacgaattccaccaatataacaaattccaagccccatagattctgcagctatcgccatattctgtgcagcaattgtagtatcaacaatggcaaccgtcaatgcttccatattctggagagccttcacatccttattttccgtctgtaaaatctgaacttgtcgataccagtcagccacaaatatataaaaaacacccgtttgattcacataatcatctgaacctgatatcctagcgagctcacgacgtaaatcattatccgctatctcaatgattgaataagcttgtagaaaattagatgaagctccagactgtgcagcttttagcaacaactccttgacatcagctgacaaaggctctgctttaaaatcacgaactgatgcgtggagcaacattttttcaatcgttggattcatgattgtttcatcattcatcaaaataagttcctcactactaataatttttataaataatcattattttacaagattctctactaaataagaggtgaaattcgagttaaaagataagcacataaagggatttttacttcttgagctggaaaaagcaaagcatactgctttcgattttgattcgtttcggaaaccaactcttctaaagttccaagttttgctccaagttctgagaaagattgacgtaaaggatttttactgtattttcccaattcagacaaaggtaaacttttcttggtccgactccagtcttcatctttttttacttcttgccaaagtcgacaatattgcttttctttataattttcaattgacatccgagttctttgcgctcggtgcaaatgtttagaaagagactctatcttttccgcaactacccaaacatctccattttcacccctacaataaagtaaatcaaaagataaatcaaagcctttaaccttaaaaatagtcacctctgttgaaacattattcaccttttttgaagtttgcattttcctattttcatgtcccacttctcgaataacaaaatcttcaaattcaaaatccattatttatttaattcttctaattttttagtttggtcatagacaatcaaagcatcaatcacttcatccattttcccagataaaatactatccaacttttgtaaagttaagccaatccggtgatcagtcacacggttttgtgggaaattgtaagttctaatccgctcagaacgatccccagttccgacagttgatttacgttctgcattttgcttatccaattcaatttgttgatagtaatcaaagacttttgtattcaacaatttaatagctttatcccgatttttttgttgcgtccgttcttcttgcatttccactttaatcccagttggtaaatggaccatacgtaccgcagtagcaaccttattgacattctgtccaccagcaccagaggcgtggtaaatatctacacgtaaatctttttggtcgattgtcatctcaaattcttcaacctcaggcataacaagaacagtagccgttgatgtatggacccgcccttgtgtttcggttacaggaacacgttgtactcggtgagcaccagattcatatttcaattttgaataaacagatggaccagaaattaaagctgaaacctctttatacccaccaattccggtgatgtttgcttccataatttcaaacttccaaccttgtgattcagaaaaatgttggtacatattcaacaaatcaccagcaaaaagtgcagcttcatcaccaccagcagctccacgaatttctaaaataatattttttccatcatttgggtcttttggcaaaagcaaaattttgatttcttcttccaaaagctctttttgtgattttgctgatgaaagttcttctttgagcatttctttcatgtcatcatcaagtccaccttcgccaagcatttcttcactatcagaaattgtttcaagaacttttttgtattcattataagtcgctactttatcacgtaaatctgcttcttcacgcgataattccataaaacgcttcgtatccgaaaccacctcagggtcagacaataactcacccaattcttcatatcttccaactattgattctaactgatcaaacatttctctatttcctttaattattttttagtttttaatggtaaatttttggccatattgacaaatgaatcccattgtgtcacatcttgcagcatgtcttttttaaaaatcatcacttgatttctaccttgaaaaaagtgcacacgatctgaaaaaatttcaacattacgtacattcatttgagctttaatttgttcctctgtcacatacatatcaagttcttgtggcttaaaatttttcaaaaaacgacttttcaattgccaatgtaaaaaaagatttcctaaaacaagaacaagcaaagcagaaacaaccggccaaagccactgccccttactcataaataaattaataaccaaaaaaataagcataattcctgaaaaaacaagcatcatccgcttggtcatttgaccaagaattctttgataatcctcaccagtaatcgttcctttaaaataataaaacatcaagttcctccctcttggtataaagtctgtccgtgtaaaattctaaacttattttttaaatttctggcttaaaataatgtttacgacaaacaggaatataggtttcgtttccaccaatttgcaactgttcaccttcataaactggttttccatcaattgtccgaatcaccattgttgcctttttactacaataccaacaaatcgttttaatttcttcgattttatctgcaagcaaaagtaaatattttgagccttcaaaaagctcattacgaaaatcatttttcaaaccaaaagccatgactggaacatttagttcatccacaacacgcgcaaaatcatagacatgttttttatttaaaaattgtgcctcatcaatcagcacacaaaaaggtttagcagacaggctgttcacataatcaaaaacagacatttcctcatcaattgcgactgcttcagctttcatcccgattcgactagcaactgtcccaacccctgcgcgtgtatccagactagaagtcattaataaaacaggcttcccctgttcctcgtaattatgagccactttcaaaatctcaattgattttcctgaattcatcgtcccatatttgaaatataattgcgccattacttttccttttattttttagcttctaaaccattgatatcaaaagttctgtacttcaaaatccctaaagattacttcataaacttctcgatttctctaatttttactcaatgaggtcaaattaaaacacaacttaaattatatcatatttcatttatattttaccccttctctctgttttattaatccatcaaaggttggaaacgttacttcatttaatgtatatctttataatttttcaacaataatctccttttttgaactcacatttcaactacttatctattttcttatttcttcttgcacttgagatgaaaacacctattctgaatttttttaaaataaaaaaccaatatttttgttattggctttttttttaaattcttaataagctcctcgctgatttttgtattttaaatcctgcattaattattgttatcttttattttcaatatatcatcaaaacaaaaaataataagagttttgcgctccctaaacttagtaaaaagtttaatcttggaaaactgattttagaaaaatcttttagatagcctttatcgttacttcaatattaccttgagtagcccgggaatatgggcaagttttatgtgttagtttcaagagttcttctgtttcttcagtacccactccttcgatatgtcctgtaatatcaactcctaatattacatctggaatttcattttgacttagattatagagagaaactgtaacttcaatagttgattcaccctctatattttttgatttcttaatatagtctaaagcactattaaaacaagcgctatatcctgcagcaaataattgctctggatttgttgctccttcaacctttctgcctggtgcaacaatatctaaattaaaacttttatctggagaatggacttcgccatttcgaccgccagtatttatcatttttgtagaaaatatttttttcattgaaatctcctttttaagttgtttacaatataattgtactaaatgcaattacgtttgacaaatatatagattcagatataatgaaatgataggagaaaatatgacagacaatattcttagcaaggaattatgttttcaattatacattgcttcaaaggaaatcataaaaaaatataatttttatttaaatagatattcgcttacttatactggatttatcgctatgttagcaattgaaaacaagatgacaataaataaattaggcgatgaactctctttagattctggtacattaagccctctgctaaaaagattggaagcaaaaggatacattataagaaaacgttctgataaagatgaaagaagtgttgagttatttctcacagataagggagcacaagttaaaaaggaattaccttctatatctcttgaaattggtgacagtttagtttcttgcaacgagaatattaattatgacttacttctctcgcaattacttactttaaataaaagtttgaaaacagaaatttaaatatttatacttatttatataaaaaaacctgacctaagtcaggtttttttatttattgtgaatcttttacagcctgatcagattttgctcgagtatcttgaacttctcgcaatgcttgatcattgtcctgtccagacttttgccttaaatcattaagttgttggtttaattgagaaattatttggtttgctgtatcaacctctttttgtttatcagctactttttgatttccttctgcaatttttgtattgatttcatttatctttgcattaatttcattttgtttgtcaacattagcttgcgttaattgagtttgcaaagaattgacttgtgaactttgtgaatcaactgaactttttaagtttgctatggtctgatttaaatcagaaattacttgatttttacttttaacccgatttgatagtgtatcaatattgttgttaattgtctgaatttctccatgtccagtccaataattatccgctaatgatttaataccaatacacgtactaaaaactattgcaaaagtggtggctgctatgataattttttttattttcatttttattttttcctttatttttttcaaattacacacacaaagagcattgtaccatatacattacatcaaaacaataccaattatgaaaaaaactgacttttttagttatacaaaaaaactataccccttaaatgtttgttaaacaatacttaagaacaacacgaaatgcataacatataaaacatgcattataccactttgataacatatacgaaaatcccagataaaaaccaaagaaaaggtttacattcatgcttttttatgctataattttccaacctcaaaataggagaatataagatgaaatactttgtacgccttgctacagagcaagataaacccgcagttgctacattctatgataattctttaccattgattgatgaaaaacaaacgagttggataaaaaatatttatccctcaattgatacagctctaaaagcaattgacttatctcagctctttgtttgttatgattcaaatgatattgtttcaggaactgtgatcctaaataatcaatcagataaagagtatgaaaatattacctggggcactccagagcttgatcctaatcaaatcttggtaatccatactttaattatagatcctaaaaaattaaatcaaggaattgcaagtactatgatcaactttataaaagaatttagcaaaagtaatagtatggtaactatcagattagatactaattttaaaaatacacctgcacagaaactttatgaaaaacatcaatttgtatttcgcgggagaaccaatctcaagagctttgataacaaaggatgggacgattgcgtattttatgaattttgtcttaaataattaaaaatataaaaataagtaaaaaccactattttttttagtggttttttattttataaattttcttttttaacaatattttttaatttattttaaattctacccattaaattttattatgatttctttaaattcattgctacaaagaggaccagtaatatttgcatatttgaactaattaaatatattcaaaattttgatagatattttttaaatattgaatcaaatacagaacttctttgcccttctctaaatctaactatagcagaaaataagctctttttttgggggaaggaacaaactgagatgttttttatctttttactattttttctgatattatccattgattaatggttttttttagagtataatatcagataaacagatgttttgtattaaatatgttactgaaggggagagatggataaacataaattaaataacttttttgactactcacttgaacctcgtagagctatcctttttgaagatgtcaaatcaaattacgcctctattgagtgtgttcaacgaaaccttaatcctttgacaacttctctttgcgtcatgagtcgtgccagtgatttaccctttattattgaaacaagaaaattcaatttcccacaatggtatcgaacacatacggacatttacggacaacggactgaaccaactttgcagtatgtcgctttcatcgaatcttgggcaaaacgaacatggcttgttccgcctcaaatgcagctctatgtagattataaaatcaaagttactgaaattctaaccaattacacatcaattgaagaaattcactcttactcaattgatgaatcatttttagatatcacagaatctcttaacttcttctatcctgatattagaaaccgatatgagcaaatgaatctgattgctttagatttacaacgtgagattttggataagttagggttatatgtaactgtagggatgggtgataatcctctacttgcaaaacttgccatggataactatgccaaacataatcagaatatgagagcattaatacgatatgaagatgtccctagtaagctctggactatttctaatatgactgacttctggggaattggaaagcgaactgagaagcgtttgaacaagttaggaatcagttctattaaagagcttgcaaatgctgaccctcttctccttaaacaaaaattaggaacaattggactccaacattttttccatgcaaatggaattgatgaaagtaatgtaagggaaaaatatattcctaaatcttctagcttcagcaattctcaaattctaccccgtgactaccataagcaaaaagaaatagaacttgtgattaaagaaatggctgaaaacttagcaataagattgagaaaaggtggaaaaatggcaagcaatctttcactttatgtgggtgctgcagcaagctctgaacactcttctattaaaatttcacgcaatattgaagcaacgcaaaatacaaaagaactgcaagacctcgcaattcgtttatttcgtgaaaaatatcaaggtggagcagtaaggcaaataggaataagtggcaatcaactctctgataattccgtcaaacaactttccttatttgaaactgttgaagaaaatcaagccaacgaaaagcaggaatcccttcaaaaagccattgacgaaatcagagaaaaattcgattttctatccattcaaaaagcaagcagtttatccgaaggatctcgtgtgatttatcgaaataaacttattggaggtcatgcagcaagtcaaaataaggaggataaagatgtcagttgaccgttcttatagtacttatgaagtcattcgagcatatcaggatagaggaatgatgaaatggggatcatttgcgaccggagagttgaccgaggcccaaaatgcatttgttaaagagcaaaatagtgataaaatcttacagcctttatctcatcacattatacttcatattctcaaccagtcatttactaatcaagtacaagtcaaaattaaatatcaatctaaggataaaataactgaagtttttggttttgtatcagaatttatcaataatcaagttagaataaaatccatagataaaattcacctcatatctatcgaaaaaattataaatatttcataattaatgaaaaaagcatattatgtccaaacatgcttttttattactatagcttctttgaatacaataatttcataaataagaataatttttaatatttattcagatgacatctcatgatataattgtttaaagaataagttcaaaaggagaagatttatggaatatcaactaagttcaacatcaatggcaccactagtggagattagtcttaacaataatgaagagatacaaattgagtctggagcgatggtctatcataattctgctgttaaacttgaaggaaaaatgaacagtaatggaaaaggaggacttggaggtgccttaaaagctcttggtcgttcaattacaagtggagaaagtttctttattactaaggcaagcgcaataggtgcaaatggtaaaatttcgcttgctcctgctagccttggttcgattaaggaaattcttgtcggtaaagaacagtggaatcttaacacaggggcattcctcgttagtgagggtggtgtccattacataatggaacgtcaaaaattagatggagcattatttggaggaactggtggtctttttgtgatgaaaacacagggcagcggaaagatgttaatcagcggttacggggatattgtagaaatagctcttgatggaacagaagattttgtagttgataatcaacatgttttagcctggactgaatctttgagttattcaattgaagttgcttccggaacatttggttttaagacaggagaagggttagttaataaatttcgaggtaagggaaaaatcctgattcaaagtagaaatgttgaagccctcgcacagtcaatcattccattcataccaagtaaaggataaataaaaagtcactaaactttagtggctttttattttataagttcccatatttttcaataatatcttgttgttttatgtattttaaatttttccgactaacttttattttagtttctataatgcattgttataaagtaatccagtaatatttccatatctaaaatatagttgtgcgattacttttccttttcccgttttatcttctaaaccttagaagattcttcactaatttctttccctataatataaaaagatagagcaatatttttcttgctctatctttttatattgttaattattttttactttgtttccgcaatttgtagaactggtttttttgaactataagtgctcaagttcttagcgaatgctaccaaaaggggattagtgttatgtttttcgatagcttcctgtgattcccaattttctatcatcacaaattctagcttattatccgtagattcataaagagagtattccagacatccttcatcctttttggaagctgaaatcagaccttctatctcttttaagaattgagattttttatcttctttaatataaaatttatcatttacaataatcataatttttattcctttttatttattaatgtttatttttcaatttttggaaaaataaatacttgacaagtcaatgattgataagtcatataataaaatattttacttgtttttgcaaatattttagattacacagaataaaaatttatatgatttctttattttctcatttaaataaaaagaactgcctttaatgacagttttaaggactattataaaattagatataattaaatttccataaaagcataatagttacccgaagggctttggaaattaaatgcttttttcccgttagcatccatcaagtcgcttgttgtaggagtaatcttctttaatttttcattcatctcttctatattatctactgtgaatagtaatgaaggtttatcattcgcaacttcgggtgagactttttttataaactcgatatcccaaatttgtaaaaaagcattgccatctgatagcggtgcaattacaactgaatctgagttttccatcttatgtctttcaatttctaaaaaaccgattgacctgaaaaaatctacttctttttctacatcttctacataaagatttatacagatattaaaagccatatagttctcccctttttctttttataccgctattataacacgaaaatatttaatttccccactaacttcttttagctccctagcttacaattttgaaagcacacgaacgcttttttatataagattaaaaaggaaaaactaccaaaattaagagcttttatgattcaaaactcggtcttataagccctttttaccaataaaaggaacaaacttcggggtattttttgcatattctttaaaatcttcacgattcttatattttttttcaagaattggtacaccagatacaaataaaaggagactagtaatcaatagaggactaataaccaaccaaagcgttgataaagtcgtcaaggagattaagaatattccccaccaacacattgactcgccaaaataattaggatgtcgtgttaatgaccacaggccactagtcaatagttttcctttattttgggggagttttttaaagacttctaactgacgatctccaaaaacttcaaaaataaagccaaatatccaaattattattcctaaaatttgccaccaataaaattgagaattaacatttgaattgacttgaataattgggagtgaaataatgattaacaaaagatattgcaccataaataccgttagaaaagctttcaatttcggaaaattattgccccaccttttacgcatatttgtatagcgataatcctcgggtttattccaatttcgtcttcctaaatgaattgctaaacgtactccccataatatgactaacactaagattaggctattttgaatcgtaattctcggagaaaataaataagagaccacagctgtaagaacaaatcctccgccccaagcaatatctatcaatccgtaattcttcttagatgtcgcaataagaaaccaacagatgaaataaagtaataaagttaccaaaacggctatataattcatttgacctcctttaatagtccggcaattgctaaacttccaatccctgcagaaattccaattgctgctgaactgtctataatttcacagtttttagtagttttttctttcaatagttcatttatctttaaagctgattcttcggataaaacatgtgtcaaagctaattcttcgatttgtccttcttttgacaataggttaatttttttcaaaattttatccatactcttagtttgactaaaagaagcaccaatcagctttccgtttcctcttttatcaagactaataattggatgcattgaaagtttttgtgcggtttctcccaaaatttttggaattcttcccgaatttatcattggcgataaatcttctactgccacataaataaatatccggtcaattattttttctgtttcattaagtactgattcaatagagcgctcttcactaattaatttggcaacttgtttaactaatagtccttgagctactgaatttaatttggaatctataagatgtactcggttttctaaggatttctttgctgtaattctttggttgagaagttgataagtgccacttagttttgaagaaactgaaatcacgatgatatgttcatattttccttctaaaaaggagaaaagtgaatcaacagattgaatgcttggttgagaagttgtcatttttaaattcttattatacttttctgaaaaaatttgaggattgattgtaagtttatctaaaaaggcttgctcacctactgaaacattcaaaggtaaaacaaaaatttgattttcaagtataaaatcagcagatagatcggcaacagaatctgtgacaatagcaatggatgattttctattttgtgatatttcatattgtaattgcatatcatcaactttttgatagataatcgttcctgttttttctaacagtgctaatatattttctggatggttagtatggatatgaatctttatttgttttttatttccagcaataactaaagaatctccccatttccttagtgattcttttaagtccttttcttgttttaggggttctttgataataaattctgaacaatacctatttttaggtgcttcagatataaagtgttctttaatatcttctttatttaattcttttatgctggggataagtccttcttgtatcttacttactttttctccacagtaagcatcagtaaaaccggatataaagtagtaaaaacctttcgctccagagtcaacgagtttattcttttttaaaattgacatctgaaattgtgtttccttaagagctttccaagcttctccttttgcttctagcaaggctttttcaaaagatgtactttctttaaaagtaatcagtaatacttctgcccatcttttcataactgataaaatcgttccttctttgggctcaatcaaagaatcataggcgctctttactgctctgttgaaagctaaaacaagtatctctaagttagtttcatatacactataataatctgaaacggcatttaagtactgggcaaaaataattccagaatttccccgagccccaatgagcgctgccgaagctacttcatcaaataaaaggttcgttgaataattattattagataaattatcaataatggtttgcattaaagatgctaaattactccctgtatccccatcggcaactgggaatacatttattttgtttagttcatcctttccgttaataaccttttgcgctcctgctatgatactttctagtagacggtcttcagattttaacttttccattctttatccttccataaactttgtaatcacaagaaatgaaagacttgcactcaaagagcttacaaaagtcccccaaataatatcaattattgttaccattagtgaccagtctttaattgatgccaaatttgttaaatcgtatgtagaataacatactaatcctagtagagcaccactcagtaagacgtaagatatactatttttttcaagtccgggcattaatacaaaaaaggttagtgctcctaaataaataatataaaagataatggctggaataactttaaaatctcccatcaagttaccaatatttggctgatagatttttttatttgcaaaaaagagccagcaaatatctaaaattaaaaaaaatactccacttataataaagggtttaataaaattcattatttttctccaatctatagctttcagttttacagatgtatatactcatgaatatcaaaatttttatgctatattatcattatttattgcccaaaccatcagattctcctcaaattatttagttcaagatagcaactgatatactcaaatatgttgcgaaaataatccaaataaaataaggaattagaaggaatgcagaccacttattaatttttgaaaatttaatgatgcagagataaacaataaaatctagtaagagaataataataactcctaaccaaaaatagcctttgaaaaaaataatactccaaataaagtttaagataagttgtattccaaaatagaataaagcattttggccctcactccttcgagttttcagcttataaaaaatcaaataggcggaaatggcgataagagcatataatacaggccaaacaatcccaaaaagatagtctggtggagctaggggtgggagtttaagattattataaatccccttaatatcccccgccaagaggccagataggccaccaattagctcaattcctacaataaataatattagttgtcccaatgcttttagttttttactagtcataatttctctccccttcattatgtatgcgttcttttgattactgtacctatattattacataaataatgagttaagctggcttattcgcttgataactttataacttagtataatcatctttaatttgttaaaaaataaaaatgtcactagaaaaatttccagtaacattttataagagttatttttagtcgtttttattatttgtaagggaaaatctgtgagggaattgaaccactcgtattgtagcttttaaggactttatcagcatctcgtttttcttttattacacttacaaatttagcttttgcatcaaatttttgataatcttcatcattaagaatcaatagcttagaagtggcactgtattctcctagaacaatatattttgtacttttaggtttcactgactgtcctttatcatcagttattgttttatcttcctttcctgtccacaaagctggctcagctgataagttttctactgtcttaaatttaaacttatctccttttttggttacattattaaaaactttttcatttattaatttattagcagcttgagtattcaagactaaaacatctgattttgaactgtatttaccttctacagttaaacttttatcaatatattttttattattttctaatatagtatctgcttcatccttattatcactatacatgattataccgtgaacatgagcaaaattttttttgaaaaagtcataaccgagaaatccggtaatggcaattggtactatgataattagcgctattagtattttcttcattctatatctttcctttttttctttttacaatttagctactctttcattctaacatcaagtccgatcccttcttcttacatttttgtaatgaaaaaacgactactaaaaacctcaagaaagacatctttttcttgaggtttgctaatattttttaaataggaagaagggagataataataagcattaaaacacctcccaatacactaaaaaggataatttttctatgtaagagtaatgcaatatattcacgaattaaggccgtaggtaagaaataaagtgctgtgggtgcccctactccttgggcttttaattttactctttgcgcatataaacttcctctgagaacatgataattattggttgaaaaaatgattgaaggggatatttctttatctgaccaatcctcattaattatccttttagaaaataacatattctcataagtagtggtggatttatcttcaaaaagaatttgatgattaggaatgttttgtgattgaaggtattttcgcatggcgaaggcttctgatacaggctcatccgctccctgtccgccactaacaacaaatttggctgtaggatttttctggtaatattcaattcctttgtccaatcgactctttaacaagggtggaacttcttcacttctaacacctgaacccaaaatgataatataatctatctttttttgtaaaggaatcatttggctcatccatgaatataaaatataggctgcaaacaaaaaacagagaattatatcaataagtaaaatataaagaagaatgtaccagattatttgtggtattgtttttgttgaaaatgttaataacataaagagagctggaaaagcaatgagtagatttaagccaaatagagcagataattttgcagtggcacttttaccttctttagttctcattgtttttgagttaaaaatgaaatatccacagaccaataaaaatattaagggaaggattccataagcaatgatcaaggttgcaaaatcacccgacggaagataaagataaataaggtttaataattcaaaaaacagagaggctaggctcaatatcaagcctgaggctagaaaaattcctcctattatacttcgtttattgatttttaatcttagcagaccaattagcatgataatcagggatattattaaaaaagccattcaaactccttgtgtttaatctgttctattatatcatagccttctatcctaatctcttcgtatgtattaaaaaaatcccactattcaaatgtgagatttttgattatcaacccaaatgcataaaaagaattggatattgatttccttgttcgtcaattggatttcttttataaactttaaagcctaaatgctcataaaatcctttggcttgcggattttgctcattcactacaagttcatttaccgaatagttttttattgcttcttcaagcaactttctaccgagtccttttttcatgtgattagggctaataaacaacatttcaagtttctcaccaacaattcccataaaagcaattggtttttcattatcatcaaattccacaattaaatgttcgatagctttaagggcttgcgggacatattgttttatatcttcaatttctttaactgacagaaaagaatgtgtttctttaactgaattttcccataaacttatcaattcttctatgagttctttatttctcatatctttatttatttctttcattttaatcctttcttatttgaaaaacttttttaatagtgaatcaaaatttctaaatagtgattctgaaaatagtgagagtaaggcaaccagaacaaaactatccaaagaaattttgctgatagagaagagggaattgaacatgaaacctgagataattatcccaacaatattaaaaatgataattcccattttaaaacggttgagtggtgcactgattttagttaaaatcataaatccaacaacagctagtaagataactgctgaagttgaaatttctgatgccgtcaatttgaaggcagctccagcaataacgactcctaaaacggccgtaatttcagtcaagctggctggtaatgcttttaagataacatttttaataaaatctttttcaattcgtttgtcattttcttctaaagagagtaagaatcccggaatcccaatggtgaataaactgataagtgaaagttgtgaagcttgtaagggataggtgaagacaaagattgctgagataattgccaagatgattgaaaagagattttttacaagaaaaagaatggctgaacgttggacgttattgacgactcgacgtccttctgtgactacttgtgtcatatgtccaaaatctgaatctaataaaacaacttgcgcaacttgagtcgcggcatcacttccggaagccatggcaatgctacaatcagcacttttcatggctaaaatatcattaacaccatctccggtcattgcgacagtatgatctttacgtttgagggcttgaacgagacggcgtttttggtcaggtgtcacacgtccaaaaacggtatatgattcaaccgcttgatctaaatcttctttcgttttcaataaatttgcatcaatgaaacgttcagccccagtaattcctgctctttttgcaactgcagacacggtttgagggttatcacctgaaataactttgatattgactccttgctctgcaaagtagttaaatgtcgatttagcattttctctgatgggattggctaacacaacatagccaagtgcgtaagcccccaaattaagttggtcataatttttttcttttgttcccgctaaaactaggacacgaaagccttcttctaagagatgattgatttcagagctaattttctcataagttttccctaaaacaatttctggtgctcctaaaagataactttcattttcaaaacaaacagcactatattttacttttgatgaaaatggaataatttttttaacaccggtcatttgattttgaaggtcacctttggcaagcataaactctcgaattgccttcatggtatcattgtcatcagtatttgctgagatgtagtcagataaaagagacataaatttcgcttcgcttatgttactacttgggctaacaaatacttgctcaactgacattctgggttctgtgattgttcctgttttatcgacacatagaacatcaacacgcgctaaagattcaatacttttcatattgtgcaatagcacttgattacgagctaatttcacactactgagggttaaggcaatggttgttaaaagatacaacccctctggaatcattccgataaccgctgccaccattgctacaacactggtttgaagtgtattatgattgacaaagtaattttgggtaaataaaatgactgctatcggaagaataataaagctgacccactttaataatttattgagggcacgtaacatctcagagtcttcaccatggtcaactaatttggcttgttctgttaatttggaaatgtaggaatcttttccgactttttccaaaatgactttggcttctcctgacacaacaaaacttcctgacagaagtttgtcatcaatatttttttcaatttcgtcagcttcacctgttaaaagtgattcattgacaaaaatacttccttcgacaatgcgagcgtcagcgacaatttgatttcctgttttaagaataataatatcttcttcaaccaaatcatctgaagcaattttttcttgttgaccattccttatcactgtggattgcggagcgtgcaggagagtcatttggtccaaatatcgtttggctttgatttcttgataaattccgacaattgtattaataacaattattggaaggaaaatgagctgattccatgcttgaactaaactgattagaatcgcaatgactgcaaatattaagttgaaaaatgtaaaagtatttcgttttacaatttcccaaacaggacgatccgtctcatctatatttttatttatctttccttggcgaatccgttcttcaacctcaaaacttgttaatccttttaaagacatattttttactctctatttcttctcaatttcaattatatagtattttcaagaatactttgttctatcttaacatagttctgagaagtcctgcaaacggtaaaaatgttatttttgattcgttaaacttttttctatttaaatatgataaaatatgctcataatcatatagaaaagagaatttattatgccatatgtccatgttgaactttttgaaggtcgtacagttgagcaaaaagctataattgctaaagaaattactgaatcaatttcaaaacatgctggagcacctacttcagcaattcatgtcatctttaatgaccttccagaaggaatgctctatcaaggcggagaaatgaaaaagaagaaataagttttcatttgagccaatcaaagctgtcagtaattgatggcttttttatttaagctgtcagtaaagttttagtaaataaacttctcttgaaaaaatatttttattaggataaaatgaaagcaactctaaaagaaactggtgaaaaatgaaagttttgattacttctggtggaacaacggaacctattgacaacgttcgtggcatcagtaattttgcaacaggaagtctcggaaaagtgactgctgaaaaatttttaaatgctggtcatgaagtctatttattagctggacttcaggctaaacttcctgaatttactgacagactgacctatattccgattgaaggaactcatgacctttatgaacagatgaaaaacttagtccctgacatggatgttgttatccatagtatggctgtcagtgattatcgtcctatttatatgacaggtcttgaaaattttactgacaagttttctaaagaggagcttttaaattttcgtcctgaaaaagttgggaaaatttcttcaaaatctgattatcaaatcatgctcctagaaaaaacaccaaaaattatttcttatattaaagaatggaatccaaatgttttactttttggttttaaattattggttggtgtagaaaaatctgagcttctttctgtggccagagaaaaattactgacaaatcatgctgattttattttagcgaatgatttagaaaatattcatggaaatgaccatcaagcatttttggtcagtaaaaatcatgaaattactttagaaacaaaggctgaaattgctgacagacttttaaaaacctcggaggaattaaaaaatgactaaaattacacttgcggtaacaggttcaattgcagcttacaaagcagcagatttaacttctttactgacaaaagagggacatgatgtgacagtcttaatgacaagaagtgctactcagttcatcactcctttaactctacaagttttgtccaaaaataaggttcacttggatattatggacgaaaaacgtcctgaattggttaatcatattgatttagctaaaaatactgaacttttccttgttgcacctgcaactgctgatacaattagccgtttggcgcaaggccgagctgatgatattgtcacttctgtagcccttgctcttgaaccttctgtaccaaaatattttgcccctgcaatgaatactaaaatgtatcaacatcctttgacgcaaaaaaacattgagattcttaagaaaatagattataatatgattcaaccgaaaaaatctttgctcgcttgtggagattttggtgagggagcactcgccgacttacctgatattctatcgtatttaaaaaattctttataaaataaatgaggtatttatgaaaaaatcaaaagcatctgatgtggcaatcttagccatttttattgcaattatggtcgttgtccaacttttgagtcaaattatctatagcgtttggcctttaccaatcgttccaactttgctccatattccagtaatcattggttcaattgttcttggagttcgtaaaggagcatttctgggtctagtgatgggattgattagtgttattaatgcaacaatcgtaaccctaccttctagctttatgtttagtcccttacagcctgttcctggaacaaatcatggttctatctgggcattggttattgccatcgttccgcgtgttctagtcggaattcttcctgccctcgtttatcgtttggcacaaaatcgttttggggctggtttagccgcttttgttggaacagcaactaatacacttttggttttaagtttcatcttcctcttctttcatgatgtaaccaaacaaaccttcggagctttgcttgcttcaattatcacaggaaattctattgcagaagtgatcatcgctgtgattttaacaatggcaattgtccctgctttaagtaaagcaagaggcaattcataattgaaaaaaaacaatctatttttattagattgttttttttattaaaaaaatgttataatgtaagcgttgataagaaaaaaataggagaaaacttatgaaaaaaatattaagtttcgacattgacaacacactcaatgaaccaaaaatgccgattttccctgagatggctgaattgttggctactttgtctcaaaaatatatcattgcaccaatttctggtcaaaaatatgatcaatttttgattcaaattattaataatttgcctgaatctgcaaatctggataatttccatttgtttgttgcccaagggactcaatattatgctcacaaagatggcgaatggaaacaggtcttcaattacgctttgactgatgaacaagctaacgcaattatgggtgcacttgaaaaagctgctaaagagcttggacattgggatgaatctgttcttgcccctggtgatgaaattaatgaaaatcgtgaatcgatgattgcttactcagcaatcggtcaaaaagctggtgttgaagctaaacaagcttgggacccagacatgacaaaacgtaatgaaattgctaaattggctagccaatatgctccagaatttgaatttgaagttgctggaacaacaactattaatggttttgttccaggtcaaaataaagaatttgggatgaatcatttgatggaagaacttaatgttactaaagaagaaattctttactttggtgacatgactcaacctggcggaaatgattaccctgttgttcaaatgggaattgaaacaatcactgttcgtgactggaaagaaactgcagctattctaaaagcaattattgcgatggaagaagcttaattttccactgataaaaagctgtcactactgacagcttttttcttttgctgacagaaaatattattgaagattttaaactacagaatggcttttcatcctttagtcctattgaaattcatctgaattttaggtaaaatagatgagtatgtttaatttatagaaggtgaacttatattgaaaaatttgaaaaagaaattaacattgactggtttaatgacagccggattgttattcctatctggctgtgttcaaacacacgttgttgatggagtccgcgttccaaccgaagcagctactcatggaattacctataattttttggttcgtccaatgtctgcttttgttgacttattcgctaataacttgcacatgggttatggttggggaattatttttgttactctgattatccgttttctcatcttgcctttaggtttgaatcaagcctacaaatcaacttatatgcaagaaaaaatggcttatcttgctcctgtatttgctcctttgcaagaacgactcaaaaaagcacaaactcctgaagaaaaaatggcagctcaacaagcattgatggcagcccaaaaagataatggaattaacatgctttcatcaattggttgcttaccaatgttgattcaatggcctttctttatcgctctttataatgcagcggcttatacaacaggaatttcaagttcaacattttatgggattcctttaggacatccaagtgtggtcttggttattatctctggggtgctttacttcatccaaacctggatttcaactttgtcaatgacccctgaacaaaagaaatcaggaatggcaatgttgattatgagtccggcaatgattgttgtcttctcattcatgtcacctgctggagtagcactttactgggcagttggtggttttgttattgttatccaacaaatcatcattaccttcatcatgaaaccaagaatgcgccgtcgtattgatgaagaatttacaaaaaatcctccaaaaatcaataatgaaggcctaaaagatgttacacctacttctgttcaagaaaatttcaaagaaatcacaagtgaacgcaatgaaaaggaacataaatctggcggacgaaatgctggtaaacaaaatcgtaagtaatttttactgacaagatataaaaaaataaaaagtcactgatagaatttctgtcagtgatttttttatttattgaatcaataatttcttgttcagattaaaatgagagttctgtcagtaacttttaagaacttgatgaccttctataagaatcatgtggacattctattgattacggataaaaaactgctaccatcaaatttttctcaccaaaccacttgccctttttcatgattcctcatcggaaaatgcaaataaaaaatctactgacagactcaacaacagtaattcatcaggaaattcatgattcttggctagtaaaatatataaaaaaacactgacagaaattctgtcagtgtttttttatatttgtcttatgttaaatgaacacctttatcaacataaacaatatcaccaatgacacctgaggcaagtgggctaacaaggaaagcggcagtttgaccaacttcatcaattgttacaccaacaccatcagctgtacggctgtcagattctttaatcaaatctttgtaacctgaaactccagaaaccgcaagtgttttaattgctcctgcagaaattccgttcacatgaacacctacatgtgccatttcagcagcaagataacgaactgtagattcaagagctgctttagcaattcccataacattgtagttaggaatggcacgaactgaacccatgtaagtcaaagttacgataccagaaccttttttaagcaatggttttgctgctttagcaacagcaagcaagctgtaagctgaaatatcttgagcaagggcataaccatcgcgagagatatctgtaacattcccaccaagctcttcttttttagagtaagcaatagcatgaacaagtccgtcaattttaccgacacgtgcctcaattgtaccaaaagcacgacgaatagattcatcagaagttacatcacattcaatgagcaaatcttctggttcagccaatttagctaattgtttttccattcgttcattttggtaagtataaattaatgttgcaccttgatctttcattgctttagcacagccccaagcaatagatttattgttagcaacacccatgataacaatttttttaccttctaaaaacataaataaaataagtccttttctttaaaataatcaggtttaagcgactagcaaataaaaaaaaataaatttaatcactttacctttacaagtcatataaaaaagttgacactctcacaagaaattgataatattaattgtaaaaggttttgtatatcaaaatacttgatacataaaattttaacttaaaaatgttgaactgtcaagttagagtgatggctctttttccctgattactcgggcttttcattaatttttaataagaaaaggaataaaaaatgactaaaaaatacgctatgactgctacagaagtgatggaagttattccgaaccgctatcctatcatgtttattgactacgttgatgaaatttctgaaaataaaattgttgcaacgaaaaatgtaacgattaacgaagaagtttttaatggacatttccctggtaatccaactttccctggtgttttgattcttgaatcacttgctcaagcaggttcaattttgattctcaaaaaagaagaatttcaaggaaaaatggcttatattggtggaattgataaagcaaaattccgtcaaaaagtcactcctggtgatgtaatgaaacttgaatttgaaattacaaaattccgtggaaaagtaggaactgctgatgccgcagcttatgttgatggtaaaaaagtaaccacttgtcagttcactttcatcgttgatgaagcagctgaacaaacaaactaaaaaaaatttactgacagtctttgtcagtaaatttttttattatatacaggatttgtcagtaaatatcttaactctcctgcatttttttaataaaggattgtaaaatttcaatatgttcttccaacttttcaagaataatagattcatttgcaatgtggcattgttcatgctgtcctggtccaaaaacaaccgttctaatcccaacattttcaaaaaatccttgatcattagaacccgaagccgccgttgttttcgcgccagataagtctgtcagtaactgaatgaatggagcatgattatcggtcaaagttgataaaacaggtgtcacaatatcttcataagtaaaatgatactgcacagctaacttactcatgacttgctcaaatacctcttccaattcaggagttaaacgacagtcaaccacaagttcagcgaagtcggctgttttattaggagaattttcatccccagagagaattgatgtcactacaaaagttggctgaccaagctgactatttttataaattttcaagtcttcaacgatttgctcaatattttctagaaaataagtaaccgcccctaaagcgctttgctgaaaatgttcttgtacagaagcatgaccagccttcccagaaaaatgtagcttcataaaatgatttccacgttgcccaatataaatcttctctaaatcagttggttctgcaataatgcaacaagctgagtcatagctccaattttcactaaaataacgagcaaaatcttctgaacccttaccatcaagttcttcgttagccgtccccacgacccaaatatcttgacttaaatctttaccaataaaacttgcagcagcaagtaagtttccaacatcgccacctttcatatcactcgcaccaagtccaaagagttttccctcttctactcttgcatcggtaggcaaaaatttccagtcagctaaatgacctgaaacgacagtatcaacatgcccagttaagataatggcttcttttttttgttcttttttaccttttgctttaatttgtccggcgacaaaagtttctttgcgaataacaaaatcaaattgcttctcaataaaccatttttcaagaaatattaaaatctcttcttcatttcctgaacttgacggaatattaaccaaactttttaataagtctacagctttttccataaattcccaccaaactatttattattttcagaaagcgtgtagttcttttgaatatctttattaatttgtccattcttcaattcttctttaatgacagaattgacaacctttgttaattcatctgaacctttaggaagtgcaaccgctgaaccataactatcttttggcgtttttacgtccacattagcaatcgctaaatctgaattagctgcgacgtaactcttagcaataaggttttcaatcacggctccttgaacttgtccccctttgacttcattgatttcatcgccaatttgtggcaaggcaatctctgttgctcctttgaattgactggttacaatcccttcttgagttgaccctttttgtgccgctacttttttacctttgaaatcatctactgaactatatttacttaaatcagattttttcacaactaaataattacttgctgtataatatacatctgagaaattgacagatttttcacgactaggttcttttgaaattcccgaaatcgcaatatctgcttttcctgtatttaaactagctaaaacattgttaaagtccatgctttcaattttcactttaacccctagttttttaccaatagcattggccaaatcaacatcagaacccacgactgtattcttaccatctttaataatttggaattcaaagggtggataatctggagataaagcaactttcaatacgccggctttttttactttatccacttgattagtagccgattttccatttccacaagctgctaatgttgctactgcggccaaaccgaccattcccaatgctaattttttcatcttcttgttcatccttaaacctcttttataaatagaataagtataattatacattttaaaattattttgtcaagaatttttgcatatttatattataattatttaaaaaacaaagatttttagataaaaactgtacttttatacttgagacaaaataaaaattcactcaatgagtgaatttttattaattgttaatcaatccattgcacgtaattctaataccatatcacgtaactgagcagctccttcaaagtcgagggcgctagccgcttgttgcatttctttttcaagttttttgactaatgctttacgttctttcttagtcatcgcacttgcatcaacttcttcaatctcaccagaatcagttttcttagtaatggcaatcaaatcacgaatttcttttttgatcgtttgaggtgtgattccatgttcttcattataagccatttgaatttcacgccgacgggctgtttcatccatcgcatgtttcattgaacgcgttattttatacttttgaccctcgtattctgtataataaccactatctaagatttctttatccgcaggatcattttcatcaagggctttagccatatcagaataaagaataacgtgcccttcactattacgtgccgcacgaccgatggtctgaatcaaaccacgttcattacgtaaaaatccttctttatcagcatccaaaatcgccactaaagaaacttctggcacatctatcccttcacgcagcaaattaattcccaccagaacatcaaagactcctaaacgcaaatcccgaataatttcggttcgttctaatgttttgatatccgagtgcatatatttaacttttatccccatttccttaaaataggcagttaaatcttctgacatctttttagtcaaagtcgtgacgaatactcgttcatttttctcagctcgtttatgaatttcaccaactaaatcatcgatttgtcccatcattggtcgaacttctacgacaggatctaatagacctgttggacgaataatttgttcaacaatggtatcggtctgctccatctcataatccccaggggttgctgaaacataaacaatttgatgcacatgactttcaaattcttctctttttaaaggacggttatcgagggctgaaggcaggcggaatccataattacaaagcatttctttacgggctctgtcaccattatacattccttttacttgccccatggtcatgtgtgattcatcaatcataatcatgaaatcatcaggaaagaaatcaagcaaagtatacggaggttcgccttcctcacgcccgtccatatgacgtgaatagttttcgaccccattacaataacccatttcacggagcatttcgatatcgtagttggttctttgttctaaacgttgagcctcaagaagttttccttctgagcggaaaacttttaattgttcttctaattctgcttctatcttggcaattgattcttccatacggtcatcatttgtcatgaaatgtgtcgctgggaaaattgccaaatggtctacttcacctaaaacttgtccggtcaaaacttcaatttcacggatacggtcaatttcatcaccgaaaaattcaacacgaaaggcatgctcatcacgagaggctggaaaaacttctacaacatccccgcgaactcggaaacagccccgttgaaagtcaatatcatttcgctcaaattgaattcctaccaaatcatttaaaagttggtcacgagaaatttcttgacctgggcgcaatgaaaccaccgaatcttgatactctttgggtgaacccaaaccataaatacaagaaactgaggccacaacaatcacatcattacgttccaataagcttgaggtcgcactgtgacgcaatttgtcaatttcatcattgaccgaactgtctttttcaatataggtgtcagaacttggaacataggcttcgggttgataataatcataataggatacgaaatactcgactgcattatttggaaaaaattctttaaattcactgtataattgaccagccagtgttttattatgagccataacaagagtaggtttacctgtccgtgcaatcacttgactcatggtgtaagttttccctgttcctgttgctccacgtaaaatttgagctttttccccattctcaatattatctactaactcagcaatcgcctcaccttggtcaccggctggctcatattttgaaacaagttcaaatttattatctgttattctttctatagccattctttttcctttaattcttttctattatctttgaaaaataatctaatgcttgatgataaacatcatttttaaagccaaaatccattttacgaatttcagaaagtcctaaaaattgataagttgaaaattcaatttcttcaggatggctttcaagattaatttttgcttcttcatgcaatcggacaagaaaataatgttgttcttgcccagcataagtccaagttggaaatttcatctctttaggaaaatcatattttaaagttcctggatattgtccaatgatttcaaactcttttgtcccaatttcttctgagagttctcgaataatggctgtctctggtttttcaccagcttcaattccaccttgtgggaagccccagctcatcccgtctgctcgtttacctagccaaattttgttttctttattgagaataatggctgcaacattttgtctgtattctttcatttttatcctctttttagtattaggtttactgaattctatagatgtaaaatttgtcttattattaatcttctaatacaattttaccattttcatcgctaaaaatatgctataattaatctatattcaaaaaaagataaggaagttttattaataatgaatcgtgatgaaattcaagcaaatttaatcaaagcaagtcacatgattagcatggacgatattattcgtgaaggttatccaactttacgtgaagtggcaaatgatgtaaccttgccattgtcagatgaagacattatcttaggagaaaaaatgttgcaattcttgcataattctcaagatcctgtcatggctgaaaaaatggggctccgtggtggagttggacttgcagcaaaccaacttggcttgctcaaaaaagtcatcgccgttttgattccaaatgaacctgaagttgatgaagatggaaatgaaattccacctaaagaagcttacaaaatgcgtgaaatcatgtataatgcaaaagtggttagtcactctgttcaagatgcggctgttgaaggcggcgaaggttgtctttctgttgaccgtgaagttccaggttacgtcgttcgccatgctcgtgtaactgtggaatactacaacaaggaaggcgaaaagaaaaaaattcgcttaaaagatttcccagcaatttgtgttcaacatgagattgatcacactaatggtgttatgttctatgaccacatcaatatgaatgacccttgggaaattaaagacggtatgattattgttaaataatcgccaaatttactgatgaatttatgaatagaaaaattactgacagaatttccgtcagtaattttttatttcattttctactttttaattcttgtcagtaaaagttactgacaagtttttagaaaatgataaaggtaaattattatttagcaatttttgcaaaatattcaagagtacgaatcaattgagcagtgaaactcatttcattatcataccaagcagctgttttaactaattgtccaccgtcttttaggtcagtcacttcagttaatgtagcatcaaaaagtgaaccgtaagccataccgataatatcagatgaaacaatttcatcaacattatagccaaagctttcatcagcggcagctttcattgcttcattgatttcgtcaactgtaacatgtttttcaagtacagtgacaagttcggtaattgagcctgttggagttgaaacacgttgagcatgacctttcatcaaaccagaaagttcaggcaaaacaagaccaattgctttagccgctccacttgatgctggaacaatgttttcggcagcagcacgcgcacgacggaagtctccaccacgatgtggaccatcaagggtcatttggtcaccagtataagagtgaacggtagtcattgttccacctttaacaccaaagtttttatttaaggcatccgccattggtgctaaactatttgtagtacaagaaccggcagaaataactgtttcagttccatcaagaattgtgtggtttgtattgaagacaacagttttaacattatttccaccaggtgctgtaatcaaaactttcttagctccaccaggatgcaaatgtttttcagctttttctttagtcgcaaagaaacctgtggcttcaagcacaatttcaacaccagaatcagcccattgaatgtcttctgggttacgttcagccgtaactttcacaaattttccgttgacatcaaaaccatcttctttgacttcaacagtccctttaaaacgtccttgagttgtatcatattttagcaaatgtgcaagcattgctgggtctgtcaaatcgttgatatgcgcaacttcaactccttcgacttcttgaattcgacgtaatgccaaacgtccaatacgaccaaaaccgttaataccaactttaactaccatgatgtagtcctccgtttttttatttagatgatgagattcttctctttttttgctataatagaaataaataattatagctattagagatatctcttatctctaatataaatgatactacttttttaccctagtgtcaatcttttttaatttaaaatgtttaaggagcttcatcatgaaattatcatctggttgggaacaatctgtttatgtattacttattttggcaagacttcctgaaaatcggaccatgtcatcaattgcacttgccaatcgtctcaaagtttcgccttcatatctcaaaaaaattattaaatctttagttgatgagggacttttacgctctactccaggaaaaaatggcggtttttcactcaataaagaccttcacgatattagtttttacgatgtctttttggccatcgaaggacggggtcgaatttttcaaagtcaaggtcttttgcaaaattttattggttcagagtctggcaaagcaaagcgttgtgccattacaagcgctcttgatgaaattgaaaatacccttgtcagaacactatcaaatgtttcactagcccaagttgctgacgaaactcaatataattataatcttggttatcttgatgaatggattgatgaaatggattaaagaatttactgacagagctgcaattcattacgaacaatgaagttacaaatagaaaaattactgacgagatttacgtcagttcaatgcgaccaaggggagcattgaagttggggatagaaaaaattgctgacaagattcatgtcagttcaatgcgactgcagggagcattaaagttgtagatagaaaaattgctgacaagattcatgtcagcaatttttcattatttctttatttcattgtttcattattttattttttctgtcactaaaaattttactgacagaactattttattcagcaggaacttcttcatcagtcgtttctgctgcttcttgagcttgattagagataacaattttatcatcaatcaaatcagcaaccaattctttgtattcagggtgttcaatatagaagtcagcaattgaatcttcgatattttcttgaattgttctacgaagtggtcttgcacccattgctggattgtaacctaaatcaactaatttttcttttgctgcttgagtgacactaagatgaatatcattacgtccaatttgttcgttgacttcatcaagcatcaaatcaacaattttaaggagattttctttgctcaaagcagagaattcaattattccgtcaaaacggttcatgaattcagggctaaagaaatcgccaagttgaccaagcactgatttagttcgtccctcacgagcagcaccaaatccgacagaggcttcaactttaccagttccggcattagaagtcataataatcaaactatctttaaaggatactgtccgtccttgtgcgtctgtcagacgtccatcttcaagaatttgtaagaacatgtgcatcacatctggatgtgctttttcgatttcatctaataaaatcaaactgtaaggattacgacgaacacgttcagtcaattgaccagcttcttcataacccacatatcctggaggggctccaatcaatttggccaccgaatgtttttccatgtattccgacatgtcaaaacgaatcatactttcgcttgagccaaataattctttagccaattgtttagcaagttctgttttaccaacacctgttggaccaacgaaaaggaaagaaccaattggacgattaggtttaccaagtcccacacgagaacgacggatagctttagcaatcttatccactgcttcatcctgaccaatcacatgtgctttcaaatcatcagccaaattaatcaattgtgtttgttctttttctttcaaatcaccaactggaatatgtgttttttgctcaacaatttgttcaatatctttttcagtgatgacaggaatttcatcatctgaaacttcatgattttgtaattcacgaagtttggtgatttggtcacggaaatgagcggctttttcaaaatcttcagcctgtgttgcttcatttttcttcgtttctgcatccgcaatccgacgattaatatcttcaggatcaacaaatttcaaggttagatttttcttagaaccagactcatccaaaaggtcaatggctttatctggtaagaaacggtcttgaatgtaacgatttgacaaatgagcggctgcttcaatagcctcatcagtgtatttcacgtgatgataatcttcataacgtgcttgaatgcctcgcaaaatagtaattgtttcatcaactgatggttcatcgactttaactggttgcatccgacgttcaagcgcagcatctttttcaatgatgcgatattcattgagcgttgttgctccgaccaattgaagctcaccacgcgcaagcgcaggttttaggatatttcctgcatccatattgccatcaccggcagaaccagcaccaacaatttcatgaatttcatcaataaacataatcacatcattacgttttctgatttcatccattaatttttgcatccgttcttcaaattgtccacgaattcctgttccttgaacaagagaaacaacatcaagacgaatcacttctttattttgtagtttttgcggcacatctccgtccacaattttttgcgctaaaccttcaacaactgctgttttaccaacaccaggttcaccaattaatacaggattattcttagtcctacgatttaaaatctcaatgacacgtttaatttcttcatcacgcccaatcactgggtcaatttcgccacgacgagctgactctgtgatgttaattccaaattcttctaacattcctttaggttgttttgcccgaggattttgtggaccgcgcggaccacgtccacctgtttgtgttggtggagtttgagtgcttgctgctccattaaaatcttgaccgtgcaaagcactaaagatatcattaaatggattaaatggttcatcagaatttccatttgaggcatttcctgcgccaaataaagcttcttgaccgccagatttcataatttgataacagttttggcacaaatcaatttgttttttctgaccatttacacttgtgtaaaggtgaatcgtcgcttcattaatattacaattttgacaaagcatcgctttcctcctcttaattctcagtaattaattttaaactaatttctcttcacggtttggaaggagttaatctaaaatcaggaccaacttcgatgtaaagttttttatatttgaaattttttgtggtgatgactagaactcgctcattatttcggacatcccaaaactcattttcaccgttttctctgaaccaaccgccatagtaccaagcgttagttcctgctacttttttatagaattttggttttttcatatcagatacaagttgaacagattccaaattttccgggtcaatcttgatatgttttcttaaagaaagaacttttcttgcccctctaagttcaatatcaatgccaccattttttccaaaatagacagtagtcgtcattttctctccttatttataatttaagtgataacggttactttcattttacatcaaatttaaaaaatcaataaatcatttctcccttttaaaataaaaagtttgaccatatttgaccattgataaatttattataatcattttaggaaaatttagcaagtcttttgaactttataaataaatttttaataaaaaatactgacaaagctgtcagtagagccaaaatataatataaaaaatttagcttttccttctaggtttgtcagtaatttttttattttgtcagttagcctgcatcatcaattttcttatataatcaattttgatgaaccaagatataaattgaagcaagaatggcaatgccggcaaaaatataaacaatgatatttcctgctgaccagccatatgcttgaacaagccaaccaataaccagagtagctgtcacttcaccaataatgtactgacagaaccccatcgtacccgttgacattccattggcaaattttgggacagcttcattgaccatcagcccgacaatcgttgctggagcataaatgaaagttcccataattaataacacaataataatcaaagtatgattggtcgctgcaaaataagtaatcagacaggcaagcatggcaatcaatgaaaccaaaaccataatggcccgacggcctttaagtaaatcagtgataaatccgatgataataaccccaggtacagctgcaagttcaaaaattcctgtcagccattttgctgttgaattatcaaatcctttgacattaaccagatagtttggaatccaactcataattccataacgaacgacatagattgacaatgaggtcaaaatgaccgcccacacgagtttatttttgacaatgtattcaaaaaatattttaaaaacattgtcattagaaacatcgccttcaacaatttctccgtctttaatgaccactttatcgccagaatattcttcaattgtcggtaatcctttcgtcgttggacggtcagaacccagaaataaaacgataatagcaatggcaatcgaaacaattgatgctgtccaaaaactccattgaagcgaagcgccgaaaaagaaagcagataaattaatgacagccacacacatgaaagctccagcattatgagctgatgaccagattgaaaatgatgtcccacgcgccataatcgaaccttttgctttgcggccaaaccataaaccgactaaacgctgacaagccgcagctcccataccttgcataaccgagttaagtaacatcaaaaagacaatcaacccaaaactttgagttgttccataaagcgcattgataatcgctgacacaatcaatcctgttgccacataacggtttggattggcacggtcagctaaagtccccataatcagctttgaaattccatagccaatcccaaacatggagagaattgtcccaatttgtcccatcgaaaaaccataagccttggaaatatcattttgttgaactgtaaaaatcaatcgaataatataataaccaatataaacgattgccgtcgaaattaaaactcgagtttgccacattttatacaaacggggaactttttcctctgatattttttgctccgcatctggagcgggttttaagaatccaaacattttgaatcccctttcattttgatgaattaattataacccactcctatttgaaataaattcctgattaagccataatttcaggaatttatttttaaatcaaaaaaatttactgacagaatataatcgtcagcttacattacaatctgtcagtaaatctctagcactcaaacaattgcaccgtattctttatactgtttgtaaagttggattaaaaggtgaataattaattctaaggggagcatattattataatcaacaaggattttccctgacaggttcttttgataagcaagcaaaagcaaatcactttgttcaaccagcctactcttatagttaccagtaatagctaaaaccttttttccatctcttttggccttctgtgctgttgccacaatcaaatctgtttcacctgataaactaagaccaattacaaatgtatttctaggcaatttttcaagatatgcttgcatattatcttgatataagctgacagctttaacatctaaaaattgcaaatctctcgcaaatgagtcagctatccgaacagataatcctcttgaaataatcacgactgaagctgcatgaaaaatattttcaacaactttagctaagttttcactctctagcagccttactgtcattaataattcttcaatattttcagagacaacttgatttgcatcttttgtcagcccataaatccaatcatgtctatttaatttttgtttttccatatttttgtattcagaaaaaccagaaaaattttgctttttcaaagttcgaataattgatgaaggactgacatgggcagattcagcaatttgagcaaccgtcatttgaattatttttgctttattttcttctaaataattccaaatataaatttcgacactagttaaatggttcataaaactcttctgaataaaaaataattttatataatacaaactgaatcataatacatactatctctaaaaaaatataaaaaaacttactgacagtttcatcagtaagtttttaaattacataaagtcacgcaacggtttagaacgacgtgggtgacgaagttttttgattgcttttgcttcaatctgacgaatacgttcacgtgtcactttgaattgtttaccaacatcttccaaagtatgcatgcgtccatcatcaagaccaaaacgcattctcaaaacattttcttcacggtcagtcaaagtgtccataacttcatctaactgttcacgtaaaagaatacggtttgtataatcaacaggtgattcgattacatcatcctcaatgaagtcaccaagatgtgaatcatcttcttcaccaataggtgtttcgagtgagactggttcttgagcaattttcagaacttcacgaactttatctggcgccatgtgcaactctttaccaatttcttctggtgaagggtcgcgtccgagttcttgcaaaagattacgttgaacacgaatcaatttattgattgtttcaaccatatgcactggaatacgaatcgtgcgggcttggtcagcaatcgcacgtgtaattgcttggcgaatccaccatgtggcataagtcgagaacttgaatccttttgtatggtcaaatttatccacagccttcatcaaacccatatttccttcttgaatcaagtccaaaaattgcattccacgtccagaataacgttttgcaattgaaacaaccaaacgcaagttggcttcggcaagcatttgtttcgcaaattctgccccttcaccaccagcaataattgcttcagcaagttttgtttcttcatcaagagaaatcaatggataacgaccgatttctttaagatacatgcgaacaggatcatcgatacgaacattcgtaacaatttcatccattgcagtatctgaaacttcttctttttcaatttcatcagtgacaagagccaaaggacttggatttccatctttatccacaattgaaattcctgcatcttgaatttgtttaaacaaatcttcaagtgcgtcatcaacaatcccaaatttaacagaaagttcatccatgatttcttcatcaagcgcttcacccaaaggtttacgtttggtaatatagcttttaactgctttttcataagcttttacgttaaaagtatcaccattttctttgacttcaactcttgctaatgttttaggactatccatcttttcaacaacaacaggtttaacatttaatgcttcaagaagacgacgttcttcaccaggtccaactgaacttgaatgtgattttacaagtaagccaatttcttgagccttctcaaccaaaacacggttttgaacgccagtttcttttgaaatttgacttattctttttttatttgctgccaattcgctcctcctctttgggtaaaactactgacaaaactgtcattaaatagactagccaattgtcagtaaaaaattatcataattttttcttttggttaataatctgaagggttaactctaagacacgttctttgtttcctgctttctcagcagttgccaactgttgaatgagttcttcaaattttatttgttccatttcattagaaaaaatggaaactaagtcattgatttcctgacttgatgctgtatcaggcaaatctaaacttataatctggtaaaacagactacgttcttcgtctgacagctcacttgctaagtgtgattcatcaatttgttcataaaccattgcttcaagcaagattttatcaaataaatcttgataacgtttatggacgaatctaaaattttcatcttgagaaaattttttcaaaactgatgaatgataaatcattcgatggagtagcatttcttcggctttttccgaacgtgacaacttaggaacttgaacagatggttgaacaacttgagccgattcacttcttctgtaagtttgttgagttttaacattattctcataataagcctcctcaaaatctacaggcatgaccgattcaagactagaataatcattttcgtcagtaaaactttcggtcaaacttgaagcatctaaattactgacaggatggtcagtaattgtcatattttcacgccgtaaatttacagcctgctccacttgattatactcgaaatcaggcaaaatctcaactaattttcttatataggcatcctgagccgtaatcgatggaagctttgcaatcattggtgaaatctgttcaataaaatcaagttgcgtttgtaaattagcaaggttttcaggtctcaaataatcaattaaaaattcaatgggttgaatacgccccgtttccattaaggcagataatcccttcaaaccataatttttagaatactcatctggatcaagtccttctggaacctttacaatctgcacagcagattcaccaatcaaatcaatggccttataaattgcattttgcccagccgaatccccgtcatatactaatacgaatttttttgccatttgtttcaaacggcggacgtgtttttcggttaatgccgtccccattgaggcaacaacattattgattccagctttataagccgcaataacatccataaaaccttccattaaataaacttcatgctgcttagaaattgttggttttgctttatctaaattccaaagttcataagatttatcaaatatagttgttgctgaagtattaatatatttggctttagagtcatcgttttcctgccatttacgtccagaaaaaccaattgtatgtccatattcgttggtgattggaaacatgattcgattcgtaaaagcatcaaacactttattatttgagaaatgaaataaaccagactttgccataatttcttcatcaaacttatttgataaatttttaaaaataaaatcattttcttcaggagctaaaccaatattaaatctcttgattacatcatcagtaatcccccgctcctcaagatatttcctagcccgttcacccaactccgttgacatcaatagaatattgtataaacgaccagcctggttattgatttcaaacaatggagcatttggattatttttttcttctctatcatcagaaatgttaagagtaactcctgcaaaatcagccagttccttaacagcatcaacgaatccaacctgattgtattcttttaaaaactcaatcgcatccccagagcgcccacagccaaaacaatgataaaaacctttttcagcatttacattaaaggaaggagttttctcaccatgaaaagggcataaaccaatataattcttacctgtacgacttaaagcaacatactgtgaaattaaatcagcaatattaacttttgactttaaatcattaacaacctcagtgtcaagtgaaaccataattttccccttcttccctacgattaatcataaaagtaatctcataaaataagtataacacttcagaaaggttcttaatcatcattcattttctaaaataaatataacttacgaaatcttactgattttatggctttaaagtctaaaagacgcctattaaagaatagacgtcgaacaaaggggggtaagggattcgaaccctcgcgccggtttcccgacctaacgatttagcaaaccgtcctcttcagcctcttgagtaaccccccataggcttattaacaatgaatagatacattacatatccattatgggaattccaggattcgaacctgggacccctgcgttatcaacacagtgctctaaccaactgagctaaactcccaatttattgttttcaattgaaaactaagcggatgacgagaatcgaactcgcgtagccagcttggaaggctggggttctaccattaaactacatccgctaacaaagaatggcgcgagacggaatcgaaccgccgacacatggagcttcaatccattgctctaccaactgagctaccgagccaaagatatggatcttgctggattcgaaccagcgaccgatcggttatgagccgatagctctaaccaactgagctaaagatccagctgataaatatagcggcgaaggggatcgaacccccgacctctcgggtatgaaccgaacgctctagccagctgagctacaccgccatttttgacataagtcaaattgatgtaaaaacatcaatcgggaagacaggattcgaacctgcgacaccttggtcccaaaccaagtactctaccaagctgagctacttcccgttatatgcaagcggtaggattcgaacctacaaccgcctgattcgtagtcaggtactctatccagttgagccacgcctgcaaataacatttttataaataactagtaataatactagttaaatacattaatattcaattcttggtaaatttagttttctttgttctgaaatgattctgatgagaacgataaagatgacagaaataaataaagctaagttatggctgattaccgattgaagggatacatatagaattccaccaataatacatggtagggcatagatgttttctctaaaaatcattggaacttgatttgcaatcacatcgcgtatcattccaccaccgacacctgtcaatactcctaagaatacaatgaagaagatattttgtgaataaccatgtgctattccagcatcaatccctaatactgtaaaaattcctaaacctattgcgtcagaaaccaggagaagattattatagaaacgtgctgctttaaaaatactcaatgcttctcttcttgatttaattattagtgctacaagcatagctactattgatgcaataatcgaaataactataaaaaatggcgattttaatgctgtaggcggtgttgctcctaagagtaaatctcgaaatatcccaccaccaacagctgttattactgacatcacaagaatcccaaaaatatctagtttatgattgatccccactacggtccccgaaatagcgaatgctacggttcctaaaatttccaaaaataaataaaaactgctaatcacttccatatccctttatacttcaccttaataatctttttaatacaatttattataccttataatcctccaatataaataaaaaagagactgattttcaacagtctctttttctttaatcaacgcggctaaaattagcaacatctgcactgatattttcaataaattcttcaagcggaatgacttttgtttcttttgagccataacgacgaatatttacagttccatcagcttgttcttggtctccaataacgatttgatatggaattttgtgtgtttgtgattgacgaatcttccagcccattttttcattggcttcatcgacaacaacgcggaaccctttatcttgaagttcacgttgaattttccatgcgtaatcggcatgaatttcattatttactgggataatggttgcttgagttggagcgagccatgttgggaaagcacctttataaacttcaataagataggcaatgaaacgttcaagggttgagattacaccacggtgaatcatgactgggcgatgtttttccccgtcagcaccgatatatgaaatgtcaaagttttcaggattaaggaagtctaactgaatagttgaaagtgtttcttcgttaccaagtgcagttttaacttgaatgtcaagtttaggaccgtaaaatgctgcttctccttctgcttcaacgtagtcaagattcatgtcatccattgtcgctttgagcatggcttgagatttttcccacatttcatcatctgggaaatatttcactgtatctttagggtcacggtaactgagtcggaaactgtaatcattgattccaaagtcacggtacatgtccataatcaattgaagaattttactaaattcttcttgaacttgttctaacatgacgaaagtatgaccatcattcaaagtcatttcgcggacacgttgaagtcctgagagtgctcctgatttttcataacggtgcatcatcccaaattcagcaatacgaattgggagttcacgataagagtgaacgtgatgtttatagatagctatatggctcggacagttcattggacgaagttccatttcttcgccatcacccatatccattggtggatacatatcttcatggtaatgttgccagtgacctgattgtttataagtattaaggttcatcatgactggtgtgataacgtgttgataaccgtttttcacttcttggtcaacgacaaaacgttcaataattcgacgaattgttgctccagctgggagccagtaagcagttcccgcaccaagttctgcgtcattaaagaacaagtcaagttcgcgaccgagtttacggtggtcacgttcttttgcttcttcacgaagtttaagattttcttctaattcttcttttgtaaaccaagctgtaccgtaaatacgttgcatcatcttgttatcagaattaccgcgccagtaagcacctgcaacgttgagaaggtggaaaaatttgatgacaccagttgatggaacgtgtgggccgcggcaaaggtcagtatattcaccttgagtatagatagtaagtccaccttcatcttcattgtgttcttcaatgagttcaagtttgtatggatcatttgcaaaaatttcttttgcttcttctttgcttacttctttacgttctgatttgaagttttctttgacaattttcttcatttcagcttcgattgttgccaaatcatcatttgaaatttgaccggcttcgttatctgtatcgtaatagaacccatcttgaatagctggtccaacacccaagtgaatatcagggaaatggcgttttgctgcttgagcaaaaaggtgagcagctgaatgtcgtaaaattccaagtgcatcttcatggtctggtgttacaatttcaaagttgctatcttcattgattgctcgagtggcatcaattaattttccgttgaccttacctgcaagtgtttttttggcaagactaggtgagattgatttagcaatttcaaatgttgttacgcccgcctcaaattcttttacgttaccgtctggaaatgttattttaatcattttatgtgcctttctttaatgtttttttagttggaaattactgacagaaaaatccgaattgcttgggagcaatgaattacttgttaaaagtcttgtcaataatttatggaaataaaaaaacgcaaatcttatcctataaaggacgcgatctgcgtgttaccacctttgttctatttactgacaaaattcgttaagctcttgctagcaattattgcttacaaaagtactcaatttttagctataaaattgctgtcagtaaatttctcttctttgacgtaacgtgtcagagacgcttttctgttgtccaaaaaagaatttaacttacaaaaaatctgtaagtagtgagtggtatttttagctgccattttcaggctcgcatcaaccgcctgatttcttagaaattttcactaaaaacatgtctcttcttatattgtaaagcttgacctaaaatttgtcaagaaggaaattatactaaataaaattactgacagcccaagattaaaagttctgtcagtaatttttactgacgagtaaaaaagaactcaatgagttctttttatattaatgtctttgctcaatattttgctttgttttgtaagcaagaaaatcgcgtgccacatctttatcaaaatcattgagttgttttatcacttggttttgaatcgtttcaatctcaattttttcaaaagagagctcagcaattactttttcaacgacttttgttacattattagcaatcatattggcgtggagcggtttatctttgtatttaccattgattgcagctttgaatactgccgtttgaatgcggaagctatcccagtcaacgacatgtccattacgtttgataactactttattaactaattttgcttgcatcaatttctccttattttttaatcttcttacaatactattataccaaatttttcggaattatttaaaagtttcgacgattaatacgatattgagtaaagttacaaaaactcctgttgctaataagagccactttgtaaaccaaacatttttatatttgcccattacccttttagaacttgtcaaataaatttgcaaaaagatagtaattggtaattggatacttaagaaaacctgtgaataaattaaaatattaaagggcgaagtcacaaaacttaaagcgcaaatagcaatcgttgctccaattattgtgattaaaacacctaatttactatgtgggtcttgtgcatcataaggttctgcaaagattcctgcaaaaattgacccacctgccattccggctgttaccgatgaggctactcctgcaaaaagaaaagcaatcgcaaaaataattgcagccactggaccaaggagaggaacgagcatttcttgtgcttgattaatttctgttacaattcgagggaaaaataaagccgcagcaatgataataattgcagaattaatcacccaacctagaaacattgaaaaaattgtatcaaagaactcaaaacgcaattgtctttccatcaccgcttcatcttttaaattccactgacgactttgaataacttccgagtgtaaaaatagattatgtggcatgacaacggcccctagggctgacatgatgattggcattgattttgcatcaacaaaaggaatgaccattccttttgctgcttttccccaattaatatgtggaataataaaaatttctagtaaaagtgcaatcccaatcaaacttacaaaaccaataataactttttcaattttaggatatgaattactaaacaaaaaccagataaccaaaccagctgttaaaattgctcctaccacaattggtaatttaaagagcatttgcaaagctattgctccacccaaaatttcagcaactgctgtcgaaatagaagctaaaactcccgttaccaaaactgttctactgagccagggtctaaggtattgggtcgcattttctgacaaacactttcctgtgacaatccctaagtgggccacattatgctggagaaaagccaacataattgttgatagcgtaattacccaaagtaatttataaccaaattgagaacccgcagcaagattggcagcccaatttcctggatctataaatcccaccgcaacaatcaatcctggtccaacatacttcaaaaaatcaagggctggatattttttatcttgtaaaaatcgccacatttttatccttttcattttcacttccttttggacaattatagcatgcagcttttaagagttcaactttacaaaataaaaaaccgtcagtaaattttactgacggtcattataaataattgattatttggcaacgatgaaacggtctgcatcatccatgaatgttttttcgccggcaggtgcttcgattgaaccaaatacaagttgtccacgaagtttccagctttctggaatattccattctttagcaacagcttcgtcaatcaatggattgtagtgttgcaagttagcgcctaaaccaagttcagcaagagcagtccatacatttacagaaataattcctgaaccttgttctgaccaaactgggaagttatctgcataaagagcaaattgttcttgaagatttttaacaactgcttggtcttcaaagaaaagaattgtaccaaaagcagctttaaatccatcaagttttgcacgtgtgttatcccaagctgattcaggaacaccttgtgcttccatggctgctttaagttctggggcaacaatttcatcccaaagtttatcttgggcatcacctgtgagaatcaaaagacgtccagtttgtgaattgaaagctgttggtgaaaaacgtacagcttctttaattgtttcaatcactttttcttcatcttgaacgtttcttccaagagcgtagattgtgcgacggttttctaatgatttaatgaatgacataataattacttccttttttatttttattgtttacatatgtaatcttatcaaataaatttacacttgtaaactattttgattcaaaaaattactttttttataaaataaaaaaaatccctatttgaaatagggataaatttattatttagtaccgaacaaacggtctccagcatcaccaagacctgggacaatataaccatgttcattaagtttttcatccaaagctgcagtataaatttcaatatctggatgtgcttcttggagagctttcactccctctggtgcagcaacaagacaaacaaatttaatattttctgctttagcatttcgttttttaagagaatcaactgctaaaattgctgaaccaccagtcgcaagcattgggtcaacaagaaaaatttgacggtcagcaatatcggctggaagtttaactaaatattcaactggtttaagtgtttcttcgtcacgatacattccgatatgccctacacgagcagctggaatcaatttcaaaattccgtctaccatcccaataccagcacgcaagattggtacaatcgctaattttttacctgcgatttgtttaaccgtcgttttttgaacgggtgtttcgatttcgacatcttcaaggggtaaatctcttgatacttcgtaggccatgagcattccaatttcatcaacaagttcacggaattcttttgtcgatgcctctttacgacgcaagattgagagtttgtgttgaatcaatggatgttctacgacttgaaattttgacattttgattttcctttcgctagatccctttgctaagcaaagttcagatttgtaaactgcctttaaaaggcaattttgctaattttaggcaaaattttttagagcctagcaagttcgctattctctaaaagcattttttctattttaccacttttttgatctttttgggaggaataagatgaaatttaaaaaaatttaaatttttcgtcttttattctttattttttcttaattatcatattttttcaggaccattttaattaaaaatggtgccaatacagttgctaaaataatcacgataaccagctccgaataaacttcatctgtgataatggcactcgtcagaccaatttgagccacaatcagagccatttcccctcgtgaaatcattcctgttccaatcaacatactctcaccagtacttaatttacttgcttttccaacaaaataggcggggataaattttgtcaaaatcgctaagaaggtaaagagtaaaattatccaaggatgatgaattaaactatcgaattgaacagatatggcgataagtacaaagaatactgggataaaaataacataaccgattgctgaagtatattcttcaatcttatgacttacctctgtttgtgaaatagcaagtcctgcaaagaaactacctattactgctgacattcctacgctatcagcaagtagacttaatcccaaacaaataatcaaggcaacaatcgtatttttgttggcaatgggtagtttttgtacgaatttccaaaatcttggaataagcttatgcacaagaaataaaaaggcaaaaaagagaagttcaagcaaaaattggaagaaaagatgagaaccagaaccaccatttttaaaactagtaaaaattgataaaatcaatacagctaaaatatcatcaacaactgctgctcctagaataatcgaacctgcacgtgtactgagcttgccatattcttgcaagacttcaaccgtaatcgacactgaggtcgcagcgaaaacaattccataaaagaaactggtcgatattccgtaaccaaagccaaaagcaacaagtccaaaggcaattaatggcacaattacaccaccaactgcaacgagcattgatgctttaaaatttttctttagaacagttaaatcactctcaattcccgctaagaacatgagtaagataaccccaatctcagacatcacttctagaacatgaccgctatgaaccaagcctaaaactgatggagcaatcaaaatcccaacaagcatttgtccaacgacagctggaattttaaggcgtcttgaaacaagagtagcaattaaagaggcaattaaaacaattgtgagttgtaaaatatcattcataagttgattttaacatatttttcattcttaaaaacacattttcgactaaaatccttaaattttgaatgtttctacgagtcgtttgcttgcttcttcaatcaatgagaatggtgcagcagcatttaatctggcatgcgcttgtccggcttttccaaaacttattcctttatttaaaatcacacctgcctcttctgctaatttttcatccaataccttatcttctaattgatattcagaaaaatcaagccaaatcaaataggttccttgaggtttcattactttgatttttgttttttgatgaagttctgactcaatataagtgatatttttttcaagcacatttttgagttcatttaaccattcacttccattttcataagcaactttggtggctagcattcctaaagtgctaatttcttgttgattatttgctagtcttctttgtaagtatttttcacgtaaatcttgattttcgataattgcataagcgcatttcacgccagcaatgttaaaacttttagtggcagaagataaaacaactgaaaaatctttgaagtcttctgaaagagtgttaaaggtctgatgctgatgaccaaacaatgttaaatcttgatgaatttcatcagaaacgacaatcacattatgctttttacaaatttggccaagttttatcagttcttctttcgtccacacgcgcccaccaggattgtgggggttacaaagaatatataatttcacggaattttcaacaatttctttttcaaaaacttcaaaatcaattagaaattccccgtttttttcaatcagtttattttcaattagctttcgattatttagcttaactgttctggcaaacgggggataaacaggtgtgtttattaaaacagcatcattttctttggtcaatgcttgaatggccagaccaattcctggaacaactccttcaaccaaaattaaagcttctttagaaaagtcatactgatgttgatttttttcccaattttgaatgcttttaattaaatcttcttcaacataggcatatccataaactctatagtctgcgtaatcatggatactttgttttatttctggtaaggcaagaaaatccatatcagccacccataatggaagtttatgaggattctcttttatttcttgccattttacagaattgtggtcaagtcgatttggaatggttgtaaaatcatattttgtcatttttatactctcttttttattttcgtcatgatagctgtgactgctttagcagtttacagatatgctagtagttccatcagtaaaaaatttactgacagaacatattttagcacttatggatatgctggtagtctcatcataggatagccgttggcgcttcgcctttttgtcattcgctttagcggatagacaaaaaggacagcgtagcacgcagtgcgtagatagcgtttacggatatgctagtttgttcatcagtaattttttaattttctaaagcttctttgaggtcttctattaaatcgcgaacatcttctatcccaatcgaaaggcgaagcaaatcatctgttaaaccataactttctctaatctcaagtggaatatcatggtgagtttgcgctgttggataagtgattaaagattcaacacctcctaagctttcagcaaatgtaaaaacgctcaagtgatttaaaatagcaggaattttgtttttgtcagtaacttttagagaaatcatgccacctaatcctgggtaaagtacttcttttactgatggaagtttttttaggaaagtcacatttttttgggcatttttagttgccctctccattctgaggcttaaagttttcaaacctcgcatgacaagataactgtcaaacggagaaagaactgctcctgtagtattgagctgatataataatctttcataaagatcttcatcataaacaatgaccgctccagccaagacgtcattatgtcctgataaatattttgttgccgaatgaatcactaaatccgcacccaattctaatggtttttgataaattggggtataaaaagtattgtcaacaatcacttttgcatgatatgcctgtgctttattggcgattttttcaatattatatttaaccatcattggatttgtcggtgtttcaatataaacaatatcagtattttcatctattagctcaagcatttctttttcgcttttagcataggaaaagtaaaatcgcccctctttttcttgttcatcaaaccagcgaaatgaacctccatacaaatctcgactggcaacgattttggaaccgactggaaaaactgaaaaggccaagacaattgcagccattcctgacgaagttgctagagcaaattgtcctgattcaattgaagcaagggcttcttccaaggttgctcttgttggatttttggttctggtgtaatcaaagccagtcgattgaccaaattctggatgttgataggtcgttgaaaaatgcaaaggactaactaaagctcccgttgcctcatcttgatgaattccgacttgcgccaataaagtatctaatcttttatccataaatttcctcattttttaactcattattttttacttttactctttttgattaaaatcataattttcttcattcaaatgttgactcagacgttctcctagataaggcgttccttgataaaccgcataattcaaccaatttgaaaaaaagagggaagctgctgaagcccaagtgctttttggcttatttttatcatcattttccggaaaataattttggggaagattgggtttcagtccttcttctttatctctctcatattcccaagctaaagtttcacggtcatattctaaatggccaaaaaggtaaatttcacgcaaatttttcttcgctaaaattgaaaatccggtttctttggagcttgacaagacttccaaatcaggtactttttttatttctgatggatttgattgggtatatcgcgattgtggataattaaaaaaatcatcaaatcctctaaataatggatttttaggttgctctactgagcttttgtaaataccacacaatttttgcggaagattttctttagttacaccatagcgagcataaagtgccgcttgtgccccccaacaaatatgcagacttgaatagacatggcttttagaccagtcaataattttcaaaagctcactccaatagtccacttcttcaaagtttaactgctcaaccggagctcctgtgacaattaatccgtcgtaatattgactcttaatctcagaaaaagatttatagaaggaatctaaatgcccttgtttcgtatttttaaaatcatgagaagtcatatataaaaagtcaacattaatttgtaatggagtgttcgatagtaatcgtaaaatttgtctttcagttactaatttacgcggcatgagattaaccaccagcaaatttaaagggcgaatattttgattcttcgctcgttcatcattcataacaaaaatattatccgctcgcaaatcatcaattgcgggcagaccttcaatcacttttaccggcataaatcactcaactttcaaatagaattagactcaattatagcccttcgtgatttttttgcaatagtctcgcattttaattctgtgatggtctaatttaaaatttttaatcttataataaaacttgcctatggcaagtctcattttgtattttatttatttataattcgagcaatgattttatcatagattactctcatttctttttctgaggatttttcggaaaatttttctaggggaatccaggctaatccctctgtttcagctgtattcttttgaagtgaatcactttcatttgcttcaaataaaaaagtaacattaagatgaatatgagcactgacataaccatattttctgtgatgatgtccaaaaacaggtaaggcttcaattgaaattggcttttctgaaagttttttgaaagatcgcagtcccgtttcttcttgaacctcttttaccgctacagctaataagtcagcattgccatcagcatgaccgcctacccaaccccaactttgataaatcttatgataaattcctaaaattttatcatgactttcattcaaaacaaatgcacttgctgtaaaatgtgcaatagaagaccgattcaaatttttttcatcagctgcaaaatcttgaaaaactttataatctgttttttcttgctgaccttctggtacaaaattctctaataatttttctatttgatttttcatttttcacctcacaaaattattacaatgatactcattaaaattaaagaaataaacatggataaacttattgtcaatccagctaaggccttatcatttccaagttctatagcctgaatcatatgtaaaaaggacattgggcaaaagaagattaataaaagaatttcttttattatggctggaaatggaaggaaaaaataaactaaactagctaaaataaaagctagcaaatagcgccaagtcaatatttttaagacaagttttaattttccctttggcagacgaaattccataaaaagcccgatcgtaaagatagataaaagagtattagcatttgctaaagggcgaattggaattagccattcatccggaaaagataggccaaaaattgctaaaataaacataaaaatataaacaacaaagggtggattacgaaataagacgccaaatatttcttgtaagataaagccgtgtttttttctgccacttgaaagttcaacaattgcttgagtagtccctgtcaccattaatgaatttcccatgtcaaacatggcaagaaatggaattgctgctggaaaaaaactagaaacaaaaggaattgaaaaatttccgatattataacctgacaaatcaaacatataaagtccacgttcttcaacagtagcttttcgcccaataaattttcctagaaaaactaaaagaagattggaaaaaagtcccataaacatcaaaataaaaaaaatattagagagttttgtatgattgactccaattaaaattgttgctggcaaggtcagataaacaaccatttttgaagttattgctccgtctttttgatgaagaattctaattttctttagtaggagagctaaaaataaaacaagtatgatactcaaggcgttgagaagaattgtggtcattattttactttctgtcagtcgttttttattctgtcagtaattttgtaactcctaagtttactgacagcctatctcaattaattctagcattttttttaagcaaaaactcccgtaaaaatacgagagtcttttttgattatttaatttcaatggtatattcacaagaaaattttccttctggtgccaattgattgattccaaatttgttggtaatatctccatcagtattttcatcatctgcaattccacaccaaggttcgatacaaacaaagggtgcttcatttggataaggtgaccataaaccaaaataaggcatatttttccatgttaggctgacttcgttgtcatctaatttattgatcaatgaaactttcatctcctttgatgaagtataaactaaagcatctttatcaaaaagtgttcttgttaatggaagttgactgacttgactttcaactctttcatctagtttcaaagttcctgacggtggatcaagtggaataaatgtccgcttttcatctggtgaaattgttaattggtaatcttcaaaagttccattttttaaaggaacattgaaagctgggtgagccccaacgccaaaagacatgaatttttcatcttcatttttcacttcataacgaactctaattttattgtctactagtttataagaaacacggaaaacaaaatgaaagggatagtgatttaagctatcttcattgtcgcgaagttcaaaaacaagttcatcagctgatttcttaattaattcaaagtcattatcacgtgcaaaaccgtgtccgcccattttataagttttgtcattatagcgatattccccatttttcaatttccctacgattggaaagagaactggagcatgacgtccccaaaattttgcatctgcttgccacaagtattcaatatcatcatgttgaatagaatgcatttctgctccaaaagtatccacaacaacatttaagtggtcattttttaaagtgtaattcataaaaaactccttatatttttttaacttcctctattttaccatttttactgacaaaaatttctgtcagtaaaaaaacgtacgccacacttcagaatgttgacaaagtactttccacaaaaaatcaaaaagttaaattatgactcaaatgactgtggaaatagacaaaagaggagccttttgggctcctcttttaacaatggaacacttcgtcccactcgactgcgagagtggagagcctagcatgaagtgcgaagatgttacacaccaaattattcaaatttaggtgtaaaacagcttttttattcactcgaaccgtcggtttaatcttttctcggtttataaaaattacgattagataaagcccaaacccgttgactaaattgacctgggtcaagcgtttgagtcgccgtagtcatcatcatcatattggcatccataacatcaatttgatgaatcatttctgcttccataatttgcggacgaacagggctaccatattccaactcaccatgatgactcaacaaacaatgacgaagcattaataaatcttcattatcatcatcaaagccaagttcaatggcggctttactcacttcttcatcaatcaaaacaatgtgcccaagcaaatttccgcgcaaagtataagaagtattttccgcacctgtaaactctaaacattttgccatatcatgcagtaaaacaccggcaaacatcaaattttcgttgagttgtggataaacttcgcaaactttttctgctaattgaagcatggtggttgtatggaaagcaagacctccttcaaaagcatggtgattagtttttgcagcaggaaattcataaaattctttatcaaattttttcaaaatcgtccgtacaattcgatttaaagtcgcattttcaatacggaagacgattgattgaacatattcacgtagatctttttcttgaacaggagaactttctcggtaatcatgaggttgattaggttcactatctgtcgccaaacgtaattgtattttattgacttgaggcattccattataaagttctttgagagccttcatatgcacgacacgtccagctctaaattgttcaaccgccttaggatttgcatcccaaatatttccgttgattgttcctgttctgtcttgaaaacttaaagctaaaaagtcttttcctgcacgagtttgacgtaattcaactgatttaatcagataaaacccttcaaaaaattcgccaatttctaagtttttaatgagcaccatgttttctcctttaagatgtgagaacgagcattcagaagtgatgaaaattgtggttctgaatacaatccagtctctatttcacgcgcttctacgagcccgaactcagttaaataaatttacaggggcgcttcatttcaccaaagaaataaatgtttttctttcttacgtcccacttttatatgttaattttttatcgcttttaagagcgactacttctttagatatcgaacttaaactagaaagagaggtttattcattatctatccctagaagttcactacttttactattatcaatttcattaatattccgtaatttacgattcatcacatttgttcttgtggtgattagattgctaatctctttttcagattgttgcagacgttcttgaacttttttcagtgaaccttcaaacttaccaaattctgttttgacagcacctagtagctcataaacttcagctgatttttgttcgatttgcaaagttttaaagcccatttgcaaactgttcaagacggctgtcattgtcgttggaccagtcacattaaccttgtaatcacgactgatttgttcataaagttcagggttattgaccacttccataaacagcccttcagttggtaaaaacatgatggcaaaatctgttgtttttggtggaacaatatatttttcactgattgatttggcttgagctttgacggcattaaacaatgcttttcttgtcttctcaatttccagactgtcatttgattctaaagccatttgcaagcgttgataatcttccatcgggaattttgagtcaattggtaataaaagctctgaatcatcagatttcccaggtaaaatcaaagcataatcaactgcatttcccccttggatattgacttgttcacggtattgactacttgtaaacatttgctctaaaattcggcctaactgaatttcaccaacaatcccacgtgttttaacaccggtcattaccttttgtaagctgtccacatcgctggcaagatttctcatttcgcccaagccctcttccacatttttcaaatgtaaagttacctgttcaaaggattgcgaaattctgcgatttaatgtttcttgcaatttttcatcgaccgtttcttgaatctgactcaatcttttatcatttgaatcttgtaattctttaaatttatggtcaaatttggcggtaattgactctgtcagttctgacagtttactaaccgttctatcagtagattctaccaaacttacagaaattttttctaatttttgctcatttgagttttgtaaatctttaaactgccaatcaaacttactattgatattttctgtcagtgccgaaaaatcattattgaccgaacgtaaactactagaaagttcctgtctattttgcgcaagttgctggttaatatctgagcgcatttccgataaattttgattaagataatttaactgatgactcgtatttcctttgtcagtttttttgaaaaaattggcaagggacagtaaaatcaaaagtataagtaatataataattatgacttccatcttgattttttattttcctacatttctaaaaaatttaaatcaattcctaaagtttactgacagaaaagctgtcagtaactttttgaaaattttataaatttacacgaagtttttcgatatttttctcaacttcaccattaaaaataaatgaccctgcaacaaaaacattggctccggcagctttagcaactttaattgtttggtcatcaattccaccatcaacttcaatttcaaaatcaagctttttatcagtccgaatttgagcgagttcccgcaccttatccatcatttcaggaataaatttttggcccccaaaaccaggattcactgtcattactaagaccatatctacaagtggtaaaacagttttaatcgcctctacaggagttccaggattaataactaccgaagctttcatgccggcattcttaattttttgaagtgctccgtgaatatgatgagttgcttcaacatgaatactcatgctatcagctcctgcctttgcaaaatcctccacatatttttcaggattttcaaccatcatgtgaacatcgaaaaataaatgagtttgtgcgcgaagtgccgaaacaacgccagctccaaaggttaaattatccacaaaatgtccgtccattacgtcaatatgtacaaggtcagctccagcagattctaaacgtttcacatctcttgcaaaatttccaaagtctgctgacaaaattgatggagcaattttatttttcatttctatcctctctctaaataacttgaattagtaatttatcttttgaaactaaaaacacttattcaccactattttctgatgaatcatcatgaagttcttctttaataattgttttccaagattcaccctcacgtttgtgctctacaacggttgccgcacgaactccaagcataattgctaagcctaaagcaatgacagtcaagaaattcatcacaaaggccagacttccacttttgaagacaaacatttctaaaatttggcaaataagcgcaaaaataaccgctaaaaaggcttctgttttcaatcgttttttcatttttctttgtcctgtgaactctctaaatcttttttatcctctttgggctgattagttaatccaaaaaagacacggtttaaccaaaaaataacaaagaaagttgcaataaccaagaggataaatacaataatcatcattgtttttgacaaatcatttttaaaataaatcgctaaaatccatgctaaaacaagggcaaaaaaaccagcttgttttaaccaaatattatctttagccctgtttttttcgttttttctcataagtttccctcgtgtgattaatttcatctaaaatctgtaaataattatcatagcggctctctaaaatttcatgattttctagtgccagcttgactgcacagctgggttcatgcgtatgtgtacattcgcgaaacttgcaatcatgactgattcttaaaatttcaggaaaagcagcatttaaatccggctgattcgtcacttcatagtctagactagaaaatcccggtgtgtcagcaattaagccaccagccaattcaaaaaattcaacatgacgtgtcgtatgacgcccacgtcccagtttttctgaagtttctcccgttgccagttgcatttctggtgcaattttatttagcaaagtagtcttaccagcgccagtttgacccataaagacagttacttttcccgctaaattactgaccaaatgctcagcatcaaaaaaaacatcataaccaatttgttcataatcactttttatctgttcataatctgtcagctgattaaaagtttttttattcttatctgagccttcctgcatctctgtcagtaaatccaacttagaaatgtaaatcatcgggtgaatatttttatgctctaaaaaaaccaaaaatcgatctaataaattcaaactaaaatttgggctcactgttgacataataatcacagcttgatcaatattagcaatagatggtcgaattaaagaattttttcgctcaccaatttttaaaatataaccttctgaattttcctcagtagaaaattcaacaaaatctcccacaacaggtttcattcctttttttctgaaattaccacgcgcacgcgtctgataaacttcaccttctgattctacatcataaaagcctgccaaagatttgacaatacgtccattttttatcatgttctcattataccaaaaaaaggcttaactgtaagcctttcattattttttaatgtttattaactcaaaacagtgatttgaatatttttccgtccccaagcgattgcttggtcattagttggaaaatggacatcaatgatattcccaataattgctcccccagtatcaccagcaattgcaattccatatcctggaacttcaacaagagaattcaaaggaataacacttgggtcaaccgcaatgcaaattggatttttacttaaatcaattcccgttgctgtaatcccattcaaagcataagccgttgcttctacatttaaagtacgaccaccagaagttgttgtagatgagccattgttagcactatccgttcctttatcgcttgaagcctgtgaactttgagaacttgatgagcttgagttttgagtacttgacgaacttgatgaaatcttagccttctcttgctccgctttagctttaacctcagctaccgatttagccaatgcttcatcgcgagctttttgttctgctgctgctttttcttgcatttcactcaaaagttgtttattagaactaattttatccttaagcgatgaaatactactttgcaagctgtctacttgtccttgatagtcattttggtttttcacaagagattcttgcgtttcttccaatttaactttcattgttttaagtgaagcttctttttctatcaaagatttagcttggtcagcctcggctgtcaaaactacgttcagattagtcaaacgtgtaatcatctctgagagattttttgatgacgcaacgacatcaatatatgagaacgtagccccaccatttgattgtactgcccgcatttgttttgcgacagaagccttgagttgaacaatatcattttcagtttcagcaattttgctttcatattctgtgattttgctctttgactgcttaactttttcttgagcttcttgcgcttgactataaatcttatttgcctgcgctaatttgctatcgagttctgtttggaagtttgtaagttcttggttgacttccgtttgagagctctcagcatttacctttgttactcctaagagattagatggtagtactgacaaaatcaacagcaaagctcccacaagtattccaacttgttttatttttttaggaattaaattcttcatactttgtctattctaacatatcccctcaggattttaattgcaatatctttaccaagattaacataattttaaaataaatacaaaacaacacttccgcaagagtcttttaatttactgaaagcaaattttcattcacttctttattatttatttacaaaaaaatctctatcagtaaaataccaatagagattttactgacagtttttttgtcagtaatttttcaaattaacggatttctatatccaatttttccacaagattttttgtaattttattgaccgcagccgtaatttcatcatctgtcattgtattttcaacaggttggaaagtgagactgtaagccattgatttcttaccagccggcaagtttttgccttgataaatatcaaataactcaacttggctaagtgttttgacacgacttgatttaatgacagaaacaatttgtgcatgtgtcacttcagcatcaatcaaaagtgcgatatcacggtgaaccgcttgaactttcggaatgtcagtaaagatagtttgagctggtaattcttcaagcatcacttgcatatcaagaccagcaacataagtttctgcaatgtcgtattttttagctgtcgccggatgaatttgtcctacaaaaccagccacacgaccattaattttaatgacagcagtccgtcctgggtgcatcgctgcttgattattgcttggaataaattctacttctttgtatgcttcgagaaggttttccacaattcccttagcatagtagaaatcaacaggaacagcttgtccattatatgatttatccacaacatttccagaaatagcaaaagcaaggtttggtacttctatcggacgaatatcatctggatttggtaagaaaatattgccaatttcataaattgccacatcagcatttttacgattctgattgtaatttacaatatccaaaagtcctggaatcatgtttgcacgaagtgtttgacgatcttcggtcattggcatcataagcgttgttgtttcaagctgacccacaaattcagttgctttttctggagttacaagcgaataaccaataacttcattaagccctgaactttcgagacctgttcgcaccgtacgacggaatttttgcatttgagtcaattcaccagcattttgtgaggaaggcaaagtacttggcaaattatcatagccataaatacgagctacttcttcaactaaatcagcttcaatatgaatatcccaacgacgtgatggaatttcacaagtaaatttttcaccctcaacttcaaccccaaagccaagttgaacaaaaatgttttccacagtctcaagagataaatctgttcccaaagcactattaacacgactcaaagtaattgatacttttggcaaaataggttgataatcatttgattcaacaacacctgaaagaacttttccaccagccaattcaactatcattgctgctgcaaaatcaagtgcctcacgaaccgttccttcattaattcctttttcaaaacgacttgatgcttccgaacgcaaagcaaatttttgagaagttttacgaattgaagtcccatcaaatagagccgcttcaagggcaacacttgttgtttcgtcagtaatttcactatcagcgccacccataacaccaccaagcgctacaggaagtccatttgcggtaaccacaatatcagaatcatctaattcacgttcaacatggtctaaggttgtcattttttcaccagccttagcttgacgaaccaaaatttcatcagaaccaaatttagcaaaatcaaaactatgcaaaggttgaccaaaagccatcaaaacataattcgtcacatccactacattgttgattggtttcacaccagcattcatcaaacggttttgcaaccattgtggtgatttagcaatcttaaccccttcaatcaaacgaattttatatgttggtaccttatctgtttcaacttttactgcaattttacttgctgctgattcagaagcttctactaaatctttcttttctaattgaacgggtaaaccataaatagcgccaacttcccaagctgccccatgcattgacaaagcatccgcacggtttggtgtaattgataattcaatgatttcatcatccatatcaagataagagaaaatactatcaccaactttagcatccgctggcatttcaaaaataccatcctcatgcttcattggattaattttttcatcaatcccaatttcatcaagagcacagagcatcccgagagattcaactcctcgaattttaccttttttgattttataattatcagcaattcgagcacccacaagtgccacaattactttcatacccacacgaacatttggcacaccacaaacaatttgcaatgattcttcagctccaacattcacttgtgtgatgtgtaagtgtgtgtcaggaatatcttcacttgataaaatttctcccacaacaagttttgacaaaccttccattggacttgtcacgccttcaacctcaatcccagacgtagacatcttttgttctaattcagccgatgtcgctctaagattaggcaccaactcttttaaccatttatatgatacttgcattttatttcactttctattcacagttttttgactttttttattttccaaattgctctaagaatcgtacgtccccttgatagaatccacgaatatcgttaattccataacggagcatcgcaatacgttcttgaccaagcccgaaagcaaaaccagaataaactgaagaatctaaaccagacatttcaagcacattgggatggaccatacctgcaccaagaatttcaatccagccggtatgtttgcagacgttacagccttttccgccacatttgaaacaagaaatatcaacctcaacagaaggttcagtaaatgggaaataacttggacgccagcgtaattcacggtcttgaccaaacatttttttcatgacaaggtcaagcgttcctttaaggtctgccattgtgatatttttatctacaaccaaaccttcaatttgatgaaattggtggctgtgagtggcatcatctgtatcacgacgataaacacgaccaggagcaatcatgcgtaaaccacctttagagaaatcatgagcatccattgtccgagcttgcataggtgaagtatgcgtacgaagtaaaacttcattagtgatatagaaagtatcttgcatatcacgagctggatgatcttttggaagattcattcgctcaaaattataatggtctgtttccacttcatagccatcaacaatttcataacccattccaaggaaaatttcttcaatttcctcttgcgtttgagttaagatatggcgacttccttttttctgagcttttcctggcaaagtcacatccaaagtttctgattctaaagcggcattcattactgcttgttcaatttccacttttttagcttcaaattttgccccaaactcatcacgaaaagcattggcaagtgcgccaataactggacgttcttcattagttaggtctttcatccctttcagaatttcagtcaattcaccctttttaccgagcatcatagttcttaaattattcagtgttttttcatcagcaacagagagtaagtcagacaaagtccgcttgcgaaggtcttcaattttttcttgtaagttcatttttatcctttcaacttatgaaaaatatatatttgttattaaaaagagatttgagccaaatttaatagaaaataaaaataccacaactctcatctccaaaggagcgaaagccgcggtaccatcctattttatcacttaatttaattatttaattcacacaaaagcctacattttagactatcactctaaatgatagattaaaaatagctttctttagtaaggtgaacttcaattgcaattccatattgtggctttcagtcggtgaccacaattccctcaaatttcatagacaatctactcttcttacatctatgcttaattttatcactttcataagatttgtcaactttaagaaagtgtatttttttatcttgacaaaacaaaaaacgtattttataataaatatatatttaaaacatgtttataaaacacgtttagaaagaagaaatttaatgaaaacatttaaaagcttagaagattttgtcggaacacactttatctatacctatgataatggttgggaatatgaactctacgtcaaaaacgatcataccattgattaccgtatccatggcggaatggtcgctggccgctgggtcaaagatcaagaagtttcattagtgatgttaaccgaaggaatttataaaattacatggacagaacctactggtactgatgttgccttagattttcttccaaatgaaggaaaattacatggcatgattttcttcccgaaatgggtagaggaacatccagaaatcactgtctgcttccaaaatgattttattgacttaatgcatgaatctcgcgaaaaatatgaaacttatcctaaatatttagttccagaatttgcaaaaatcacttatgctgctgaagcaggcaaagataatgacgaagtcgtcgcacaagctccttacaaagaaatgacaaatgatattcgtaacggaaaatactttgaccaaaattataaaatgattaagcattaatttttaagtcaaaaataatgaagaagagacaaataatatttaatttgtctcttctttatttgagaaatcaatagaataccagcttatcaacattaaataattatcaatttagatttccttaaatttcgttatatataatagaatagatagttttttaaaaatgaagtttaaattctacatcaaaaatttacaatttactattttttgtgtatcatggaaataaaggagaaaaaatatgagccatagagataaattatcttatattatacttggacttttaaagaccgaaccattaagtggttatgaccttaagaaaaagtttgaaagtgaagtcggtgaattttggcaagccaacacagggcaaatttatccttcacttagagtattattaaacgatcaagccgttacttttgatgtacacattgtaggtgaaaagttagagaaaaaaacctatcaaattactccaaaaggaatcgaactatttaacgagtggttaaaacaccctgttgaccgctatccaattcaaaaagatgaattcatgctccgcctttattttctcgatgacaaaaatgaagaaaatctccaaaaactaattgaagaagaaagtattgtccaccagaaaaaactggaatatctgattaaacgtcaaaaagacctctttggtgaagatgaaaaaaataaaaaaagtggccactatttggttttagattttgctattcaaagagaaacttttaaaaaagaatggttagattctttacttaaagatttaaaataagaaaaacactaatattttatgaatattagtgtttttttatccttcaaaaataattattttataaacctttttatttttagttaaggaaaaaaattgttaaaataaagttagcgcttacagaacaagattccggaatctttaaaatcactattgtttaggagatatttatgatttcagtgaaaaaacgtagagaaattaaggcttttttggtaacagcatctataggaattgttgtattaggagggcaacaagtcttagcagatgcagctagtgaaatggtcaatccaaaagataaagtgcttgtaggttattggcacaattggaaatcaacaggaaaagatggttataaaggaggaagttctgctgacttcaatctttcaagtacacaagaaggctacaatgtaattaatgtttcctttatgaaaacacctgaaggacaaacccttcccactttcaagccttataacaaaactgatactgaattcagagccgaaatttcaaaattaaatgccgaaggtaagagcgtcttaatcgctttaggaggagctgacgctcatattgaattaaagaaaagtcaggaaagtgattttgttaatgaaatcattcgtcttgtagatacttacggctttgatggattagatattgatttagaacaggctgcaattgaagcagcagataatcaaactgttatcccatctgctttaaaaaaagttaaagaccattatcgaaaagatggtaaaaactttatgattacgatggctccagaatttccttacttaacaagttcaggtaaatatgcaccatatatcaacaatttagattcgtactatgatttcatcaatcctcaatactataatcaaggaggagatggtttctgggatagtgatttaaatatgtggatttctcaatcaaatgacgaaaaaaaagaagattttctctatggtttaactcaacgtctcgtaacaggaacagatggatttattaaaatcccagccagtaaattcgttattggtctaccatctaataatgacgctgctgcaacaggttatgtgaaagaccccaatgccgtaaaaaatgcattgaatcgcttaaaagcttctggtaacgaaataaaaggtttaatgacttggtcagtaaattgggatgctggaaccaattcaaatggtgaaaaatataataatatttttgtaaatacatacaccccaatgctctttaacaatcaaccgattgaagatactgaaaaacccaccttgcccacaatttcgattagcaatgtgactgcttctactgccacaattcaaggaaaatctacagacaatgtccgcattgatcactatgaaattaagattggtactcaatcttttaaaagtacatccggcttacaagatgtgactggattatccaaaaaaactgaatacaacgttgaagttgtagcagttgacccttcaggtaatcgttctgatacggccagagctacatttatgacactggacacatcagcggaaaataatacttggcaaaaggataaagtttatgttcaaggtgatcgtgttacttttaatggagtaaattatgaagcaaaatggtggaatactggccaacaacctgaccaatcaggagaatttggcccatggaaaaagctataaataggagaggaataaatttatgaaaaaactacttactggtttattagttgctgcaggtctactcagtgtctcccttttaattaaaacagatactgtatcagctcatggttatgttcaatcaccaccagccagaggctatcaaggacaattggattctcaaagtttaggttggaccgccgcttttaatatttatggaaatgttattagtaacccacaatctttagaagcacctaaaggcttcccagaatctggtcccgctgatggtcggatcgcttctgcaaatggaggcttagggcaaataggcgactttgttctagataatcaaactagttcccactggaaaaaaacctctattagtacaggttctaacatcttcacttggaaatacactgcacctcataaaacaacgaagtggcactactatatgaccaaaacaggttgggaccaaaatgcacctttaaaacgttcagaattagaacttatagggacaatcaatcacgatggttctcctgcaacaaataatctctctcacacgattaacattccaactgatcgatctggttatcacattgttttggctgtctgggatgtagctgatacttctaatgctttttataatgtaattgatgtcaacgtcaataataaaaactctagttcacaagtcttcggacccttcttgtaaacaaaaaaagtcagagcatgctctggcttttttatttggactttatacgccccaaactgattctaaaacattagtttgttcacgaccaggacctactgagaaagtcgagatacgtacgccaactagttcactaacacgacgaacatagttacgagcagcttctggtaactcttctaaagtccggcatgaagtaatatcttcagaccatcctggcaattcttcatagattggtttgcaatctgctaattctttaagtgatgctggataatgagtaatttgttcaccattactacgttcgtaagcaacacaaatttttactgtttcaagtcctgaaagaacgtcaattgaattcaaactaagattagtcaagccagaaacacgttttgcatgacgcattacgactgagtcaaaccaaccaacacgacgtggacgtcctgttgttgttccatattcatgtcctacttcacgaatttgatgtccaacttcatcaaaaagttctgttgggaatggaccatcacccacacgtgaagtataggctttacaaacaccaacaacttttgaaatttttgatggacccacaccagagccaatcgttaccccaccagctactgggtttgatgaagttacaaatggatatgttccttggtcaatatcaagcattaccccttgcgcaccttcaaaaaggacacgttttcctgcatcaagggcatcattcaagataactgaagtatctgtcacatattttttaagttgttgaccgtattcatagtattcttcaaaaatttcttcaaattcgattggttctgaatcatacatttttacaaattcacggtttttagcttcaaggtttgtacgtaaacgttcctcaaagatttctttgtcaagtaagtctgcaacacgaattccgacacgagctgctttatccatataggctggcccaatccctttaatggttgtcccaatcttcttatcgcctttggcttcttcttgaaggaagtctaattttttatggtaaggcaagataacatgtgcacggtctgaaatacgtaagctctctgcagaaactccattttcagcgagataagcgatttcttcaatcagtgattttgggttaacaacgacaccattcccaataacggaaatcttttcagggaagaaaattcctgatggaatgaggtgaagtttgaactttttgccgtcgatgacgatggtatgacctgcattgtctcccccttgataacgggcaataacttctgcatttgagcttaggaaatctgtaattttaccttttccttcgtctccccattgcgttccgacaactactactgatggcataatattctccttttggatagttttgactatccacttttcttaaaatattttgcacgctccaagttcgcttggctggcatttctaaaaaacttcttcaacttttgaactaatttatcaaaagtaaaagataaatcatttcttgaaagctcctatcgcactattttttattttatcaaaaaacatcaagatttacttaaaaaatcctgatgcttttgattaaatctaaattatcgttcggaaatacggaacttttttaatctttaaattatgttttacaaaaaactgagaattttggagactgttccactttctagtaaaaccattattccaagtattatataaacaaaagcaagaatccaacgactgtttttttctaaaacgtcatgaaggtgaggaatttttgcaattgtttttccaagaagccctaaaattaatatgtttaaggcaaaaattattatagataatagcaaattatttgctgacagtgtcataaaaaatggagtaaacaaagcaatgttatccgctccacaactcgcaaaagaaatgataataacagttccaagcaagcttttatttttccttttttgtagcaattcatctaattcttcatcgtcatcatcatccccaaagaataaatattttattcctagtcctaaaggaatcaggcccagtaagcctaaaatccactcttctggaacaagttttaggatgaccgcaaaaaataaactgaccactacaagtgcaaaagaaccaattatttgtcccaaagtaatagataaatgactttttttatcaaaacgaacatataatattgctagtaatataagtaaatctagggctgttgcccagtagataaccgttgaatttattataactgaaaacatattaaccattttctaacctctcaaagctattgaggatgagctttttcattattctactaaataaaaagctataagcaacggatttaagattgacaactttaaatgctttgaacaatttccatggatatttattatttttgttacaacttgtaagtttcgattctttaaattttagaaaacgaataaaagacaggacaatattcttcagttaagagctagcaaaatatccattatacaattattatcacttatctgacatttgagttattaatttagtgaaagaagcgagatatttttttcttcaactacttttaattgacaattttccaattttacaatacagctatgttgataatttgattcatcaccaaatataacggtagctttctgtccatcagctaagatgatgatgtcgccttttttcatgttctaaattctttctattttataaaaatggattttatccagttggatgatagattacatttatcttgagattatagtttgtaccctaatacaaattttaatattttagcaaaataagctatattttttcggattattagtgctaattgtcttagaaaactttattttctcaatcatttatcggaaatgcatccatagattttagagaacgagcaactgggacaattcttttacttttttgttgacttttaaaacctagagtaatttcagaattatcgttaggtagcttcttagcaattttagaaactattttttgcaggactataattttactttgtgcataagaatcccccatttgtgaatctatatttatattaaatagcctttttgaatctctttctttttttggataaacttcaatcatatctcctttagaaatatctgcatttgtcacattatgaacgactttataactccattcataattatcaaaagtaagcttcgaatcccctttaacagcaagttctgattttaaatctgaaattactgaatcgtacttgctatttttattctttgagcatgacgatagtgttaatattacaagaaaagtaagaccccataagataatttttttcataactactcctagttgttaaactcttattccatataaatttgtttttttattttgtgattgaaaaattatgaatcatgaggatatgtccaatttttagtggttgaattataatatgttcttgcttcatttattatattatcaaaagtaggaagtcctaatcctccattttcataatgagcctcagtataagctcttaaatgttcagggagtatttcttttactttgttttcaatcgcttctgtacactgcttataatcgctatcatatgtttcttgaaactgactgtcactataacttatttttggttcagcatacatggtaatgatatctcgcaacatttgtctatgccaatcctctttctcaagttcaatagatttatatccttcttcaagtttttcctgatcttcttgtgataagtttgatgaatccttgtaattaattgaagagccagtatctgtagactccctttcttttttggaagattgagaagtgctactagcaaaacttgcttgtgaactctttggactgggatagaaaaagatcgttaataaaattcctatcgcaaatattaaaagactcacaataacagttcctaaaacaagcactgtttttttattagagtttggaacactagactcctcgcgtaccaatcctagtgaaagagccttttcatagtcttcttcattaggctcacgcccatttacatttttaaaggatttctcccactccttttttctaatcattttctactccaaattttcataatttatataaaatcattctcttttaaagaacatttttatgtagcttaacaatataggtccccaaaatttctaatttttttcctcaggatggatattttgttttacagtatatgagtccaattcaatttttattactccaactcgctctaacattttttctggcatggggtcgtattcttttccttttgctgcatgctccattaaaagctccaatgccgccctcttttcgtccaaattttctatcatttctgcttttccaaaaccaatcaaactttgataagcgtaagaataagttgaagcatttttatttccttcgattagcttatgatgactatccatttcgatagcaactaaaggatttttttctagcattgatactttctttccttcttttgctccgtgaatatacaatgttagttgatcattattatcccaagaatagccgaaatttactggtactacataggggtaaatttctccatttatggccagacgaactacttgtacttcttcaaccagttttttaattagctcaatatctgtgacctgtcttttagctcttctcatatccatttttattatcctttacttctgtatttgttcaattaatttatattaagtttttacatatgattattttaaaataccattctcagggcttactaatccaacgaatccattcgggcaaagcttcttttttaggcttgtaacctttcttaaacatcgtataaaaatattctttattaagacgttcaaatctatctaaaaatgattcatctacattttcatttttacgaactgcattgataaaagcagttaaaataattgctatgactagtcctatataaattaatataaaaaaagcaataaatattaatattggtccaagtggtacagttcgcataattcacattctttcttttaataattggtttcaggatacataaatttacaaatacaaataatttttatagtttattatcagaatatcagttaaatttaatggcccaagttccattttacaatctcactaactaagcgtttgagttcattggtttcaacatcataagggacttttatggtccctttactgcattcgtattgttctttaagagacgcactattattttcaatgaagtttggtttgggatatattcctaagtgctttttttgaggacttgcataaataaggacattcttatccttaaaccatgcaggcattccataggaaatccgttcttgtacttcaggaaagaccaattttacagtttctctgacaatgttcattaactcatcatttttaaaacaatcttcaaattccatagcaggcctctctcatcttcattatcatttttttgttgtttttagtaataatatgttcaaaaaatttatttactgctattagtttatcaaaatcctttattcttaacaaacacttttaagctttctcaaacatcaaaggaaaatctgaggttttttcttgcttttatatcatttattgattgacaatttttgtgctctattgaggtcagttggggtcttgtggtacaatagactcatggataaaattatcaaatcaatctcaaaaaatgggcatttcagagcttttgctttggattcaaccctaactgtgaaagaagcacaggaacgccatcaaacatggccaacttcgacggttgccttaggtcgtacattgattgctggacaaattttaggagctaatgaaaaaggtgatactaaaattacagttaaagttctgggtgatggggcaatgggtccaatcatcgcagtcgctgacagccgcggccatgtcaaaggttatgtcaaaaatcgtgaactcgactataaaaaagcttcaactggtgaagtattagttgctccttttgttggtaatggctttttagttgtggtcaaagacatgggacttaaacaaccttatagtggtcaagttgatttaattactggtgaaattggcgaagacttagcttggtattttttaagttcagaacaaactccttcttctgttggtgtgaatgttttgcttaatgaagactcagatacagtcaaaattgctggtggatttatgttgcaagctttgccagatgctactgacgaagaaattaccgaaattgaacataatatcaaaagtatgccttcaattgcaacaatgctgaccagtgaagaaccattaaaaacgatgttagacaatatttatggcgatatggaatacaaaaatcttggtgaatttcctttggaattcaaatgtgattgtagtaaggaacgtttccttgaaggcattaaatctttaggaagagaaccaattgaggaaatgatatccgaggatcacggtgctgaaattatttgtcaattctgtgaaaacaaatatgagtattctgaagatgaattaaaagcactccttaagtaaaataactaattattttactgacagaaattctgtcagtaaatagaattgagaaaaatgactgtaaaactttttattgcttctacattagacggctatattgccaccaaagaagaaagtctccaatggctttttgatgttgagggtgagggtgataacggctatggtgctttttatagtggtattgatacaatcattatggggaaaaagacttatgattggttagaaaaagagcaagccggtcagtggccttattctgacaaaacttcttatattttaactcatcaagaaatttcttctactgacaatatcgtttttattgacaaagaaaaactgacagagctgtcagtaaattttgcggatactgacaaaaatatctgggttgttggcggcggagaagtcatcaaactttttcttgaaaatcattgggttgatgaattacaagttaccattgccccagttttactaggaggcggaattccactttttccgtcaggaaattacaaagagaaacttcaactgattgatacaaaaacctacggacaatttgttgaattacattatttagtaaaaaaatagatactgacaattttgtcagtattttttaagccttaaaaccttgtgaaatctcaaaaaattgctataatattctttatgactatggacaaaatttacaacgaatcgtggaaaattggcgatatcgaaataaaaaataaaattgtgttagcaccaatggccggaattacgaataaagcttttctgactactgctaaagaatttggagctggacttgttgtaactgaaatgatttctgataaaggaattgaacatcgcaacaaaaaaactttggaaatgatggattttgaaggggtacctcatccactctcaatgcaaatttttgggggtgaagtagatactttggttgaagcagccaaatttgttgaagcaaatactgttgctgatattattgatatcaatatgggttgcccagtacccaaagtaactaaaaacgaagccggttctcgtcttttgcttgatcctgataaagtttatgatgtggtctctgctgtttctaaagctatttcaagaccattaacagtgaaaatccgaattggttgggatgatgaccacctttttgcagttgaaaatgctaaagcaattgaagcgggaggcggagcggctgtttctatgcatgcacgaaccaaagcacaagcttatacaggaaatgctcaagaaaattggcactggctcaaaaaattgaccgaaaatgtcaatattccggtcatcggaaatggcgatgtcaagactcctgaagatgcgaaacgcatgattgatgaaacaggcgtcactgcggtcatgatgggaagagcagcccttggaaacccttggattcttcatcgtaccgagcattatctacgaacaggtgagctattgcctgaaccaacagttgcggaaaaaatggaaattgcaaaacttcacttggcacgtctcgtcgaattaaaaggtgataatcttgctagccgagaatttcgtcagcatgcagcatattacctaaaaggagcttctcgtgcagcaaaagtaaaagttgctgtcaatcaagcagaatcacaagcagaaattatcactattctcgataattttgtgaatggaatcaaataaaacgatatgaaatctggaaatttccaggttttttagttataataaatatagaaataaatattcacacaattccgaaaatagaaagggttttctatatgcgtacaacaaaagccactgaagaaatcgaaaaagctattattcacctgaagaaagcaaaacgagaaattagtaattatacttttgaatacaatgttcaaaacttgattcagttagataagacaattaagcagttggaaaatatcaaaactggaatcaatgcagatagtttttctgttgaaggagtcaaatctaccggtgaaattgaaggcgcacgtctttcaagataattaatttcactgacaaaaataaaaaatagctctctggagctatttttttccttttttagccactttataacgactgcgtggataagtaaaatcaccaatgacttcatgaacatttataattgatgtgaaagcattcgggtcaagaatagacaaaatttgttttacttcttgaatttctccagggtttaaaacaacatatagaatttctttagaatttcctgagtaagccccttctccatgtaaataagtcgcgctacgaccgatttcttcaataattgctttagcaatttcagcatggttattcgtgataataagcattcctcgaaccgtataaccaccagattgaaccacattaattacttgtgctgccacaaaacttgcaatcaaagtgtacatcatatggcgtaaatcaatatagcttaatgaaagtaacatcacacaagcatcaaagataaagaaagttcgcccaacagcgaccccagccttaatctgcaaaagcttggcaataatatcggccccaccagtcgttccaccaaaacggaaaactaaaccaattcctgttccggcaaatacaccagcgagcaaagcagcgattaaataatcatgtccaacattaattgcgactggaatccgttggaaaatccacatccagattgaaagactcacgattccccaaattgtataaacaaaggttcggcgcccaagaaagcgatagccaagaattaaaagtggaatatttaagataagctgggtgtaggaagggtcaatattcaataaagcataaccaatcaatgaaagcccagcgactccaccttcagccaagtggttccccatgttgaactcaacaaaaccaaaggcatagattgctgtaccaattgtaacagcaagaagttgcaaaaaatgcaccttagataattttttcataatattcctcaaaaatttcgatgaaatatccttgccgagggcaaggacgtttaaatctattgtagtttaaatttagaatttagtcaacttttgaaaacttctccctttttaacttaaatatcttaaaaaaaatagctcaatgagctattttatttttttaaatctttaaatctaccccgtttaggagagaaatctcccacaacttcatgaacattgatgactgaagcgaaggcattcgggtcaattaccgatagaatttgttttacttcttgtatttcacttgggttaagaacaacgtaaagcacttctttttaagttcctgaataggctccttcaccgtgtaaatatgttgcgcttcggccaatttcttcaataattgttttagcaacttctacatgatgatttgtgataataagcattccccgaactgtataaccaccattttgaatcaaattaatcatttgcattgaaataaagctggcaatcaaagtatacatcatatgtttaaggtcaacataacttaaagatagagccaaaatacaagagtcaaagataaaaagcattcgcccaacaggaattcctttttttatttgaaataacttagcaagaatatccgtcccacctgttgttccaccaaagcgaaagactaatccaattcctgaacctgaaaaaactccggcgagtaaagcggctattagagtatcatttccaatattaattgtaaaactgaccctttggaaaatccagatccaaacagctaaactcactattccccaaattgtataaataaaggttcttcttcctaaaaaacgataacctatcatcaaaagaggaatattgattaaaagttgaacataagaagggtcaatatgccataaagcataagaaatcaaagaaagtccggcgacccctccttgagctaagtgattcgccatattaaaggcgacaaagccaaaagcataaattccagtaccaattgcgatggcaagcaagtacaaaaaatgtactcgtgcaaatcttttcattttatttcctcctttattttttcagataataaggggagaaagtcctccttttggctttctcccttttatctttcttttttcaatgtaaaacctaagcagttagtcttctacttctgcaaattttccaagcactcgaacattctccgatattgatacaaaagcatgttcgtcatatttttgaataatatccttgaattcctgatattcatacattgtaatgacagtcatgaggacggtctgactggtatgtgtatagccaccttccgcgtcatgtaaaatggttactccatgtttaaaacgattcactaatttctttgtcagtaattctggatttttagttacaatcattacttgaagacgtttttgtcttgtaaagattgcatcttgtacacgagaattaacgaaaatagcaattaaactatagagcatgtattcccagccaaaaagaactccggctgtaaaaataatcacaccattgaccagaaatgccaaagttccaacacttcttcctgttttcttacgcatatagaggctgacgatatcagtccctccagaagaaatcccagatttcattgcattcccaacaccaaatcccataattgccccaccaaagacagcattaataactggctcatgagttaagggcgtcactggaataaaatgaatgaaaactgaactcataacaactgtaatcactgtataaacggtgaactgtttgcctattcctcgccaagcaagaatgaaaagtggcgcatttactaatatcaaagaagcagaaataggtaagatattatgaccacttattcttgctactaattcagtaacaacctgagctgcccccgtcgcaccagaagcatacacatgtcctggctgatagaaaaagttcaatgcgaatgatgagaagacagcataaacaactgctgccgaaaatttatttgccattttttcagcgccaatagattttaaaacttgataaagtccaattctatctagaaggccgccgagaattttattgatctttgtttgcaagtttaatactcaattcttccagttgtttttcagcaactatggatggagcctgtgtcattgggtcagaggctttgttatttttagggaaagcaattacttcacggatattgtcttttccagcaagcaacattacgaaacggtcaagacctagcgccaaaccgccatgtggtgggaaaccataatcaagtgcttcaagcaagaaaccaaattgttcgtttgcatcttctaatttaaagccaagagcgctcaacatttcttcttgaagttggcgggtattaattcttaatgaccctccaccaagttcataaccatttaaaacaatatcataagcatgggcacgaacttttttcaaatcagaatctttgctatgtccgtcagcagataaaaaagcttgtgtttctttcgttggtaaagtaaatggatggtgagcagacatataacgctcttcttcatctgaccactcaaacataggccaatcaatgacccaaaggaaattgaactgacggaaatcaatcaatccttgttgtttaccaatcgttaaacgaagcgcaccaagagctgaatttgctacatcaagactgtcagcaacgaagagcaccaagtcattgtcagtcaatttcaattcattaacaaagctgtcagtagattctgctaagaatttagaaacgccaccagcaaattcacctttttcaaatttaacccaagcaaggcctttggccccattttgtttggcttgttctgtcaatttatcaattgccttacgagaatatttgtcagcagcatctttgacaacaatcgctttaacaacttctgcttcttggaaaactttgaaatcaattgttttagcaagtgctgacaaatctgtcagtaacaattcaaaacgagtatcaggtttgtcagaaccataaaagttcatggcatcatcatatttcatacgtgggaaaggtaaagtgacatcaattcctttcacatctttcatgactttagcaattaacccttctgtcaaatcttgaatctcttcttctgacaaaaatgatgtttctaaatcgacttgtgtgaattctggctgacggtcaccacgtaaatcttcatcacggaaacatttaacaatttgataataacgatcaagtccagcagtcattaaaagctgtttcattaattgtggtgattgtggaagagcataaaattcacctttattaacacgagatggaacaagataatcacgcgctccttctggtgttgatttatttaaaaatggtgtttcaacatcaatgaatcctgctccatccaaatattcacgaattgaacgagtcgtcgcatgacgcattgtgatatttttaagcatttctggacgacgtaaatcaaggtaacgatatttcaaacgagtatcatcaagaacttcaacatcatctttaatttcaaaaggtgttgttttagaagtagacaaaatttcaatggcagtcgcttcaatttcaataccaccagttttaattttgtcattcttgcttgcgcgctcaacaactttacctgtcacctcaagaacaaattcattgcgtgctttatcagctgcttctgccacatcagccgctgctgtttcaggattgacaacgatttggacaatcccttctcggtcacgtaaatcaatgaaaattaatccaccaagattacggcgtttggctacccagcctttaaccgtaaccgtttgatttaagtattcttctgtaatatttcccgcgtaatttgtacgtttcatataaatgtaaattttactcttctagtacacaaagtaaaattttactcctctttctttttattatctatagttttgtttttcaggtatgacaccacgaacaccaccggttggattctttacatctccatgatgccgcggtattagatgaacatgacaatgaaaaacagtttgtccagctgctttaccaacattaatgccaatattgtaggcctcggcatgaaatttctcagttaaattatcttttgataagtctaaaagttcttcaattgcttttctttcagctttggtcatctcaaaatatgaagacacatgtcttttaggcgtaatcaacatatgaccttcactgactggataggcatcataaaatgcctgtgccaattcattttcaaagattgtatctttcatctgacaaaatggacaatccgtcatcaattcacccctgctttaagtcacttaaagttcttcatccgcataaatctcttcaaaaatcggtgcaaatgattcatgaacagctttaagtgttgtttctacttgtttacgtgtttgattatgtttcactttgatttgacctgtgcgaatctcatcttctccaagtgtaataatcaactcagcacccaatttttcagccgttttaaattgcgctcctagttttcgatttgagaaatcacgttcgactttaaaggcctgttcacgtaggctttcagctaattttgttgcttcaagatttgctttttcgcccattacagcaatataaacatccaaagtttcttcaggaatgaaattaatttcttgtttttgagcaatcatcaaaagtctttcaattcctaaaccaaaaccaaaggcaggagttgctggtccgtcgaaatattcaactagcccatcataacgtccaccaccacatacagtcaaatctttgccatcaaaatcaacaataaattcaaaaattgtatcattataataatctaaaccacgaaccatatttgggtcaatagtgtactcaatatgtaaggattcaagcaaggctttcacttcttcaaaataagcctttgaagcttcattgagatagtctaaaatagctggagcgtttttaacaattgcgatgtcttctgcttctttactatccaaaacgcgtaaaggattttcattgagacgacgacggctatcttctgaaagttgattttcaaaaggagtcaaataatcaatcaatgcttgacggtaagccatgcgactttccatatctccaagtgtatttagagctagtttaagaccagtaattcctaactggcggaaaagtgtgtcagccattgcaataatttctacatcaactgctggatttttcactcctaaacactctacaccaaattgatgaaattgacgtaaacgtcctgattgtggacgttcataacgaaacattggtgcgtcataccatagcttcactggttttactacttcaggggcatagagtttattctcaatataagcccgaacagctgaggcagttccttctggacgaagcgcaatatgacgtcctcctttatcctcaaaatcatacatttctttggtaacaatatcacttgtttcacctgttgcacgactaaaaagttcatagctttcaaacattggtgtccgaatttctttgaaattataatcattgaaaacaccacgagcaatttcttcgatgtactgccattttgcagtttcagcaggcagtaaatctgctgttccttttggtttttgaagtttcatttttttcctttcggttaactgggagtagaaatctttatgattattcattgggtttgaacattcatttcaaagataccgtttacataagaaagcaccctaaagcttctcgctctagggtgcatcattgcacggtaccacctaaatttgctcctagaaaatcagagcctcagattgattataacgttatcaccgataaacactgtcacaaaccctatgagctttcaccaacactcactctcttttctattattgtaacgcaaaaagtgagccaaagcaagcaacttttgtaggatttagaaaatattttaacttctatgattcttctaaattaagaacatggcgattataatatttttgagcaaaatcacgactaataggaacttctaaaaagtcaaataaggcaatcactctaagcatttctttttgaccttctatttttccattcctataatctaaataagcccaagcaaagcgataaagtccttggacatgtgtatcaagtgcttctgcataatgatgaaccattgataataagtcacttgctttttgggtttcccctctacttatgagtgtcatagcacatcgcccggcagtctgtacaatacgacgtcgataaattaattttcctttatattctttctcatgtaaattaatatctgataatattgcataaactaaagagtaagggagttgccaagcatttaaagccaaaattcctaaactatattcaagccaaagctcgattccaaataaaaaatcaccaatttctgttacttcttcatcatttaatatttgatgacaagctttagcagttaattctaagacacggtaatcagtgtattgtctggtcaatctttcttgcgaatgcaattcaagccactcattgttatagttcaaagtttcaaaattttctttaagtatcttaccttttatttcttgattattcgcatatttgtgtgcttcattttgaatcatttctgcttccgcaaattcttctcttaactgtatcctatccaaccagttgatataatgaacaaaataatcatccttacttccattgataatataagaaaaatcctgttccggaatatgcatgagcccaagcattgcatcaatcacatcatacggtagcaaaatttttccactttcaaatagcttcaaacgaacaggatttacgccaactggaataaaaaaatcatcacgatagccttgctggtagcgaatgatatgaaacttttccccataaacttcatcaactcgactttctccagataaatacataaagtcactcaaagtataacccataaattttaaaagttcagctaatctctcaaatgaaatatttgaagtcccgttttcaaacctaacaattccatttttagaaataattgattctaaatctttatatttaaaacctgccagttgacgcaactcttcgaaacaagtaccataattttgtgacttttgtttcatctaattatccctcttttaataatatcgttttattatataactatttgtttgcgttttcaagtcctgaatcagttttttaagatataaaaagaccctgaagagggtcttctactttcgattcaatgtcagtccgacttttttatcttggataccaatttaacgattagaaaaaagattcctgctacaaaaatgattgaggctagaaatactatagtcactaaaaacataatcggttcctccttatcataaaagatagcctaatcctattgatgtaataacaccgaaaaccataaggcttaaaaagcaaagcgtagcaaatagaaggtagactagatttaaatcattatttttttctttgatataaaagtaaagatagaagataaaggaaaaagcgggaattcctaacaatagtaagacaggcaccagccaatcaaccggacttatattacttaacatcttaccgataagttcaaaagacttattcataaaactaatctgactaaagaagggagcagagagccaaagccaaatggtcagtaaaataggaattgtttttttgattgtcatagtttagtatcttcctacctgataaggagcgtatgcttgggtaaataaagcgggtaaccctgtcggtacgacaactccacttcctatcccatacataaccggtaaatcaccagtgccataataataagcttgccaaactaattttgaacaatagttaggatttactcctttaatatcagtggtaattctataatcaatatgaatgtttttagttatacttccagtggtagaataataatgagtatctgcatattgagcaacttgtcttgctaaaccagtatttcttattctgtaaacagatgtccattctttaatatgttcagtaatccattgtcttttagggagttgacgattattatctgctattccccaaaaccaattagccccacctggcatttctaaaacataaccgtccgcatttaagatagctgcatgtccaattactcccgtaggaaagtctccaccaacgattaaaatatcaccggcttgggtatcacgacagaatttgtcaatattatcttgtgccgttctcagtctaatatttgactcagcgggggttttaagttgtaagactggttcttttgtgtcagtcataacaccataattattgagttttaaccatgattcataagtgattgatgaatcataatttttgtattcttcataggaggggcgcatagtagaaatttcgtctttttcccaatttgcttttggataaagattggggtcaataatgttttcgttgacagctttatcataaagacttccaacatttgtgaattcatcagcattaacgattagtcctgtaaacagaactaatcccagtagtagtgcgatgaggcttccaattttaaattttttcatttgcttgtctcctttttaggttcagggcgcaagactttttttgtaataatattttctgttcatttgtgcaaaaaatctcctttctattgtgaacccatgtattttttcttttttaaacttatgatgcaaatcggcatcatagagccttgtgacctcagaatccataagtcattccgggatgtccgtatctagtttctactgctgtctttataagttttttatgtgcactatccttatatgatgtaatagtaactcttgtttgatatgatttaggattataaaataaccctgtatttcctacaattctaacttcgatttttcctgtaaaatacacatttttacttgaatcagctatataatcataaatggcaggtgtcaaggcagctgctacggctgtcttaatttctccagaacttgcattgccttttttggccaaaagaagaactactgcagtagtaacaattgatttttgaactgcacgagtggctttttgaatatttgtatttgaactatatgatttccatgtcacccattgggtagggtagggtaagtggaagcttctacttcatcacaaaatattgaatcaccattttttacaatattcatatccactgatgaattattttcaggggttggattattactgaatttgctataggtaaaacttacaacaaagtagataatcaccgcaaaaataattataagaatgaactttagtccttttttcataatcttttcttccctttttctaattggattatccaataaatattagtttaggttacacaaataatcattttggttgtttatataaaattgaaaactatttttctctactattgcaggagtttacttgttgctaaatttacaatcgagttttatcttttttattttcaaaatcattataacagctgatttttcgacttcttttattcgtgccatatctggcactccaaataaaaaaatccaagtagaaatacttgaatttttttattttctatttggaaatgattaatcagcatttctaaaaacttgcatatttttagcaaaatagtcatagccactataaatggtaaagaagacacaaacataaaagaggattgttcctatatacaagggattcccaatgaaaaggaaaataacgctcaacatttgtgtggcagttttgattttaccaggcattgcagccgccataacaactccaccttgttcaaccaataagaggcgcaatcctgtaaccgcaagctcacggcaaatgataattgcaacagcccacattggaacaacatgaagtccaacaagaacaacaaatgcaaccatattgagcattttatcggccaatgggtcagcaaatttaccaaaattgctgacaacatgccatttacgggcgagatatccatcaagccagtcagtaaatgaggctacggcaaatacaattgctgcgataacccacatcactgaactatggtcttgtgaaacaaaaccattaaaatgtgcaccttctggtaaataaaataaaatcacaaagattggaatcataaaaatccttgccattgtcaattgattgggtaatttctctttcatagttctccttttacagcttaaaataagcctcaacttttatttattgagcagctgaattgcttgtcgttcgattaatttgtaaagtaattttatttggtccagttgtggttagtgatgataaatcaagagcttttccattaaccgtaatggtaagcccttgaacacttccaagtgtaattactgaattttctgcgcctgttgtcactaaagcagacagactattggctccatcagataatgtttgaccagttgctggaacattggaattcgtcatgccaacccaaattgttcgtcctgctgcaactgaaaaatcaacttttatagggtcagaaatattagaaattgtggcaatcaatgccgaacttgagcctgagatagcaattgttggttcaggtgtactactacttgcttgtgtactactttctgatggttttgtagagcttgtagaagacttagaagtactaacttcactctttgaataagaataatcattggttattaaatctggtgtttctggtttattcataattaccgctgcaaaaacacctactacaattaataatgccgctgctgataaagaaataattggtacataatgacgccatgtttttggcacttcttcctcaggttctactcgctcactcggtttcacaaaatgataattttctaggatatcctctttatcctcaactgtgattcctttgccttcatcataggcttgaataattctatctgcattcaaccccaatttttctgcatattgtttgaggtaagctttaatgtaaaagtcacccggtagggctttatagtcatctgtctccagtgctacgatatataatttttgtacttgagttaattgttctgcttcagaaagatcaagtccaagcgatgtccgcttttcttttaagacttgtccgattgttttgattgtcaacatatcctcccttcatttttgtactgcacatcgattgttaattatcactgttctttgtttattttggagatttttactatctcgccttagaaattgcgctgacaaagtttcactgaaactttgagcgactttttattttactgacagaaagattttaataggcttgaatttctgtcaaaggatatccgttgggactttagtcccttacggatatccttaaatttctgtcagtagatttttagcttttctgtcttactgacagagggatttatttaggtaaaattgtaaattctacttttttcatctcagaaataaattggtcagcaaatttttcaatttctgacagacttaattctttcaaaatttcagggaaatcaaagaaagttaagtcaccataaatttctgatgaaaattgattcgcaatatattcaagcgaatttaatgaactaaaataatctcccaacatttctcttttgagtaagtcgagatgttcctcactaaaatctctatctattttataactttttatggcttcttgcaaagtttgacctaaaatttgcggattttctgtgtcagcagtcaacactgcaaaatgaaatctcttgtccaaatcaaaggagaaaccaaaggaatcgtcgattaggcctgaattataaagctcttcatagcgctgactggttctaccaaaaagcaaatcgagaaaaagttgattggctaatttatatttaaatagggtctttgagtcacttgaaagttggtcttcaccgcgcagacccaaagcaaattttggcatggcgacttcaagttccaaactctctcccaaaattggttcgctcgctttaatttcttttctttgaatttctgctaaatcagcaaagtcttttttagcttgattacttcttacaaagtctgacatcatctcaatatcaaaaggacctgttaggaacaaattcatatttttaggatgataaaaaacttcataatttttatacaaatcatctgccgtaatggcattaattgttgccggtgtgccagcaatatcagcttctaaaggagaatcagggtacattttttccaaaagtcctgcaaaaagacgccaatcgctgtcatcttgatacatttggatttcttgttgaataattccttgttctttttcaacattttcttttgtaaaataaggtttttggacaaaatcaagtaaaagttctgtacattcataagaatttttgcgagtagaaaaaaggtatgaagtccttgaaaaacttgtaaaagcattagtttgagctcccaaagctccaaacttatacatgacatcaccctcttctttttcaaaaagtttatgctctaagaaatgggcgattccttctggaaaagtctgaaattcactttctcccaatgggacaaaacttgtatcaagtgaaccaaaatttgtagtgaacaagccgtaagttcgattgtaatctgcttttggaagataataaactgtcaagccattaggcaaaatatctgtaaataatctctcacctattttttcataaaacttacttttcaaggctgacctccattttttcctgattcacagtaaatcctttcataaagtattctgcctgcagatttaatgattttgcaacgctaatcaaatcggcttttgaaacagattcgagggcatttaaaaattcagacatcggtaaaaatttatctggaataagtgcttttacatactctagctcaatagtgtttgacggcgaatcctgccccacaaaataagcatttcgtaacattgttttggtttgctcaacttctaattctgtaaaatctcctgattttatggcttctaattgttcaaagattaaacttttggcttcttcataattttcaacgtcaattccagctgcaatttttagaaaacctgtgaaagaatcaaaagttgaagaaattgaataggctaaacttgctttttcccgaacattggtaaagagttttgaatgagcaaaacctcccaaaagtccattcatcacttgcaaagcaaggtagtttttgtctccataagcaattggcatttgataagcgaattgcaaaatagattgagcaacctctttttcatctgtcactactgagctttctgtcagtgattgttgataaaaaatttctttactgacagctctgtcagtaaaattgaagtctgagaatcgttcaatcattcgtttttcatctacatcacctaagacaaagatatcaatggcattgtctgtcagcattttttgataatattcaaaaacggcttttggattttctttggcaatcaattcgctcgttccaacacttggtagtgcttgattttcatcttcaaagaataaattagccaactgacgactggcataataagaacggtcatcattcattgaggccaaataatgcaataaatttctttgctctcttttgaaaatttcgggattgaattgaccattagcagcatcgggttgaaaaattgcaattttcaagaaatcgactgctgctcccaaagtatcaaaatcaacaagtttaggatttacgatactcatattaagagaaagtaaatgttgtttcccttttttagccactcctgtcgtaaacgaagcgccatacatttcagataatttgcgactaaaatcttttccggtttgataaaccgcattagtgctttcgagcatattagaaataaggacacgttttccaagggtgtcagctgacatttcttcacgaaaacgaaccattagtcttactgttttaaatttgctttctttaatgagatgaagcatcactccatctgccattttaatttctgtcaattgactatcactttcctattttatcaagctttttctagttattaaggcaacctttattataccaaaaactgaagcaattttgtgagatttcctaacgaaaatgacgaataatttttatcttaaagtttccttattttattcaataaatttctaaatttccaatgaactaaatttcagatttatgttaaaataagactatgaaaaaatacattttatttgaagaatatatcacactcggacaagttttgaaagaacttggattaatttcaacaggaggtcaagcaaaaattttccttgctgaaaacgaaggaaatattttctataatggcgaagctgaaaatcgtcgtggcaaaaaactccgtgacggagatttattaaaatttccaacttttgatttaaaagttacttttgagcaagctgacgctgatgcgattaaagaacatgaagcagaaaaagctgaagaagcgcgtgttaaagctattgtgaaaaaaatgaacgcggaaaacaagacgacaaaaccagctaaaaaagctccgccacgttttcctggtagaaaataatgaaactcaaagtaattgaactcaaaaattttcgtaattatgaggaattaaaacttgattttcaccctaatctcaatatttttttaggacaaaatgctcaagggaaaacaaatatccttgaggcgattcattttttagcactcactcgtagtcacagaacaagtcacgataaagagctcatttcttggtcgcaacaagaaatgaaggtctcaggagtcgttgaaaaagctcatgcaactgttccacttgaagttcaattaagtcccaaagggagaattgctaaagccaatcatctcaaagaaaatcgcttagccgactacattggtcaactaaaaatcttgatgtttgcacctgaaaatttggaattggtcaaaggttctcctgctacccgcagaaaatttatggatattgaactaggacaaattcatgcggtttacctttatgattccatgcgatataatcgtgcgttaaaagaacggaatgcttatttaaaatttgataaagacaaaattgataaaaattttttaagtgttcttgacggacaattagctgaacatggtaataaaatcatgcttgagcggcaaaattttattgataaacttgaagttcatgcaaaaaaaatccatgagcaacttactcatggtaaagaaaatttaaaaatcatttataatcaaaatgtgaaaactgacttttcaaaagaattattgagcagacaagaccatgatatttttaggcatcaaacatcagttggccctcatcgtgacgatttacaattttttatcaatgagatcaatgttgctgattttggtagtcaaggacaacaacgaaccgttgctctctcaattaaattagcagagattgatttaatttttgaagagactggtgagtatccgattttacttttagatgatgtcatgagtgaattagacaatcatcgtcaacttgatttgattgaaacaagtttgggtaaaacacaaacttttataactacaaccactcttgatcatcttaaaaatttacctgaaaatctgagtattttccatgttaatgctggaaccattgaacaagagcaataaaaagttactgatgaaactactagcatatctgtaaactgctaaagcagtaacagctatcctatgacagaaattcatcagtaacttttttactttctgtcagtaaaaatttccttagcaacaaagatagcattcaaaactcttggaaaaccgacataaggaacacagtgaataaaagtttcaataatttcttcttgcgttagtccaacatttaacgaagcttgaatatgcacgcgcaattgattttcacagcctccttgagtcaacaaactggtgatagtaatcatttcacgctgtttaaaattgagaactcctcgctcataaatcgttccaaaagcgaattctagcatcatatcattcaagtctggtgcaagatctttgagtgaatcaaaaacaacttcagcagctactccgtcaattttcgctaaattttttaaaccaatttcttttttgttcattttatttaccagctttctatgataaaatcattataaaccctcaagttaacttgagggcaagcgaaaaagagaaaaaaatgactaaaacttataaaatttcagaaatagctttactgacagaacttccaatcgctactcttcgttattatgaggaacttgatttattaaaacctgctcgaaactctagtaattatcgagagtttacagaagctgaccttgaatggatttactttatcaaaagagctaaagcaacaggaatgcctcttgcaaaaatccaagattattctcgcttaagagaacaaggcgattcaacaattattcaacgtatttcacttttagttgaacaagagcgaattttacgccaacaaattactgatttagaaggtcacttagattttattttacaaaaaaaacatcattactatgaaactcttcaaaaaaactcggaatcttaattccgagttttttatggtgttccgtatagaaaatttttaacatattttactacagttggattttttggagcttgtgaatggctcgttttagttggatataaagttgaagttatttcatttccgttgttcttgaaaagatgataaattgaaaaactatctgcccaaggaatagcgctatctgtctgctttgcactattaaaatctccttccaatagcaacatttgaactttcggagatattctttcatagttttcttcgatgtattgatacatttgtgttttaattaatggtccgttttgtatgacattagtcaaactctctccgtattggagattagttcctttattgtattccccatccaaagatacatatttattaacaggagggaaatttggattattggctgtatcaatcatatagtacacagcaccggtccctcctgaagaataaccgacgagattaatccaaggaatctgataattctgcatcaaataagatactactttttgtaatcctgcagaatatatcgaaccagagtcagttccttttactgtcccaaattcaatcatcggatactggttatcttgtgaaatttgtccttcaatttttaatatattatttttattagtatctgcagtaattgacaaagatttatgagcgggtacattttcaatcggaagtagccgttgaactaaccaatccactggtgtaacactgccacttgaacctgcaatataaatcgtaggataaattatttgcttattcgaattcgaagttaaggaagtactctccttaacttccgctgtcgttgacaaactcgttccattatcacttttagcatgtgaatgctgagctttcgaccaagagaggacgaaaattgttccagaaagaacgataactaaagcaataaaagtcagagaaagccttttaaatttatttttatttcttcttaactgtctttttttcatccacttcattatatcaaatttttttattaataattatcacaattatcattacattttcatgacgattacatataaaaaagctcaaaaaattgagctttttttcgaactttagataatttatcagtaaccttttggatgactttggtgccatttccaagcgttcgtaataatgtgctctaaatcattttgtgctttccaacccaaaatttcaccagcttttgttgaatcagcaactagttcatctgggtctcctgcacggcgttcacccatttggcttggaatttctttacctgttacttttcgtgctgtttcaagtacttcaagatttgaataacctttacttgaaccgagattaaattggtcagactgaccgcccgctttaagatactctagtgctttgatgtgtgcttcaatcaaatcttccatatcaatataatcacgaatacaagttccatcaggcgtgtgatagtcatcaccataaatagtaatgaattccctttggccaagtgctgtttgcaaaataattggaatcaaatgtgtttcatttttatgagcttcaccaattgaaccatcatccttagccccagcaacattgaaataacgcaaagcgacataagtcatatcagttgcttgcgattgccatttcatcattttttccatgattaatttgctttcaccataaggattaattggtttttgaggtgttttttctgaaattggacttttttctggaattccaaatgtagctgctgtacttgagaaaacaatatgttttactccgaattcttccatcgtttctagaattacttgagcaccaccaacattattattaaaatacattaaaggtttttgcattgactcacccactaaagagtaagcacaaaaatgcatgattccttcaatattttctttttcaaaaacactagctaagaaagcatgatcacgcacatcaccctcgtaaaagcgtacatttgctggaacagattcacggtggcctgtcactaaattatccaccactgccacatcataaccacgtttaagaagcatgtctaccgcatggcttcccacatatcctgctccaccaagaactacaactgtcataaaaacctccattttctatacattatatcaaattattgagaatttgtatcactttttggaaacactaacaattatgatagctaatatcactcaataaattttaaacttagttttaggattaagcatttataaaattaataaatctatggaaaccagcttgtccctcttgattatctttgaacactccggcatctttcaacacctgttcaaatacttctccaactgctccctgaactgtttcatgcactgtttcttttgaaaaatattctgtctttttcaattcttcagcccatggtctgtgaatttctgacatctcattttcttgattcaagagatatttttcaacttccaaaagttctgtctttaacctggctggtaaaattgcaagtcccatcacttcaatcaatccaatattttcttttttaatatggtgtagggctggatgtggatgaaaaattccatctggataaatttcacttgtattattatctcgtaaaactaaatctaattcatatttcccctctcgaattcgagcaatcggagtaattgtatgatgaagctttccgtcagcacttttagctttgatttgaagactttcatcactataaacttgccatttttttaaaagttcatctgcagcttttgaaagttctacttggtttttacttgataatcttagaacagacattggccaattcacaattccacaagaaacatctggaaaatgttgaagtttaatttcttctcgaagttctgcttttgccatcggaaattcataacggccagcttgataatggtcatgggtcaaaattgaccctccaacaattggtaaatctgcattagaaccaatcatataatcaggaaattgatctagaaatcccaataaattatcaaaagcacgtttattaatttccattggttgatgtttagaatttagtaaaatcgagtgttcattaaaataggcataaggagaatattggaagccccagtcttcgccgttaattgaaacttgaatgattcgatgattagaacgagcaggtttatttcctatgccataaaatccttcgttttccaaacaaagttgacaggctggataagaggaaacctttactaatttagctgccgcaatggctttggggtctttttctggttttgagagattaatcgttatttcaagttttccatattttgtcaaatgactaaaggcaatattacgtgcaatatctcgagtttttacttggttcacttgctgtgccagttcataaaaatattgagttgctgcatctggagatgttttatatttttcccagaaatcatgattgattttacttgggcgtggtgtaataaaattcatcagagcagcttcataaaattcatcttgtcctttttcaatcatattattttcatttgcaatcgctaaaagttgatccattaaaatcaaggaatctttctcgtgagcttctttatcgacttctgcccaatcatttagaccaagaaaatgaagaagttgatttctgtgatagagctcatcaagtggctcaatcgttccattttgtaaagcaagactaataaaatcttgaattgattgataaattgacataaaatactttctaatttacttctgtaagtaaagttcttgctttgtcttgattagtgagttttggaaatgaatacaaaattcaagcacttagttttgagtgcttgaatttgtgctatcactaatttaatgttaactcacttaaatcactcataaaaattttttaatattatttgatttattcaacatccaactttgttgaaccagaaccaatttgagcgacgtaaaagcttgctggataaccgacaacttcttcgtaaacttggccgacggctttttcaaaggctgaaacattgtcatgagcaacaagagcgattgcacaaccgccaaatccggctccagtcattctggcccccaagacaccggcttgtttttgagcagtttctgctaaggtatcaagttcaagtcctgtgacttcataatcatctttcaaagaagcatgtgaagcattaagaagttctccaaattttgtcaaattacctgcaacaaatgctttttgagcaattttagttcgattattttcataaacggcatgacgtgcacgtttaattaatgtttcatccccaatcaaatcagtattggcatcaaattcttcatttgataattctccaagtgattgaatgtccaatctcgtttgcattcttttgagcgcttcacgtgtttcagcaaaacgttcgttgtattttgattctgtcaaagcccgcggtttgttagtattcatgataacaatatcataatcacgaagttcaacaggaaccatctcatattttagagtgttacagtccaataggattgcttttttgacttcaccaaaaccaatagcgaattggtctaaaattccagaattaacaccaatataatcattttctgttttttgtcctaattgaaccaattcaagacgtggaacatttaagttaaataaatcatccaaaacaacgccgactaaaagctcaagtgatgctgatgatgaaaggccagatgctgtaggaatttctccttttatcaacaattcaaaacctttgtcaatttcatatcctgctcctttaagcatgacaatcattcctttaacataattagaccaaagctcaccatctttcttttcaacttcatctaaatcaaattcaatgacgcctaatttaggaaaattttctgagtaaagtttgacttttttatcttctctcagacgagctagtcctgttgttccaattgtgattgatgctgggaaaacatatcccccattgtaatcggtatgttcaccaatcaaattaattcgtcctgggctaaaaaagtattcaacttcttttgtatctccaaaaacttctgcaaatttttctgttaatgctgataatacagtactattttctacaactatagacatttcttctctcctctaaatttatttctttattttatatgcaagctataaattgtggttgcttgatatttttctcccgcttttaggctgatatctccaagctccggaatttgctcagacccaggtgaaacttgacattcaaaagtaattccaccatggtgcacctgctttttcccatgataaagagttcctaaatcaccaaaatttgctgtaaatatcacaatacttggttggtcagtaaagactgaaattaaagtatcatcaagcgttaaacgagcttgttctttatcaagtcctaactggtctaacaagaaaggatggtcaattcctttaactaattgaacttgttccatattagaattgagggcatttgataattgtttttcctgacggaaatccaagtctgtattttttatatcaacgatatcaccacgaacaatttctgtttggtcttttaaaggaacaaatcttgaagcggccagtcgaagtccatgattttcaacagattcactagcatcaccattcaaattaaaatagacatgcccagttggattaaacacagtgtctttatcagaaatggcctcataatgaattttccacttattgtcatcatcaaaagagtgagttactgacatttctattttaccaggataaccatttgttccgtcattagaaactaaggaaaatttgacttgaacttcagctcctaaatcggtaacttcatatgtccaaagtttagtatgaatactttcttccccaccatgtaaggtttgagggccttcattttgatttaagatataatcttttccagaaattttgaccaaaccatccttaattcttcctgctgtgggtccaactgttgcaccaggataggcatctttttctaaatattctttagctgaatcaaagcctagaatcagatgctttccatctttttgccagtcaacaatccgagcgccgagatttgtaaaagaaattgtgacacctgctttattggttagactaattaagtcacttcctaagccaaaatctcttattttaatttccatgatatttcctaactataatgacctttaatcaaattttaaaaattctactgacagatttactgatgaccttttaaacgaatttcatctttttattttctatcttacaaaagctgtcagtaaattatttacctattttaaacgttcttcgagttctgcaacaatttcttcgtgacgtttttcagtcaatttaactttgaataaataaattgctaaagcgataatcatcaaaatggctggaactacaaatgagtagagtttaaatgttgccacaccgtaagtgtgaccagagatatattttgaacctgtcattcctgctgaaattgccacaaatccatagataccatttgagaaagcaccggcaattttatcaagcaatggacgcatggcaagcgttacggcttcattacgtactccatttttccattgaccatattctaccgagtcagtaattgtcattaatactgacaagaaaacaagttgatatggcgcagttaagaagattaatccagcaacagtcattgctaccgaacttcctaaaacgaacaagagataaccaagaagcattgaaatgattgctccagtcaaaactttgcgtcgtccaaattttttagctaaaatcggaaacattggaacgagaatgattgaaccaatgaatccgacaattcctgtaattgaataaagactagcatttccaataacaaaagtaaagttcaaaatcaaagttgctgttgttgccacataagcaatggcaaataaaatatatgaaagtgacaaccacattaattggtcattttttaggagcgctttaaatacatccaatgtatttgttttggttccttcttgacgaataactgatttttgttctttagttccccaagcggttaccaaagccgaaattccttggaccaaagcggcaataacaccaaaagcaaagaatcctcttgctccttgagcatgtccacctttagtaaagaaaattgtgattggaatcgctaaaatagttgccccttgcgcaccaattgctgagccaaaacgggcgaaagttccaagtgtttcacgttcagaatttttttctgatagcgctggaatcattgaccagaaggcaatgtctttgaatgaataaaaggcgtcaagaataataaaggcaatgatgaagacaatggcaaataatgtacgattatcactttttgctagtccgaagaagtctgaaaacatgagcataatcatcaaagatgacataatcccaccaacaaccaaccaaggtttaaattttccccatcttgtgtgggtattatcaataattgaaccaatgattgggtcaaaaataatttcgattaaacgaataataacgactaaaccagtgactaaagcaatcatcgcatcctcatgtggtgtgccagcaaacatttgtgccgttacaaaggcgatgaagaatgtactaattgaataatagtaaacatcatgtcctaatgcgccaaaagcgtacgataaacgttgtttcatttttccctctttcatggggatcctcctttatactaaatctacttaattcataagtaaatctacaaagctactgttttgccttttgaaacgagtaatccttggttgggaaaacttttattttggataagtttttaaaagcgaaacagtcttcaatttcattttgaaatcgctcacatttagagtataacactttgatttaagaaagggtttccaatttcagcttatcttttggaaaccctttctattttgctctttttataaaaaaaagctcgatatgacttgatatcgaagcattattgttttaaagtataaatggagtaagcatcaattagaactcttgataaaatggataatgagagtctactatgaacatctaaatcaaaataattcacctcaagactactcttgtatccaatcaaacttatatccgaaagattggtcagactggtattagcattaacagttaaggataatattttgggattttgtcctttggcaatatttagagcatttaaaatttctactgtttctcctgaaagtgataaaacgatgattaggcttttttcattaacaaaacgggcatagtaagccatgtattttgaatcatcatgcaaactgacgggcttacggaaaagttgcaactttttcatcagttcgtcagcaacgtttgttgataagcctcgtgaaaaaattaagatttcctctgattcttgaatcaactccacagctttttcaatttcttcagcagagatattttctattgttttcaaaagttcttcttgatttttagcaatagcccccaagacttctttggaaaaaccattgatttcaggaagttttttctcacgaatcgaatatctaaattcaccataaccttcaaaacctttttttcttactgttcgattgacagttgagagagaaacatgagccaattctgccaattctgaaattgataattgtggaattttctcatagttttcttgaataatttgccaagtataggattcagcattggttaaattggacatatttttactccattgattcgcttgttgttatcaaaaaatgttttctatcctaaaattataacatttgacgcttacatttgctataattccctgaaatcgttttatatttctatttttaaggagaaagtgatgacttatattcccaatcccactcgttataaccatatgatttatcgtccagctggaaaatctggtttattattgcctgctctttcattaggactctggcataattttggttcggtagataattttgaaaatgcgagagacatgattcatacggcatttgatttaggaattactcattttgatttggccaataattatggaccaaaacccggttcggcagaacgtaattttggtcgtattttgaaagacgatttccaaaaactgcgtgatgagttaattatctcaactaaagctggttatctaatgtggcctggcccctatggaaactggggcagtaaaaaaagtttgctggctagtcttgatcaatctttggaacgcttgggacttgactatgttgatattttttattcacatcgtcctgacccaaatacaccgattgaagaaacaatgggggctttaaaaagcgctctggatagcggaaaagcactttatgtaggtttgtccaattattccgccaaagaaaccgaagctgcggtcttagcggctgaaaagttaggctttaaactcttgattcatcaacctcgttattcaatgctagatcgatggattgaagatgatttgcaagaaactttgacggaggcggggataggaacaatcgcctttaaacctttgtaccaaggactcttaaccggaaaatatttacatggtattcctgaagattcgcgaatgcgtgaccctcattatgcaactttgcatgatgacagtcttacgaaagaaagattggaacaagtccaagcgcttaatgatttggctcaaagtcgtggacaatctttagctcaaatggccttggcctgggttttacgagaaagagatgacaaggttcaaggcatcacttctgctttaattggcgcaagccgtccgcaacaaatcattgaaaatgtggcagctttagaacatttgaaatttactgacgaagaattaattaagattgaaaagctcttataaagaacaaaaaagttactgacaaatctgtcagtaactttttattttctaaataaagctgtcagtaaaattaatagctcaatcggtcaatttttacaccagtatattcgtgaacagcatcaattgcatgatgataacgtgttaaatatccttcctgatcacggtgatctccttcgtcatctaaaataacaactttatccattaaaccaaactcagctaattgacgcatcaattcttcatggaattcatgacgtgattcttcccattccatatgacgaaagccgtcatcaatatattctgtaattggtggaatgactaaaattaaatccattcgttcatctgcaattgttttcttgaatagaggttcaagctgctcgaaatcttctctaggtaagtataatttagcgtacactctggtcacaatggcatcagtatctaaaaagacaattccttggttagcaggagaattgacttcgcgagaatttgcatcatattgacctgtaatcattcgagcatagtcatccattttcaactcatcatcatcaatattaaaagcttcttcatattctctagcgtattcttctgaaaacggggcattaatggaacgtgccaaacggcgaacaagggttgatttacctgttgaagctgaacccatgacggttacaattttcgaaaaatgtcttctaaagacgcgattaatgtgagtccagtgttcttgcggattttctctaatttgtgtagctgatagtgaaatatcatgtctgtcagcaatttcaacagcatattgattcccgtcagctggaaatcgtttcttcaattctactgcgtattctaattcgccgacataaaaagtgactgataaatctctctccaatgtattatgatgaatcaattcaaataaacgatttgcccattcgtcccaaccattaggcatttctggtaaatcattttcattaagcatcgaaactttaatattttcttcatcattaaaagcttcacgcaaataacgaaatcgtttctcaagaggtaggccaatttgggcaccacggtcattatcataaccggaaacgacaagcaagaccccgtcattcaaacttgcacatttatagatttgttgctgatgccccgtatgcagaggagcaaaagttccaaaataaataccgatattttttccacttaattttgattttgaaatattatttgtgagcatttcgtttatatcctgttttcatatcaacaatattcgtcaattccttaccatttgcataggcatcgagatttttttccaatattttcataaagcgacgccatgtttcaggaagagtataaccgcccgaagcatgaggagtgattaatagtctttctgtatgccaagcccggtgacctttaggcaatggttctgggtcggtcacgtcaattcctgccccagcaatttttttagactcaagagcatcacacaaggcttctaaatcgacatttgttccccgaccaacatttaggaaaatagcattttctttcattaaatcaaatttttcttgattaaataatttataagtttcatgggtcccagggacacttgaagcaataatatcagctctcggtaaaactttgtctaggtcagtttcggcatagacttcatcagcaaattcttcatcaccataaacagttcgtttgactgcaatgacatgacctcccaaagcttgaatcttttgtgcaaagtgacttccaatatcacctaaaccatgaaccaatactgttgagccataaatagattgaatctgaccaatattttcccagatttctttttcttgttgtttttgataaaggtcaaattttcttagaagaacgaaagccattgttagtaaatgctcagaaatcgtaagtccataagttcctgttgcatttgtcaaaactacctcttgaggaaaatttgctccttgagtataaccattggttccagctgataaaagttggagccattttaaatttttatattttgctaataaatcaggctttggcagaccaactaatacttctgtttccagaaaatctgattctgtcagctcttcttcttttttaaattgaaactggtaagctttatttttcttgaaagccgcttttgtttcatctgaaaaatttaaccaaacattttctaaggcaattgcttttatcattgggactcctttgtataaaatgaattttaaagactacttaaagagaataaagtcaagccttgttttctttatcttctttctttgattatagcactttgccttaattttataaaaaatagaagtttgacaattctgaaattatcagtcctaaaatgatataaaagagaatttcagcaaaaattctctttttatttttattaagctcgtactgttttagcaagacctgtttttttatcataaagattaatcaaacctgagccatttttacgaatcatatcccctgctttaaccgcaaaaggaacatcaatatgtaaaagggtcattgggtttggtgcacggtcaatatgttcatctgtttctgccaaacgaagatttttgaccactgtttccacgtggcggaatcctgggccataaaattcaatttggtcaccttctgtaataacatttctttgacgaattgtagctaccattgtttcagcatcaaagtcaacaacttctccgacgaacttgtactcaggaattttacgacgagccccaaagagttgtttattttcatcaggcgttccataataaaagccagtatctaattcacgttgagctactttccataattcatcaactaaggctggttttatttcttcaaaacgttctggtgattccaaataggcatcaatagctgctttataaacgttagaaactgttgaaacgtagtgaattgatttcattcttccttcgattttgagcgaattaactccattttcaatcatatcaggaatatgttcaatcattgacatatcaacggctgacattgaaaattcttcagtgacttcaccggtaatcgattttctctcgccagcaaatggcatatcatataaatcatatttccaacggcaagattgtgaacatccaccgcgattagcatcacgcatactcatataatttgacaagacacaacgtcctgagtatgaaatacacatggctccgtgaacaaaagcttcaatttcaacatcagtatgttgacgaatttctcttaactcttctacagaaacttcacgcgctaaaactacgcgttcaagtcctaaatttttccagaattctaaggtttcatagttagtagcagacgcttgtgttgacaagtgaatggccaaacctggtgcttcagcagcgcagatggcaatcaaagcagggtcagaaacgataaccgctgaaattcctaaatcacgtaatgtacggaaccattcgcccgcccctttttcattcccttcatgtgtcaccatattggctgctacataaactttagcgttgtgggcacttgcataagcgaccccttcagccatttcttcaaaagtaaaattacctgcgcgtgaacgtaagccataggcttgtccaccaatatatactgcgtctgcgccataatcaatagcgacttttagtttttcgagtgttcctgctggtgcaagcacctctggacgtgtttttgtaattgacatgtttcaattctccaattttcaagattgtaagtattttgaaaaggctccaaaaagaaaaaatcttagtcaaatttattgtcagtaaatttgcgagccaaaacttctttgtttctttattttacaggatttcttgccaaatttaaaccttcaaatgtgacaaagttctttgacattatgttgcttatctctcatttttactgacagaattattgataaagctttttacatttctgtcagtaaatcctctatttcaactttattttcctgattttctcatatcatttataacgaaaagaataagtgccccaataatcaatatgagcgtcaaaattattttttctcttgttcctgggttaaagaaaaaaataatgagccagacaatcagtattagcaccggaaaaaaatattttgaaatttaatcattattttctctcctcaagagttaattaaaagttttatgaattttctttaaaattatttataaatgatttacgaacctttgacaatagtttttcatcaaaaaaaagctgtcagtaaattaacaacttctttcctttttttatttaatggcatctttgtccaaatcatagaaaccgtgtgataatgtccgtcctgctggatgtatttttcggatttcttcatctagttggaaagccttaagttctgtaaattcgcctgcttcaatcagctttttagcttctacaaaaagtttgcttatcgctacaaaatcttcaccacgagtaaaaattccatccaatttccaatggtcataacccattgctactaaatctgaaagttctgtcatcatatctaaatcatcattagcaaaaatatgcgtcccgtgattatcttcaaagattgaataatgtgtatcaactttcttaggttcagagacaaaaagatttctttctctgtctttgcctttttcctcagtcttgatgaaattataatagttttgcaccaatggacgtttgctatgatgaatcactgttgcaccataaactaaaatttcgcctggtacagctagttcatcggtcatatcagcaagttcttcttttggcaattcacgtgcaagaacagcttcaattgccccttgtttggcccaaaaattaacttggcgggcagaagcaaccatggttgaggcatcataagtaaatggtaactcatatttatcacgttgcaaaacaaaaatcacacccgcatcgcctactgcaattcggtcagctttaatttcaactaagaaatctaaaaaatcttttatttttgccatcatctctgtatgcatcagagcattgaccgcgacagtcactgtctttcctgcatcatgtgcaagttctgtaattttttgaatctcttcgttggttaaggcagttggtacgcgtaaaccataatttttttcaccaatgtataaacggtcgactccagcttcgagcaatgctttagcttgctctaggctttctgccgtagaagtaatagtaatcatagtgataattatatcatattgttctcttacacgttttttctaattcatcctcttactaaaatttactactcaaaatgatatttattcataaaaaagtataggttaattttattttaacccaaactaaactaaatggtaatacatttaaattctgggtaacgtaaacctgtgctttttatactataattgattacataatataggaaagtgctagaaaattatggaattaaagaatttaaaagatttttatgagaagcaagaatatgtcgattataacgaaagtaaaagttttgagcaaagacaagtcaacaaaagaattgaagaattaagcttcttcactaatattgctgttttctcaatttttcttgtttttactacttacattttggtgagtttattggcaagctggattgctattccagtttctattgttctctcgcttgctctttatatttccgtgaaaaaaggaattgctaaagcgattaaatttatgatgaaataaaaactgcctaatagacagttttttttattttattccaattaaaatttgcacatgaattctcgctgtttttggcggattttcctttgcaaatttttttctttcctcagaaactgaccattctaatggactcatcaataagaaatcttgacgcaaattttctggaatttcaaaagtataatcaattgtttgttgagtattcttaggaaattcttctttaaaatgctcaataactgcttgattatcataatcaactggaagttgataaacttctcgcaactcacgtaaataatttctgtcaggaataattttaatgacccggccattttctgtcagaactcgatgaaattctgcataatttgaaggcgtaaaaatattcaaaattactgacagactttcgtcagcaaaagggagattagttaaatcagctaaggacagaaaacttttcgtatctaattcggttgccatttcaattccatctttagcaatatcaaaagcaaacttcgcgcccgcaccctctaggagttctaaaaatgaaccttcacctgttccaacatcaagtaaatttccactgacaaatgatttttgaatttctgtcagtaaattttgatacatccctgcttgaattaggcgtctacgtggttcaaacattttacgcgtataatgctctgtgtcagcttttgtttgtaaaaaactaacataacctttcttgtttaaattataagtatgattattttcacattttaaggcataggctgccaattgaaattttccatgacaaattggacatctcaacatttccacattttcttctaaaaataaataagctttttcaattttttttaacatagttctattctagcataatcactttcattctttttattcaaaataattcttgtaatttttttaagttaaacaagataatcatgttataataattttagtagatgaaaggaagaaattatgattatccgagaactttgccttgaaaattttaccaaaattcctcaagcgcttcaagccggcgttgagagaattgaactttgcgacaacctcgcagttggaggaaccactccttcttatggtgtcattgaagaagctgccaaatatgttgccgaaagtaagacaactcttgctgtcatgattcgtcctcgcggtggtaattttgtttataattctcatgaacttaaaattattgagactgatacacttaaagctgttgaagctggtgcccaaaacattgtatttggtgcccttactcctgacaatgaaatagatactgacgcacttgaaacagtgagcattgccgcacaagggctcccaatcactttccacatggcttttgatgaagtagctgatcaagaaaaagcaattgaccaacttgtcgaatttggcgtagataaaattttgacgcacggtgggccacttgatcaacccttaaatactgacaaacttaaaagtcttattgactatgctaagggtaaaattaacattattattggtgggggtgtcaatgctgaaaactttgaaaacctcgctcaattaactggaacaaattatgttcatggtacaaaaattatcaaattataaataaaaagttactgacagacattctatcagtaacttttttatttatttttaagtcggaatctaacataaaattttgtcagtaaaaagttcgtaagtaatataatcaaactcaagaaaaatggtcgaacaaaaattaatgacagaatcaattcaacaattgtcacaaacatcatcactctaaaaataagcacccgtaagccagctgttttagccgcttttttcagtggataaattcttgttaaaagttgataatcaaaagccgtttgtaatgataaaagttgaaaaataagcaaatagttaaatacaaccagcataataatggcaacaattccattattaataaaaatcatcgctaaaattgacaaaataagtaaacgaatcgttaaaccaagataatctcctgagcgtaaaaaacttcttgtaaatagatactcataagttctttttgttttcgtcagtagaaaatcaagatatttccgacgatgactgtgtgatttaagtcccttaacattcgtaaacagtgaaaataatcttaaagttcctgtttttcgtccttcttctaaatcaatcaagaaagcccaatccaaaagtccacttttttgagaagtccaaattttgtaagccaaccaagccgctttgattgcgacaagtaagacgaaccaaaggactaagaaaataggattaaatcttaataatggagcagcaatcaaaaccaaaagtgctgacacaactgctggaataatcaaagagcggattaaacattttactaaatatgcccgaacttccatttcttttgtcagaaaaaaaactttatctggactctcaataaatgttgccaaacgtcccacaatttgactagccaaactgaccaaaacaactaaaataattttgccccataaattcagctgatgaatttgtagaaagttaatgtactgaaccaccaaagctcctaataaaatcatcaggaacaaaacaaaatggtcattaaatacataacgaagatattttatattttgcttataccaaaggttacgtcgttttttaaaaatttcattcatttgactttcctgcctctacaacttctttagagtttggaatatttccttttgttaaggcaagataaatttcatctaaacttgccttaggctgattaaattgagtccgtaattcttctactgttccaaaagcaacaacttgaccttcatgcaaaacaataaatttatcacagaatttttcagctgtggacaagatatgtgtactcattaaaatcgaacttcctgattttttcatgtcaatcatcaagtcaatcaaatcctgaatcgcaagcggatcaagtcccataaaaggttcatcaacaatatagagcgaaggttccactaagaatgcgcagataatcatcactttttgtttcatcccttttgaaaaattcacagggaaccaatctaatttatcactcaagcggaaagtttctaataatttttcagcacgttcaaaagccaagtcaacagaaatcccgtaagctaaagctgtcacttcaatatgttcacgcaaagtcaattcttcatataaacttggtgtttctggaatgaaaccaatttttctacgatagccttctaaatcttgttgtaaagttaagccgtctaattcaatttgtccagaataaggagtcaaaagtccaataatttcttgaattgttgtcgattttcctgccccatttaaaccaatgagtccaactaactcaccttctttaatttcaaaattaaggtcttttaagacaggatgccccaaatagccacctgttagatttgttacttttaacatacattcctcttttcaatcttattctatatttattattgaagtcattcttaaaatacgttgcgcatagctcggattatcatcatcctcggcgataacttcttttaagtcatcaagattatctgtaataattccatctactccattgaacatctgttctctcatatccgtttcgtcattgaccgtccaagcaaaaaccatctgctctcttgcctgagctttatccacaaaactactattgagtgttgtggcctccatggtataggccgacatcttagtttgtgggaaaagtaagttgaacggaaggatgaaactcactttaatcttaggattaattttttgttcaattaaaagagcattataatctaaagaatgaatcatagccttatcttttaaaagacgtgcaccatattttttactaaaattttcaaccatctttggagaatcaaatggagatactttaatctcaaccagtaatttttggttaactttttcagcagccgctaaataatcatcaaaacttgggattaaagcctttttaccattttccgaaacaactgtattcgtcaattctgctaaggtaagtttttgtggcggagtatcaattccagctaaatcttttaaagttggatcatggaaaacaacaaattgatggtcttttgtttcctgaatatccatttcaacataatctggttttgatttagccgtagcttgcatggctggaattgtattttgcaccccattttcttcatcaactccccgatgtgaaatggttaaagggacagtatccataaatccttcaacataagtccagctcactaaagcaaaaattaaaacagctaaagtagaaaaaattattttatattttcttctaactttcggagatttttttactacttctgaaatttcaaaggcttccaagtcagcttctcttatcaagtaactaaaaagcatgaccaaactcaaggtagatataatagagcttcccaaccaaatcaaatccagtattgacactgctcccacaagagcaaaagaagttttatccaaataatcttgggcaaagtagccgcccataaaaagaagcccctgcattattatactaaataaaccgataagtccaaaataaacagatagtctgaaaaaatttctaactccttttgttcgttttaaactttcttttattgctactttcaatgatttaccttttaaaatcatcagtggaagagtcaaaattaaacgggtactaatccaaaatgttatagcataaaataggaacaaaattagcatattttgccaacttttaaagaaaaattcaaatgtaaaaacaggaattttaattttcgacaaaagtggcgtactaaaaacataacgtccaaaaggaataattaatagaaaataaaatacaaaaaagactaattgttgaattctgacatttttaagatccgaaataacttgcctaaataaactttttaaactaaaagttctcgcctgaatcaaacgaattccttgaaactgaacgatgaattgcagataaaccaaaaagatgagcacaaacaagacaactacgagccccaaaactcctaagaaatgctgctgaaacaagtttccaagattattataagaaacataaggaattccactaactcgcataataagctcagaaatggattctaaaagtggaataataacaagtgtgatgactatagttgccccaacaaaaatcgaaagatattcaaaccaaaacttaaaaaactctcgcaaatatttaaaaatcaaaccaagtggccgattagcattctttttcttcttagctttttttctcaccatactcctaaactcccccatactttctctaaacagaagaataattttcattacattatatcaaatttataaaataaaaaatgcttagatttaagttataataaataaaagttttatttattataacatatttgaatttccctttttcggcaatttccttacgatttagtaagtttcagcattattactgggatttttagcttatttataatataatctaagtatattataagttttgactttgagtaaagagtcattattactactggaggacctatcaaatggaagattgtattttttgcaaaattatcgctggtgaaattcctagcaccaaaatttatgaagatgatgatgttcttgccttccttgatatcactcaaacaactaaagggcatacattagtggttcccaaaaaacattatcgcaacattctttcaatgacaggcgaacaatcagctgaacttttcagcaaggtcccttttattgccaacaaaattgttaataatcttcatgctaaagggatgaacattttacaaaataacgaagaaatcgctggtcaaactgttttccatactcatattcaccttattcctcgttttgatgaaaatgatggtttcgttggaaaattcactgctcatgattatgatttagctgaaattgctaaagaaatcaatgaccaataaaaggacattactatgattgaattatttaaagacttaaaaaatatcattggcgagttgtcagaagaagtcaacacgatgaaagtaaatgtggaacgtgttcaagaagaaggtatcaaagccgaaaaagttggaaaagatattcaaaaaaaagtagatgaatttcaaatttccatccaacctagagttgaaaaaattaatgaacttgttaatcaaataaataaaagagttgaataatttcaacccttttatttttttgatttttcttgatgtttataaaactgtctcccccagaaaatccccaataattgggacaagacaaaactaacaactatgaccagcattttttcgacatcatgatgttgaatgtaagtaaaggtatgttgtgaaaaatatagaatacttatgaatataatattaataatattcattccaataattcgccaatgtcttcctttggtactttcccaaaaactgataaaaagaatgagaatggtaacgacctctaatccaatcagcgtcaggtttagaacttgaaaaagataggcaattgcaaagataattgttgtataagcccatataaataataacatacctcattctagcatgtttttttatattctacaataaataaaaaaagagaaaaatatttttctcttttttattgttattagaatgatgcagaatcaactttaacaccaggacccattgtagttgtaacagaaaggtttgtgatgtaagctcctttagatgcagcaggtttagcagctgcaattacagagttcaaagctttaaagttttcaacaagtttttctgtatcgaatgaaactttaccgattggaacatgaacgttaccagctttgtcagcacggtagttaactttaccagcttttgattcttcaactgctttagttacatccatagtaactgtaccagttttagggtttggcatcaagttacgtggtccgaggacacgtccaagacgtccaacaacagccatcatatcaggtgttgcgataacaacgtcgaagtccaaccatccaccgttgattttagcaacgagttcatcagaaccaacgaagtctgcaccagctgctgtagcttcttcagctttcgcacctttagcgaaaacgagaacacgagcagttttaccagtaccgtttggcaataccattgctccacggatttgttggtcagattttttaacgtcgatgttaaggttgtaagcaacttctacagttgcatcaaattttgcaaatgaagtttcttttgcaagtgctacagcttcttctacgctgtataatttagttgcgtcgattttttcaatcgctgcgcgcaatgctttactttttttagccatttctattttctccttgtggtaatatcggttgtctgtcttccttgttgcgtttgaaaattcgctctgatgcgctcaaaggaaaatattcccctccaaacacggtctttatactaaacgtcggaagctattttctcgctcctcgccgctcagatgaactaatagtacttttataacaacaagagtaacagccttccactaaatgtgtggattgcatgtgtgactttttctgaatttacaatatgtaaatctcgaaaatttagtcgaagtacgaggcgacaggttccgaagcctacctaagtaggtgagggttctgtcaacgaagtaattcgtctaaatttttagtcagtaacagtgaatcccatagattttgcagtaccttcaatcattgacattgcagtttcaactgatgacgcgttaaggtcaggcattttgagttctgcaatttctttgatttgtgcttttgtaactgaagcaacttttgttttgttaggttcaccagaacctttttgaacgcctgctgcttttttcaaaagaactgctgctggaggagtttttgtgatgaatgtaaatgatttgtcatcataaactgagataacaactgggatgatcataccagcttggtcagctgtacgagcgttgaattcttttgtgaatcccatgatgttaacacctgcttgacccaaagctggtccaactggtggagctggtgttgctttaccggcagggatttgtaatttaacgagtttttctacttgtttagccacgataaattctccttatattttgttttcgtgatgtggtatgatgctgtattttacagcttccacgccgtgcatgtgaaaattcacatacctgagtattttatcaaaaaaaaggactgatgtcaacttttctttgtttacgaaaggttaattttcttgatgactatcaatttttttaagttgcaagtaatctataatagaactatcaaaccaagaaaggttaactcatgaaacttcaagctttactaaaaaaatatagtaatcaattgactggtctttcagccttattaattttaatcgcttatagtggaaaatatcttttgaattcttattttctttgggcctttgcactcttattagctacatttattggtctcgtcccaattgcttttcaagcagtccaagcacttaaattcaaacaagtttcaattgaattattggtatcaattgctgttattgctgctctttttattcaagagtatgaggagtcagcaattgttacttttcttttcgcattcggagcttttttggaaaagaaaactttagaaaaaacacgttcttccattaaatctttgacagaaattgctccctcaaccgctcttcggatttctggagaagtcattgatattgatgatgtcaagattaatgacgaattattagtaaaaactggcgctcaaattcctgtagatggctctatttatgagggggctggttttgtcaatgaatcaagtattagtggggagtccgctgaaataaaaaaaggaatcggagataaggtttttgctggaacgcttcttgaaaatggaactcttttgattcaagctgaaaaggtaggagaggataccacctttggtaaaattattgaattagtggaagaagcccaagatacaaaatcctctgctgaaaaatttattgaccgtttcgcaaaatattatactcctagtgttttagttctctcttttttaattttcattgtcagtcaagatatcaagttggcaattactttattagttttaggttgtccgggtgcccttgtcattggacctcctgtcagtaatgtcgcagggatagggaatggagccaaaaagggaattttaattaaaggtggaaatatcatgactaattttagtcagactgacctgcttctttttgacaaaacgggaacacttaccaaaggaaagactcaggtctccattactaaaaattatggcgcttctaccgaacttatcaaccaagtcgctatgcttgaaagtcaatcagatcaccctttagctaaggcaatcattgatgaaatcggtgaatttaccaaagtacctcttcaaaatatcgaagtcataaaaggacaggggatttctgctgaccatttattgattggaaacgaaaaactccttgaaaatcataaaatttttttaaacgctcaacaaaaaaatgatttaatgaaacttcaaaaacatggactttcaacagtattaattgctgatgataaggtgcgtttactttatggaattactgacgaaatccgaccaaatgtaaaagaaacattgaccagactcaaaaaacaaggaattaaagagctgataatgctgacaggcgataatgaaagtaccgctcaatcaattgcacaacaagtgggaatcagtcaggtttacgctaatctcctacctgaagacaaggcaaaaatcgtgcaagactataaactagctggtaaaaaagtagcatttataggcgacggtattaatgatagccctagtattgcacttgccgatgtgggaatcgcaatgtcatctgggactgacatcgccattgaaacttcagatattgtccttatgagttctaattttgataacctttcttatgctcattcccttgcaaaaagtacaaggaaaaatatgagacaaaatattttaattgctctctttgttgtaatctttcttctttccggattaatcttggggaatagttcaggatttattggacaatatgtcaatatggcgactggaatgtttgtccatgaagcaagtattttattggttattctcaacgcaatgcgtttaattcctcataaaaaaatactatccaaaaattttcctgtcgcaaatgactaaaaataaggttataattaaagaaaatctttcaggaaaaatatctactcaaataaggagaataaaatgactttagataatcatcattgtgtccaattagttccactctttgaaaaacttgctgaacaagatttaactaaggtcgaaaaaattgttgaacacaaaaaaattaaaaaaggtgaaattattattagccctgacaaagagcctttattagtcattgtagctcaaggtgcacttaaaatttcacaactttcacaaagtggcaaagagcaacttttaagaatcatcgaagcaggcgattatgaaggcgaaggagccttacttggcgtgactaacggacaactttatggtcaggctatgattgattctacgatttgtttcttgcgtcaatctgattttgagacattattaacgacttatcctagtctttcattacaacttttaaaacttaatgctaaaaaatatctagctgctgagcaccaagcaggatttttggcactagatgatgttgaagcacgtcttgcacattactttttgaatctatctgccacttctgatagcctttattttgaaattccaatgaaactcaaggagcttgccaattatatcggaaccagtccagaaacaatttcacgtaaaatcaaggtttttgaagaaaataaaattattagccgtcaaggacgaatgattaaacttttggataaggaaaaactagaagatgattttgcttaaaaattttacaaaaaaatagagtgagtcaactctatttttttagaaaatatttccaaattactttaatttaagcttctaaataactttcccaaatattatcaaacagggtaagattaaaataaaatggggcttgggtttctaaataagtcgaaatttcatcaaaatctttagactgttttggaaaaagcggatcttgaaaaactaaatttgcaagacgagttgcatcatctttttctactggtgcgcgatggcgcataaggtaattataaaaagtcattttctctttctattatcattaagtcggaaaattaattatttttcccattgtttttccaaaaaatcatgacgaattttacttgattgagcataatcttctggattttttttgtaaaatccttgatggtagtcttctgctggccagaatttttgaacggcttcaatacttgtcacaataggtgaatcaaaatttccgctggcttgcaattgcgctttgctttctttggcaattttttcttgttcttcgttttcaacaaaaatgactggacgatagttatccccacggtcttcaaattgaccaaaagcatctgttgggtccgtgagtgtccaataaagttcaacaagactttgataggtaattttactattatcaaaaataatttctactgcttctgtatgaccagtcaagtgtttttttacttgttcataagttggattttcaacatttccacctgtatagccacttatcacagataaaatcccttctcgttcttcaaaaggttgaaccatacaccaaaaacatccacctgcaaatattgctctttctgttgccattatttctccttcactttgtttgtcttgtgaaatattatagcatagctcaaaaaaaagtagccaattaagctacttttttactgacagaaatttttataagtcatcagactgacagaatttactgacaaatgcttttaaattaagcttagtatttctaaagaagctgtcagtaaattattctccgattaattctgttccctctggactttgtttgatttttttagctttcatcaaaccaccaagcgcttttttgaattgtccttttgagattccaaaagttgcttttatttcatctggatttgatttgtcattaaatgccattttcccgcccattgattgaagataagctaaaatcatttggctatcagcatcaagcatttcataagcacgtggttttgctgacagatttagactacggtcttcttttctaaaaccaataacacgaacttgaagttcttgaccgacacgtgggactgagaaacgttcatttggatgaataaatcctagcatattgttgtcaggcaaataaacaaatgttcctgattctttatttcgataaacaattgctcgtaaatcttggttttgcatgttgtcataaccaggacctgcaagattccagaaatcttcatgccaagctaaatgaccccaaatccgctcttttctgtcaataattaatttcacataaagttggtcaccaacttttggccattggtctttttcgagtggcaaatcatcaagagagacaaccacatcttttcctggtaaacctgtgtcaacaaaggcaccaaggtccttacgaacagctgttaccgttccccaaccataatgctcatttgttgctttttgttccaaagtcgtcaaacgacgatggtcatctttatccacataaacaaaaccagttaccacatcgccaactgtatgttcaccttctgttttatctaaacgtaataaatcttctcccttttggagaaaatagaaacgttcactttcttccacgattatcgcggagattgtttgtccaataatactcatttgtacctctttataaaatgtgattgagagactatttgtctctgtttaattgatatttccttcgtaaatccgtgatttttcaccccaaggatgatagccgtcagctagatgatgaaaatcaaagcgctcatagaaatcagcaaaatccgttgcaagataaagtttatcaaaatcaaaagttctgcaatcttcttttactgcttcaatcaacagaccagcaagaccttgctttcgaaatttttcttcaacataaagtgcacaaagccaaggatataagtccattcgactaataaaatcattgctaatcagtccacaacccgcaataatttttccttcatcaacaatcagataccactgaggaatgtttttgttactctctaaactatgcttcaaacagtcatcatatacagggttactgtccgtatttccccatttttcctgaaaaaatcgaattgcttctttgagataagacggttgctctctaagtttgattagttctctcaaatttatccatcctgacagatttttgatgtaaaaacggctcaatggagccgttaatgcttttacagattactttatttgttagattgttctacttagatatccaacaattctttttctttaattgatgcaagacggtctgcttctttaactgcgtcatcagtcactttttgaatgttgttttcaagatctttaagatcatcttcagtgatttcttttgctttttctgatttcttagcagtgtccattgcatcacgacggatattacggatcgctacttttgctgattcaatatatttacccatttctttgacaagttcgcgacggcgttcttctgtcagcattgggataactaaacgaatcacagaaccatcatttgctggtgtaatcccaagatctgattcatacaatgctttttcaatatctttcaagattgatttatcaaaaggagtaaccatcaatacgcgcgcttctggaattgtgattgacgctaattgattgagtggtgttggtgcgccgtagtaaacaacttgaacacggtcaagaagacttgcgttggcacgaccagctcggatatgtcctaaatcacgttgtaaacttcctaatgattgtttcatccggtcttgagctgttgtaacaatttcgtttgccattttatttcctttttctacttttaattcttctatttattttactgacagaaactttgtcagagataagcgttagtattttaatgattacagttatgctagtatttccatcagtaattttttaatgaataaatttactgacagctttttttgtaagtaaatcttattcaaccgttgttccgatttcttcaccacgaacgacacgtgtaatatttccagcttcattcatgttgaaaacaacaagtggaatatgattatccattgacattgttgaagccgtactgtccattacttgcaagcctttggtaataacatccatatgtgtcaaatgttcaaatttaatagcatcagcaactaatttagggtcagcattataaacaccatcaacaccatttttagccattaaaatgacatcagcattaatttccgcagcacgtaatgcagaagttgtatcagttgagaagtaaggcgaaccagttcccccagcaaaaatgacaacacgtcccttttctaaatggcgttcagcacgacgacgaatataaggttcagcaacagctttcatctcaatggctgtcatcactcgtgtgtcaaccccaatattttcaagagcactttgaatgaacaatccattttgaattgttgcaagcattcccatgtaatctgcctgagcacgctccattccggctttctcaccagtaactccacgccaaacattaccaccaccgcaaacaatcgcaagttctgcgcccaaatcatggacttctttgagttcttcagcgacagcttttgctgtttcagggtcaaatccgaaacctttttcgcctgagagggcctctcccgaaagttttaacagtacgcgtttatatttaatttcagccatattgcacctattctattatattttctctattttaccataaaatgctcacgaaaaaaagactaatcaaagcctttttagaaactatcatgatgtcaataaacccagatgtcccaacaactgaataagtaaataaatcacaaaaagaatccccgcaatccaaaagattaaattaagacttttaaaaccttgccaaattgggtgcttgatttcttctaactctttcaatttttccgggtccagactgtcaacatgtttaatactgtgtttccaaagcatttcagcaggaatcaccgatttattaagtaacaaatctccattaggttcaatcttaatctcatttccaatccatgaaaccattcctccaagaaacaaatttgcgccatacgtcttttttaacttactcacatcaaaaggattcatcagcaaatcaatttgctcatgaacaggataatatcgaacttgtccattatcaaattccaaacgtaaacgcactcctggcaacatttcagcttttgtaacttttggtaaatcctccataaccttccctcaatttactctaattataacgctttcttttatagaagacaaaccatttgtcaaaactttactgacagctttttcataaataaaaaaatttactgacaaatttctgtcagtaaattttatctaattatttagcagcttcaacatcacgagcaataaccaattcttcgtttgttggcacaacaagtactttcactttagactctggtttagaaatgataccaaatgctccacgaacatttttactttcatcaatttccatgccaaaccaagaaagtccattaactacatcagtccgaacagctgtatcattttcaccaacaccagccgtgaaaataagagcatcaaccccatttaacactccaaaatattgggcaataaatttcttgagacggtcaacatacatttcataagcaagaatcgctttaggatttcctttagccacagcttctgaaagatcacgcatatcacttgagagttctgacaccccaagaactccagattctttattgagaatgtcaatcacatcttgagcatttctaaggcttgggtcgctctctaacatataaggaatgactgaggcgtccatttcacctgcacgtgttcccatcattacaccagcaagtggtgtaaatcccattgaagtatcaacagattttccagcttcaattgctgtaattgaagctccatttccgatatgagccgtaattagcttcaaattttccaatggttttcctaagacttttgccgcttcttgggcgacatacatgtgtgacgttccatgtgctccatattttctgattgaataatcttcataatattttgttggaataggataacgataagccttttctggcaaagtactgtgaaaagcagtgtcgaaaactgcaactgcaagtgcatctggtaatagccgttgaaaagcttcaatccctaaaacattagcaggattatgcaaaggagccaaagttgaaagatttttaatctcagccaaaacctcaggactaataaccgtagaagttttgaaaaattccccacctgcaacaacacgatggccaattcctgtgatttcgcggaattcatgaattaatttaaagtgaattaattcatccattaataacaaaacagcttgacgatggtcaacaatttcttgttttctaacgtgttcttcattgttaaatttagttgttgagattgagccagacaaaccaatacgttcaaaaattcctttagcaatcacggtttcttccggcatttcgtaaagttgccattttaatgacgaggagcctgcattgacagcgagcgttttttccatacttactctccttaatgtatgcgttttattcttaaaattatatcatattttatgtctgatttcatttctcctccctcaaggattcccagaacttatcattttatgtcattttaaaaataaaaaagattttgttttagaacaaaatcttttaattaattattttttaagtgcttcaacatcacgagcaattacaagctcttcgtcagttggaatcacaaaaacttttacgcgtgaatgaggtgttgaaatttctccctcgacgccaaagacatttttctcagggtcaacttcaattccaaaccaagtcaatccagaaagaattgcttcacgaacaggaaccgaattttcaccaataccagcggtgaagacaagagcatcagccccattcaaaacggccaaatattgaccaataaatttttgaattcgatcaacatacatctcgaatgcaagttttgcatcagtatctgtatctttagcagcaatgatatcacgcatatctgatgaaataccagatacaccatagagaccagattctttgttcatcatatcaacaacaccttgagcatcttttaactcagagtcattttcaataaggtatggaaaaacagaagggtccatttcacctgtacgtgttcccatcattactccagcaagtggtgtgaatcccatcgaagtatcaattgatttcccaccttttactgctgtcagtgatgcgccattcccgatatgagcagtgataattttagtttcttcaattggttttccaagtaattttgcagcttcttgtgaaacatacatgtgtgaagttccatgagccccatatttacggacagcataatctgtataatattttttaggcaatggataacggaatgctttttcaggcatcgttgtatggaaagctgtatcaaaaactactactgaagttgcatcaggcagtaagttcaaaaaagcttcaattcctgcagcatttgctggattatgcaaaggagcaagagctgacaaatctttaacttgttgcaaaacttctggtgtaacaactgttgatttttggaaaatttcacctccagcaaccacacgatgtcctacacctgtaatttcagtaaattcctctactattttcaatcgttttaaatcttcaagtaaaacttctactgcttctgtatgatttggaatgtcaaaaacgcgttcttctttttgctcaccaaatttgacggtcacaatcgaatctttcaaaccaattcgttcgattaatcccttggcaagaactttttcttctggcatttcatacatttgccatttcatagatgatgaaccagcgttaactgctaatgttttggtcatgtttaataaaccttccttgaatttgaaatacggttaaattataacacaattacaattccttttgtgtttttcggtcatgattcacgagcttaattcaagatgtagtttttaaaataaaaaacgttttcaaattcaatcattttcatacattttaaccaaaaaaattactgacagaacctgtcagtaatttcaatcttataattttacaatttttgtaaattcttccataaagacttctaaactttctctgtctgtcagtgaagacaaagggtgagcaaaagttgcatgtgcagccggtccctttttcaaaacataaatcgccttagcatcagcattaaaaagtgattttggtaaagtgatgacagccatcacactcccatgtttactaatccactcctttaatagaggtccttgaggacttgtcagtaaatcttctggagctaggaaaatggcaaaagaaccctcttttaaataattaaatgattgctcaatcaaaagatgatgagcaaaagtatgtccgtcagtagtcgcaacttcaaaattctttgcaacttcatcatctggataaaaaccaattggtaaatcactgacaacaacgtcagcaggttccatcaaacgcttttgtactgcatcaatttgcatgaactcagcctgactccccataatttcagccattgaagcagacaaatctaaaagtaaatcatcaacttcaaagcctacataatcaacctttttattaagattaaccaaaagcgtttcagcaagattacccataccagacccaaattcaattaaacgaagttcagaatttttattaagatgttcaataatgaaattaaaaattaaaccaattgcatctggagtcattgcatgattgggctgaagtggtgcgacttgtgaccctttcaacaaaacaaattgaaaaagtttttgccactccttatttgataaatttaactgacgaagtttgtcattatttactgacaattcaacaattccttggtcagtatcatctaaaaaagcagcattttgttctacaaaagcatcataaaaatctgtatccaatttctcagatagtaacataatatttgcaacaactagctcaaaaccttgagccactttttccatatccatgttttttctccatttctacaaaatcaaaataaaactgccaaactttgacagttttattcattgcttgattattaatcaatcaatcatttatttttttctttttcgactgtccaacttttccaattccatccaagctctgaccgttacgacaagcatcgccacaataccgataatttctaaaagtaatgaccgatgacttaccgcctgtgccacagcaaaagcaagaactagaactccaacaccagcaaagaagaaaatgtccatactccgccgaacgtctttgggcatcatgaaaatatacgcaaaggcaactaaaatcaacaagataatatagaacatttttctcctttccaagttatgacaagaactaacgaaaaattaatttattcatcatcaaactttcaataattgaaaatcaagtttctctatttgattaaacttattttttcttcttagttgatttttcacgcattgctttatccaaaatttgtttacgcaagcggattgattctggagttacttccaagtaatcatcatctccaaggaattccaaagattcttcaagtgaaagaatttttggtgtgttcaaaacagatgtagagtctttatttgaagaacgaacgtttgtttgttgtttcattttagtgatatttacagtcaaatcattatcacgactgtgttcaccaacaatcatcccaccataaacttcagtacctgcatcaacaaaaagttgtccacgttcttgaacgtaacccattgcgtaagaagtaacttgacctgaatccatagaaatcaaagaaccacggtgacgtccaccgatttctcccttaacagctggaagatattggtcgaaagtatggttcatgattccgtatccacgagtcattgacatgaattctgttgtgaatccaatcaaaccacgtgcaggaacaaggaaaatcaaacgcgcttgaccgttaccagtgatttgcatatcaagcatatcacctttacgttcagagagcgcttggatgattgaaccttggtattcttcaggagtgtcgatttgaacacgttcaaatggttcgcaagcaacaccatcaatttctttgatgataacttcaggacgtgaaacttgaagttcatatccttcacggcgcattgtttcaataagaattgacaagtgcaattcaccacgaccagaaacaacccatttatcaggagattcagtgttttcaacacgaagtgaaacgtcagtttgcaattcagaaaccaaacgttcttcaactttacgtgatgttacccattttccttcgcgaccagcgaaaggtgagttgttagcaaggaaagtcatttgcaaagtaggttcatcaatgtgcaagattggcaatggttcaacgtggtctgaaggtgtaacagtttccccaacgaagatatcttccataccagacaaagcaatcaaatcaccagcttttgcttcttggatttcttgacggtcaagaccgaagaaaccaaaaagtttagtaacgcggaagtttttagtcgaaccatcaagtttagacaaagtaacgctgtccccaactttgattgttccacggaaaacacgtccaataccaatacgtccaacatagtcattgtagtccaaaagtgaaacttggaattgcaaaggttcatcagagttatcaactgggccagggatatggtcgatgattgtatcaaaaatatttgccattgtgtgttcttgatcagctggattatcagacattgatgaagaaccattgattgctgaagcataaacaactgggaaatccaattgttcgtcatcagcaccaagttcgatgaaaagttcaagaacttcatcaacaacttcagctggacgagcagatggtttgtcaatcttattaacaacaacgattggagtcaagttttgttccaaagcttttttcaaaacaaaacgtgtttgaggcattgttccttcataagcatcgacaacgaggacaaccccatcaaccattttcataatacgttcaacttctccaccgaagtccgcgtgacctggtgtgtccaagatgttgatacgagttccgttatattcaactgctgtatttttggcaaggatagtaatcccacgttcttgttcaagtgcatttgagtccatcgcacgttcagctaattctttacgagcatccaacgtttgagattgttttaagagttcgtcaaccaatgtagttttaccatggtcaacgtgggcaataatagcgacgtttctaatatcttcgcgtaatttagtcaattttatcataccttactttcgtatatatctaacccattatagcacacttttctaaaagctgtaaatgcacacgtttacaagcctaacaaagatttttttacttccaaaatgaaaaccccaaagaaaaatttctaaggagttctttatttttttataattaataaaatcagtaaaaatgattatgttgttaacattcttttattcttaaactgtagagaaagagtaaaagaaaagcaactaaaccaaatagaacagcaataatatatccagctccataaaaggttagaaagatagaaagttcagccccaaaagtattcccagataaactatgattaaaaataatcatagacggaaaagctataactaagaaactaatgtaaaaaataagactagcaaaagaaaaatagacactaaactttattttcctataaatgagaaaaagtgatataagcaacaccaatcccaaaatgaaactataaaaagggacttgatgaaaaagaaaataaaagaaattttctcgactttttttatagtcaaaattcgtattcaatttagcctgatttaccgttgcaggaagaaacatggttcctatccaaatgacaaatgcaagagatacttgccagatttttatttttcttatcaacatttttctgccctccatattcattactatatctacactcgcattttataaacatctacataaatcaaaatattaaaaatcaagaagaaatggaagaaagaagctgagcaaccctaaaataaatgtaaatactatatattttttcatatctatcactctctatctggacaattcaacaacctcatctgccattttccaaatggcagggttatgcgttgcgataataataatccgattttcatttttcatactcaaaagcagtttcatcacttcttccctattctcagaatctagtgctgctgttggctcatctgccaaaataaccggtgaatccttcaaaatcgctttagcaagtgccacacgctgtgcctcaccacctgacaattcataaattttttgattgagttttaaataggctacattaacttgtgccaaagtttcaagctttttttcttgtttagttttcttggataacttttgattaatcaatcccaaatccaaatttttatcaatcgtttcattttcaatcaatccaaaattttgaaaaagataagacaaatcatttagaaaataggaatgtttcttgatttttgataattcttttccctcataaagaatacttccctcgtaggattcaagtttagcaatcatattcagtaaggttgttttaccagaacctgattgaccgataatggcataaactttcccagcttcaaaggttaatttaaagttatcaaaaatctttctatgtaaaaattctttagtaatattagttaattcaaacatctattctcctttcaaactatttatttgtccattttcaaaattcttcatttgaacaagtaggataatgagcgaaataaaccacaaagcacttacaacaaaaagagaatataaaaactcattgctgattattgtcaatgttggtaataaaatcaaaagtaatcctaactctacaaaaatgaaccgacgatgaattctcaagttgggcattccagaaataaattttattacgattgttcttctgaaatgagtaaagtaaaggacatgaagtaaaatatagaaaaagctaatgacaataatcgttataatggctgatatgattgccatacttaaactctcttttacaagatttgtctgtgcttcatactgtccataggcattaactaaataatgaaccttatcgtatagtcccaactctttcagcctattaagcgtttgttctttacctctcacaaagaaataatcattatcccctgcccatgatatgcccgtttcttctcctgatgattgcggtgttatcacaacaataattgggtcagagatttcttgttgcgttgtcattttctcataagccacattgtaaataaaacgtttttcgccatttggtacttcttcaacgtattttgccttcatcttagtctcttttttaccgttttgtgtggtttccgtcaatgatttattatatttagtgataagtttttgacggtttttcatttgatttttcggtatcaaaagagcgtattccccaagtttgagattagaaaagtcttctttagccttgatatgttgtgctttcaaataacttggtgtaacgaaaagttggtcttggctactttcttctggtccagcaaataaatcatgtctaacgaatatcgcatcatctttcgttacttccatattataaaagttccaccatgcttttgcttcttgattacttacttgcaaattaatagaagcataagggaaagtataataatctttttcttctttccatttatctaaatcagattcctgtttttttaattcaatttgattatagtgaattcctgatagacttgtgacaaggacaagactcacagcaaattgcatcaaaaccacaagaaccatcaaagctattgtcggtagtttccctttgataagtgaattaagctgactccgagagaggacaatcatgattattgcacttactaagcatgacaatagcacaaatatcagagaagaaaaaaagatagaaaataaagcaaaaatgtgaagtgagaagttgcttagaccagttatgagcaagtaactagaagtccctatcatagcaataatcgtcaaaattgagataaactttatatcacaaatactatctgaaaatacagtattcaacaaggtctttccagacaaaagctctattcctgattttcgtaactctgagattcttacaaaaatagctaagccgacaaaagccagaaagatacttatcaataaggttacagcctgtggattaccatagatgttgtaatattcatcgaaaagcgacatctttgaaacagcggaagtcataacatggaatttctggcttaaatattgacttaactcctcggcacttccatgtcctcttagaatattataagttgcacccatacccaacaattcattgtctgcacggtcagctttggggaataaaatcatattatttcccaaaattcctttaccaaaagtcatatattccggatgaaagccggcgttaccttctggagtaacgactgtcgcaacaataaagagtttgtgagttttagcatagttatctagtgcaacaagaacctcttgattgctaggaatatgatttggattttgttccgcattgttggcgacaagcacaccctttggaagtcggtccgcaataatgtcttgactttttggctggatattgatgatataaaaggctgtgactagcattgtagccacagccagaaaaatatattttatttttttcattatttttatccccaaagtttaccaggaatatatccattaccatggtaaaagttaactcgttgaccccagtaggtatttaaccatgcatatgcttgtcggttagcatgagcatttatagtattatttccatattggtgtgcataagctacttcagcccaatgatttccatagttattccaataagcagcgtaggctcgcatgccgtattttttatcattagttgagccttgagaataagttgaacgattaatagcgaaaacgggactgacttgaagaatagtcacaccgagagccgcaaggataagtgttgaaacaagtaattttttagtttgcatttttctacttcctttctaaaaatttctaatcttttgtagaaccttttaaaaattctactacaacaaaatttttagtacctcctttcctcactttgagggtgtacaagcctctggtcgaattcgtttgtttaacatttttaagttgatgttaaatttctatatttcgattgtaaaccttttcatttttgcttacaatctttttttgcataatttcatcatttttgtgacgaaatcgcattttctgtgatgaaattgagtttttatcaggcaaaaacaaaaatcaccctaaaaaagagtgattattttattcgttttgaatgttttttgagttcttttaactcttttttgcaaaccgccggtgctttgacttttttcaagctttgtttgaaacatagcgtcaatccgtcttcttcaattcgacgaattttatttgtatcaacaagtaaaccgcgtccaagtgcaagtaaattgggaattttcttttttacatcagaaatcgtaccacgaactaaacattcattatcttttgtgatggctttaagataatttcgatgtgttttgtccgcttcaatatataaaagagaatctatcgaaattggataaccactgatttcgacaatagttagctcatttgtaaaacagtagagcaacactttcttaatcatttctctaatttcagtatcagcgtcactagccacagtcatttgagtccacagcggagaggtagtaaagttcaataattcatcttttaagtcaggattatcagtatagataagaaaaaatgccttactttctaacttctgtatttttttcagtatttcgaactcttctttttgtgcaatttttataaaacaagtcttaacttcttcaagataaatttgaaaatatttatagatatcttgatgattatagaataccattgttgcgtcaaccttgtcttttatcccaagttctttttcattttcaagaacaaatcgctccaagcgatttactgcataaaagtccgcatcaatcaaaattctattcattttttaccctcaacaagtaaattttaactataatcttattccaaaagcatcattaccattaaatatctttttagttacgttttcaaattatattgtattataccattttataagcaaattctgcgctattcactctcttttacatatagcttggacttgaaagcctttatcaaatacggtaaaatgtagtaatgaaaactctctatgacgtgcaggaaatgctgaaaaaatatggatacatcaatctttttccagatcgtttggatgcgattgcttttatgcaaattgaattaggaaaaatgcttgaatcaggaatatttcaaaaaagtgaccatgactatttgactgctcgcttgattttggcacgtgaagagagaattgaaaagaaaaaatctacgaacaataaaaaatgattctttttttattgtcagattggagaaaaaaacatgactgcaagtaaaattatcggtatagaccttggtggaacttcaattaaatttggaattttaacactcgatggtgaggttcaagataaatggtctattccgacaaatattttagaagatggaaaacatatcgttcctgatattattgaatcaatcaaccaccgtttaagcctttataacttggacaaatctgaatttcttggaattggaatgggaacaccgggttcagtaaatatttctgaaagtaccgtaaaagctgcttttaacttaaactgggcagatactcaagaagtaggtaaaccaatctctgaaggtgttggccttccattcattttggataacgatgctaacgttgctgctcttggtgaacgttgggtaggggcaggtgaaaataatccagatgttgttttcattactcttggaactggtgttggtggcggaattatcgcttcaggtgagcttgttcatggtgttgccggagctggtggcgaaattggccacatttgtgttgaccctgatggttttgaatgtacttgtggaaatcgcggttgcttggaaacagtaacttctgcaacaggtatcgttcgtttagctcgtaaattcgctgaagaatacgaaggtgattctactattaaagcagctattgacaatggtgatgaagtgacttctaaagacatcttctttgcagctcaagaaggagatcacttcagcttatccgttgttgataaatttgcttattatctcggttttgcttgtgcaaaccttggttctactttgaaccctgcttcaatcgtcatcggtggtggtgtttctgctgctggagaattcttacgtgaaaaagttgaaaaatatttcactaaatatgccttttcaactgttcgtaactcaagtaaaatcaaacttgctatccttggaaatgacgctggaattatcggtgccgcaagtcttgctcttaaatttaaaggagaataattttggttattattatcattgatatcattcttgttttagtaattatcggaatgtttgtctatcctcgttggaatcttcgtcgtaatgctaaacttgttgaagaagctgagtttgctcgtttaatgcctacttctcaattaattgatattcgtgaagcaaaagattttcgtattaaacatattcttggtgcacgtaatcttcctgctggacaaattgaccaaagtttaaatgccttaagtaaacataaacctgtactcatttatgaaaatggtcgtcctgttggcggagcaaaagttgctaaaaaactaaaaaaagctggcattcctgaagtttatatccttaaaagtggtttgaattcttggaatggtaaaactaaatctggtatctaattactaatcgtcttattagtaaatttcaaataaaaaactctctatcattaactgacagagagttttttatttataaagtaattaacctacttcagcttcaatcatccaaagtgttttttcaatatctccaagagcagtcgtatataagtcaactgtcacatcatcaccatcatcaccagcaattttaatgccatctttgaagagttgagtcaaatatttgtaagcaacaatcaattctttcacacgttctgaattagattttccccaaacggcgggagtcatttcaattttagaatttttatcaaattctgctaaagttgaaactggagaaccaccaatagtgattaggcgttctgcaaattcgtccaaatgttcatccaattgatcttttaattcatccatttttgggtgtaggtaaagaaaacctggaccacgcaaataccagtggatttgatgaacaagtgctgatgcttttgataaatcagcaactgtttgatttaaaacttcttgtgtgtgttcatttgacataactaacctccattttttaaatattaaatgtcataaagagacttaatattaacttttctataaatatattataaaccaatgagatttttttctcaaatgatttacttattttcttttttcgctgtatttaaagttacaattcttcatttatttcgtatagattagtatggacattttatttatatttgtaattggaagtatttttggctcattttttggcttaatagttgaccgtattccactaagaaaatcaattatttttggacgctcacattgtgattcttgtcagcaacttttagcctatcgtgatctaattcctattttttctcaaatatgttctggctcacattgccgttattgtaaaagtaaaattccatatttatatgtttttttggagttctcatcagctttaatttttgttttagcttgggtaaattatcttaaacctaatcaatttttactgattattctttcactaattttatctgcttttgattatcgtcagcacagttttccttttgttatctggtttatttttgcactcagttttattttaatatttcctctttctccccttttctatttttggcttattttagccgtcttagctgaaaaattcaatttaagagttggcagcggtgattttttatggttttttaccgcttcattttctctaactttcttaaacgaaatgctgctccttcaaattgcttgttcacttggtatcatttattatctaatcacaaaaaagcgagctgaaattgccttcatcccgtttctaactattgcatatctaatgtttcttttgggacaccaaattctgtcaccgtaacccctaaaagccttactcctaaactttcatcatattcaagttcttcaaatatctcttgtgctacttctgcaatttcttctggactttctaacttttctgctaaagattttctttttgtcaatgttgtaaaatcagaatatctcaattttaaaatgacaatacttccttttaattgatgactctttaatgagtcggaaactttaccagaaattttactcaactctgctttaatatcatccggaagatataatagtttaccataagttcgctcttttccaactgactttcgctcacggtaatttttgactttcgagttatgtattccattggccttttgataaagctcccaaccataaactccgaatctttcagctaaatcaactgggtctgctttttgtaaatctcccccattaaagaaacctagtgcgtgcaatttaggaactgtcgcttttccaacaccatgaaatttttccaccggtaattttgctaaaaattctaatgcttcttctggcataattaaggttaagccatggggcttttcataatcagatgcaattttcgctaaaaatttattataagaaactcctgcagaacaggttaaacctaactcaacaaatatatcatgctgaatcaacttagcaattttaattgctgattgagcaccgattttattttctgttacatctaaataggcctcatcaattgaagctgcttcaatatcatcggtataacgtttaaagatttcacgaacttgtttacttacttttgtgtatttttcatagtttcctgaaataaaaatagcttgtgggcaaagatcataagcttctttagcactcattgccgaatgtattccaaaagcacgcgcttcataagaacaagttgaaaccacgccacgtccacctgtctgtattggatttctggcaataacaaccggcttaccttttaaactcggattatcacgcacttcaacagaagcaaaaaaggcatccatatcaatatgaatgatttttcgcgaagtgtcattgatgagtgggaaagttaacatattgctattatacaagaattagttttcagactcaatagattgattacaaaaaaactcttaacaagtaagagttttaatttataaatcaataatttgataatcatagccctgcgacttcaaaattgtaaaacaagcatccatcgcaaagaaaatagttttggtattatcattaggatgaaaagtttgaatttgatagtcatctagcatttgttggtcaaaataaatatgcatattatcataatgtttaccaacaagtccaaaaagagaaacaattccggagtttaatccaagcatatcttctagtcgttcttccgagacaaagtgaagtctcttcactccaataatttctcccaagcgattcatatcaacctgtttagcatcatccataattatcatatagaactgggtagactttttattggctaagattaaagttttggaacgacaaccttcataatctttaatgtagttatccgactcctcagttgaatgacttgctggatgttctactatattataaggaatttcaagatcagctaataattccttaacttctgaaaaagttctcatcaattctctcctttattcacttttagaaaaataccgataaaattaatttatataagacaacttatttttatattttgtttagtagcctagtaatccccgaagatctaaagctgttcctgattttgcgccacaaatcaagaccagaattgctaaaactcctagtaaggccacaatgaacattcctgcccattccttgactgatattgcttgtcgactttcttttttcgctttaataaataaaatgaaaccaatcgtataaagaatcatcgccaaccaaacatattgccaaccagaaagataaagggccagagcttgaaaagcaaaggtgaaaaatcctattaatatatttttaattgaaccttctttaatcccaattttaagaagataagctccaaccaaagcataacaaatcataattacagctgttgccatataaataaagacattataagcattggctacaaaatatgtaatgataataaagatttgaatcatcagctgagtaataagcaaagaattacttggcgcatgatatttattcagcttaccaaaccaacttggcaatagtttttgctctgccaattgttgtgtcgcctcaactggtaacattgtccacgaaagccaagctcctaataaggaaatcattagtccaattgccatcagacttccgccccagccaccgaccatctcgttaagaatataaactaagcctggtgctttaacatttgccaaacttgcctggtccatataaccataaggaagtaatgataaaaggacataaatgacaagcaaaactgctagaccaataattgtcgctttagctgtatccgattttttctttgcccgatttcccatcatcgctgcgccttcaatcccgacaaatacccagaccatgaccatcagcgagcctttaatttgatcaaggagtccaccagcagtcatcgcatgccaaactaggcttttgactgacccatccgcagctagattgcttgtgaaagtttgccaaaaatgttgagtgaatacatcagctttaaataggataatccctgtgattgaaaatacgactaaaggaatgagctttgcaatcataacaaccgcatttacaagggcggcagtttctactcctcggtcaactagaaacattaatatccatgagattattgaaacaataattactgataaaacagtcaacgaaccattggaattagcaaatttgccagggaagaaatagtcagcagatgtcatcattaaaactgcaaaaccaattgttccagtccaagctgaaatccagtaaccccatcctgatagaaaaccgataaagtctccaaacccttctcgagcatagtcggagactccggaaagtttgggtctaattgtaatcagtcgattaaaactcaagacaagcatgaaaatcccaaaaccaataaagagccatgaaatcatgactccaccgggtgttgaaccattggcgaggtcattagcaagattgaagactccacctccaattgctccagaaataataattgctaatagtgcaaaaaggctaatcccttttgttttcttgttttccatttactcactttctactatttaatcataaatttcctataattaaatttgtataatatcatttataaatataaaagagtctcttgaatatagagactcttttatattcttcaattataattatactatcagttctttattatacactttttatacactttagtaaaacagaaatgtattttataaagaatatatcaaacctgatattctctcaaaaattcagataagagtttaagaccttgacgtaaggttgtttcatctgtacaatacccaatcctagcatagcctggtaaatcaaaacgatttccaggaataattaggacacctttttcacgaagaagttggattgcaaaatcttcagtttttatcggatcaagttcttcaaatttaacaaaacttacagagactgcattgggataaaccattgaaactaaaggttcattttccacccattctttcaaaattgataaattgcctttgacaattttacgagcgcgttcaagtactttatctttatatttcaatactaaagccgctacggcgtcatcaaatactccggtacaaatcaaggtataatcccggatttttctaaattcattacaaaggtcacggtcttgagtggctacccaacccacacgaattcctggtacagaataagttttagaaatagagttagttgatattcctttttcatataaatcagcaataggtgaataaggcgtttcttcatccagtggaagataaacttcatcacaaagaatataagcatcaacactgcgtgcaatttcaactacttctgacaaaaatttaggactcatgattgctccggttggttgggccgcattgtttaaacaaataagttttgtattacttttaactaaacgacgtaattcttcaatttgtggcaaccaattattttcttctttgatatgccaataatcaacttgggcacctaatgttttaggccaatcatacagttgttgataagaaggatattgagcaatcacatgatcaccttggccaattaaccctaaaattgtaaggaaatttgctccggtagctccatttgtagataaaatattatcctctggcactcttttataaagttttaccacttctgatttaaaggctggtgaaccctcaatccaaccataactgaatttttctttcatcatctgtgacataaaagcttcgccattatcttcttcgaaggccaaaacttcttccaaagataacgaatcaatggttgactgagcaatatcaatcgttgcagatttttcccaaacattgagccagtcttcacaaccaaattgtacaagttccataagttttatttacaaatttaaatattttttttaaaaaaatcatttaaatttgtcttcctctctttatttttttactgacagatttagtaatcattttaccttaatatttatcgctgatacttacatcttgtcagtaactttatcaatataaatcgtttacatgttaattgtacaataattattgataaaatatcggaaagtttatcgatttttagactacatttataaaaaaatgctacatcaaaaatgtagcatttttatctttaaggaataatctttgttcctgaatcattgttgaggaagtcttcaagattttccaaagaagtaattgttgcaggacgccctgtacgagcaacaaattccattgctgcttcgactttcggaagcattgaacctgcagcaaattgaccttcttcaatataagctttcatttctgccattgttactgtttctagttttttctgattaggtttattgaaattaacaaaaacattatctaccgcagtcaaaatcaaaagattatctgcttcaacaagttcagctactttcgctgctgaaaagtctttatcaataacagcttcaactccttcataaccatccttagtttcaatgacaggaattccaccaccaccagatacagtcaccaaaacacttgatgagattagtggcttaatcgcttcggcttcaacgatacgtgttggtttaggacttggaactactcttcgatagccgcggccagaatcttcaacaaatacccagtcggggtattgagctttcatttctgccaatcctttttcgtcgtagaatggaccaattggtttagtaggtttttcaaaagcttggtcatctttatcaacaactgtacgagtcactacagagatgactggaacacgttccatattattttttatcaaagctcttgtaaaagcttgccccatccagaaaccaatttgtccttgagtcattgcaacagctgtatcaattggcatagctggatttttaggactatccgctgctaattgttgcaataaaagatttccgacttgtggtccgttaccatgagtgacaaccatttccacatcattatttctaataagaggaattaattgttctgctgttgtttcaagtgctttttcttgcgcttttgctgttgggtcatctgttaaaatagcgttaccacctagggctacgaccatacgtcttaccatgaaattatttctcctctatcttttttcttatttaaggaacaattcttgttccactaccagatttgacaaaattttcaacattgtcaaggctagtaattgtagcagtcttacctgttcgttcaacaaaactgacagctgcttcgacttttggtcccattgaaccttttgcaaaacgttcttcgtcaacatatttgcgcatttcagaaactttgactgtttccaaatgaacttggttttctttcccatagttcaaatatacgtcaccaccgcttgttaaaatcaaaagctcgtctgctccaaccatttcagccagtttagctgcagagaaatctttatcaattacggcttcaacacctttataaccattaccatctttaatgacgggaattccaccaccgccagaagcaatcaatagactaccagattctaagattggtccaaaagctttggcttcaataatttcaagtggtttaggacttggaacaactcggcgatatccgcgaccagcgtcttccattaattcccaatcaggaaattgctttttaatttctggcaattgttcttctgtgtaaaaaggaccaattggtttactagcgtttttaaaagctggatcattttcatcaaccaatgtttgagtcactgctgaaataactggataacgctccaagccattatttgccattgctcttgtaaatgcttgaacggtccaaaaaccaatctcaccttgggtcattgctccaactgtatccaatggcatagctggatttttttcactatctgaacctagctgttgtaaaagtaagtttccaacctgtggtccatttccatgagtcacaaccatttggcagtcattatctttaattaatggcatcaattgttcagctgtaacttcaagcgcttctttttgagccttcgctgatgggtctttcgacagaatagcattcccaccaagggctacaacaatacgttttaccatttctgtaccccttcgcttaattttttatttcttttttgttaatatcgctacgaacgacgaagtaaacaataaatgtcactacaatcagtggaacaacagcaacaagtaatgtattaccatcaattccaagtgcatcttgcaagccaagccagtttccatatactccaaaaacagcaaggattcctaaaactgttaaaacaaaagttgcaattaattctgctgtagacattttagtgccatattcttttttgcccaaagcataaagaatgaaaccaacagcatagagaattaatgaaagccaaacaaattgccaacctgaatagtacaatgctaaaatttggaaagcagctgcgatgaaaccaataataatgttacttgttttcttttcttgaatccctaatttaaagaggtataaaccaactaaggcgtaacaaatcatgataacagcagtacaaaggtaaacaaagacattgtaagcatcagctacaaaataagtaacaatcaagaagatttgaacaattaattgtgtcaacaaaagtgagtttttaggtgcacctttgtcattaagtttaccaaaccaactaggaagtaatttttgttctgacaattgttgtgttgcctcaactggaagcattgtccatgataaccaagcaccaagaagtgaaatcaccagaccaatggccattagtgagccaccccaaccaccaaccatggcgttcaaaatatgaactaaaccaggttgtcctgtgtttgctaactcttgttgactcataaaaccaaatggtaataatgagagcaagatataaattactaacaaggcaatcaaaccaagaattgaagctttaccggcatctgatttacgttttgcacggtcacccatcatagcagcaccttcaataccgacaaagacccaaatcataaccataagtgaacctttgacttgactgaataaatctccgccagtcatatttgaccaagttaaactcttgatgacaccatcagcatttgtattcgcaacgaaattttgccagaagtgagcgctgaatactccagctttaaatgttactattccagcaattacaaaaacaaacaatggaatcaattttgcgatgaggacaattgcattaatagcagcagccccttcaacacctcgcataacgagtaaggtcaatccccacgaaacaattgaaacaacaattactgacagaatggtcaaagaaccattcttagcttgaaatacgccggggaagaaatagtcaacggaagtcatcatcaaaacagcaaaggcaatgttacctgcccatgcggataaccaataaccccaacctgagatgaaaccaaccatattaccaaaaccagcacgtgcataatctgatacacctgaaagttcaggtttatttaccaccaaatgatttagtgataaaaccaacattaaaataccaaaaccaataacgatccatgaaatgataacaccaccaggtgatgcatttgttgctaaatcgttagagagattgaataccccaccaccaatcgctccagaaacaataatcgcaactaaagcagcaaggccaattccttttttattttctgcgtccatatcaatcctttcagtgatttcaaccgccaaaacagtctaattttatcttagactgctttcaacgacttaaatcaaaatctatcagtttactgacagctctgtcagtaaactgacaaattatctattttaattatttaaaatcttcaggaactgctgggataaataaattacccaaagttgcagccatgattgctttgatagagtgcatacgattttctgcttcttcaaattgtcgagcatatttagaacggaatacttcgtcagtcacttccatttctgtcaaaccatatttttctttgatttctttaccatattcagtttcagtatcatggaatgctggtaagcagtgcataaagatcaattgaccattgtcagcatttccagtcattttaagcatatccattgtgatacgatatggagtcaaaagtttaacacgttcttcccagttagattctcccattgatacccaaacatctgagtaaataatgtttgcgcctttaacaccttcttcaatatttgaagttgcaagaggtttagcacctgatttttcagcaaatttatttgcaatgtccataacttctttagtaggatgaagtgaatctggagcaacaatatgaacattcacaccaagcatagaaccagttacgataagtgagtttgccatgttgttacgaccatcacctacgtagactaatgtcaaacctttaagatgtccaaagttttctttaacagtcataaagtctgcaatcatttgtgttggatgccaatcatctgtcaaaccattccaaactggaacaccagagtattttgccaaatcttcaacttctttttgagaaaatccacgacgttcgatagcatcaaacattgaaccaagcacgcgagctgtatcttctgttgattctttaattcccaattgaatatcgttagctccaaggtattctggatgagccccaaggtcaattgcagcagttgtaaaggcagcacgtgtacgagttgaagtttttgcaaagagcaaggcaatatttttaccttcaaggtagtggtgaggaatattttgttgtttcaatgctttcaaatgaagaccaaaatcaacaaggtagttaatttcagctggtgtgaaatctttttcagcaagtaagctgcgaccttggaatactgagtttacttctgcttttgtaataagtggtgatgtcattattttttcttcctttttctatttttattatatttaatgaattttttaaattacattaataagctagtgattcactctttcctaaataattaattatcaaatgaatctatgaaattataagtttaaagtatctcttcctaagttatcaatgaacttacgaagaaatttttaaatctttaagattacaaatcttcacgccaaagtggttgtgacatacaacgggcaccaccacgaccacgaccaagttcgcttgaaagaatttcatgaactttgattccgtgttctttcaataactcaacagttacatagttacggtcgtaagtaacaatttcgccgggtgcgatagcaagtgtatttgatccatcattccattgttcgcgaggagcggcaattggatcacctgcaccacattcaattaagtcaagttctgaaagattcaagactttcttgagtgctgctttaaggtcagtcaaatgttcaatttcaacttcgtcatctttaccagggcgaagaatgaagacattgatattaccagcaccatccataattcctgggaagacagtaaattgatcatggttaatcattgtaaatactgtatccaaatgcatcattgcatggttatgaggaatttcaaccgcaagtacagtgtcaaatgttgaaagtgggtttgcaaacaactctttagcaagattttgaattgttttagatgaagtacgttctgaaaccccgatagctactgttgttttgttaagaattaattcatcaccaccttcgatacgagttgtatggttacgatcacgccagattggagtatctttgaaacgtgggtgattagccataacatactctgtaatcaagctttcaggttgacgagctgggaaggtcattttattaatggtcattccgacacccattgaagcttgtgggtcacgtgtgaagtaggcatttggtaatggattgaggtagaaataattttctgcatcagatcctgccatatcgctaagtgctgtacgtttgatatccaattcatttttacgaatgccagcatagattttgtcgaccatatcttttgttgacattgaagtcaaatattcagtcaaaccatcatatgtgcgtcctggacggtaacccgcttcgtgtaataagtgacttaagaattcttcttttgtttcagatgatttttcaaaaacttctgttgcaagattttcgatataaacagtttctgcaccattatcacgcaaagtttgagcaaagaaatcatgctctttttgagcaattttgagatatggaatatcatcaaataaaagttgtttcattgtgtctggggtaatattttcaacttccgcacctgggcggtggaggaggactgattttaatttcccaatttctgagttaacattaattccattgttcattttagagtatcctttctgatttcgatccggtattattggaatcgtttacaaggaaattatacatctatgcatattttttgtcaagcacttatgctacactttacaaaggtttattcatttatacatgtttttttatattctgacaatttcacgtttattcatttcttttgttatcatgcgattcttaggcttttattaaaaaagcttattttacaaaagtattttaaaaaggcaacaaaaaaatctcttatcctaaagaattaaatctttttgataagagattaagtgaaaaatttattttttacatattttcaggtgcagcaactccaagaagacgcaatgcttctttcaagacgattgaagtagcgctaatcaaagccaaacggccatccaattgagcatcatcttctaaaatgcgaacatgagcataatatttgttaaaagcttgcgcaagcgaaattgcatatttagcaataacagatggttcataattatctgcagcacgtttaacaacatttgggaattcttttaatgctttaacaatttcccaagcttcagcgtcagaaactgcgagagaaatattattaatatctaccttacggtttgctttacgtaaaattgattgaatacgagcatgtgcatattgaacataagggcctgtttccccttcaaatgaaaccatttcgtccaagtcaaagtcataaccgttatttctatcagtttttaagtcataaaatttaacagcaccaaccccaacttgtttggcaacttcttctttattttccaaattaggatttttggcttcaatttgtttttcagcacgatcaactgcttcgtcaagtgccatttccaatttcacgacatgccctttacgagttgagaattttttcccaccttgagttaccataccaaatggaacatgcaccatatcgtcagaccaatcataaccagcttctttcaaaactgcttttaattgtttaaagtgattggtttgctcgccaccaacaacataaagagatttcacaaaattgaaagtttttttacggtaagctgctgtggcaaggtcacgtgtaatatagagtgttgcaccatctgttttcttaatcaaagctggattgaggttatatttttcaaggtcaacaatcaaagcaccttttgattcgtgtaaaagatttttactttctaaatcttcaacaatggcatccattttatcactatagaaactttcacccatgaagtggtcaaaacttacaccaagttttccgtaaatacggttaaattcaatcaaagaaacatctgagaaccatttccaaatgcgaagtgcttcctcgtcgccttgttccattttaaggaaccattgacgtccttcttcatcaacttctggatcttctttagcttcagcattgattttgacataaagtttcaagagttcatcaatcggattagctgtaattgtagcttcatcaccatatttcttgtaagctgtaatcaaaagaccaaattgtttaccccagtcgcccaagtgattgattttgattggctgataacccaatttttcgtaaattttggcgattgaatccccgataacagttgaacgtaaatgcccaattgaaaaaggtttcgcaatatttggcgcagacatgtcaatcggaacatttcctccttgaccaatatttgcatcaccgtaatgttcaccttcagtcaaaacttctcgaattacttctgaggcagttgcatttttatcaaggaaaaagttaacatatggtcctactgcgataactttctcaaagccttttgtatctatcttctcagcaatttctccagcaatgatttgtggagattttcggagagttttggccaattgaaaagctgggaatgctaaatctcctaaatctgacgatttaggtttttcgataatagccgcgatttgttctactccaagaacaccatcgattgcagcagacagtgcttggcttactaattgtttttcatccattcattaattatacagaaaaaacactaattttgtcaatatatagtccattatatggtataattatgctatgaaaagagataaaagattagaaattattaaagaaattgtgacaaataataaaatatcgactcaagaagagcttcaatctctattattagaacgcggtgtagaggtaacacaagctactttatcaagagatatcagaaaattaaatattataaaaaaacgggataaaggagagagtttttactcatttttgacttctggcaattccaaaattaattctgatttacagttgtatttttataattttgttatttcagcaaaatctgtcggagctttagtggttattcggacaaaattgggtgaggccgatgtgttggcgaatgctttagatgacgaacgtgatagtcggacagatattttaggtacaattgccggagcagatactctgctcgttatttgtgcgtccgaaaaagcggcaaatattcttactgcggaaataaagtatattttattaggataatttttaaacaaattaaggttcgtttaagcgtttacatttatactcatattactccctaaataatttcttcataaacccctttgattcaagtcgcactcccgtgacttgaattttttttactgacaaaaattgaatataacaaaaaaagtactgaccaaaaagctgtcagtactttttttattttattgtaagttagttgagacttggctaagtaacttttcaaaagcaagttcatatttttgaatatttcctgctcccataaaaacgtaaaccccacggtcatggtccaacaatggcgaaacattgtcaagatcaattactttggctggtttacgaactttgtcagctaaatcttgtgccgtaatttcatgatggtctacttcacgtgctgaaccgtaaatttgagcaaggtaaacggtatccgcatggtcaagcacctctgcaaattcgtcagcaaatgcaattgttctagtaaaagtatgaggttggaaaacagcaacgatttcacgatcaggatatttttgacgagcagcatccaatgttgcttcgatttcagttggatgatgagcaaaatcatcaataatgactgtctcacctacttttttctcagtgaaacgacgtttcactccacggaaagtcaataagtggtctgcaacttccgtcatatccaacccaagattatgacaaacggctacaactgacaaggcattcaatacattgtgtttaccataagctggaacgacaaaatgaccaattttttcaccgcggaaataagcatcaaaagatgagccacgtgtacttctgaccaaattttcggcacgataatcgtcattagcctcaaaaccataatagtaaataggtgctttggcagtcaatttacgtaagttaacatcttccccgtaagcaaaaataccttttttaatattatttgcataatcttggaaagctgaggtgacatcttcaattccttcaaagtagtcaggatggtcaaagtcaatatttgtcataattgtatattcaggatgataaggcatgaaatgacgttcatattcatcagattcaaagacaaaatattcacttccctcaatcccacgaccagttccgtcaccaatcaagtaagaagtgtccacgatattagacatcacgtgagctaacattccagttgttgaagttttaccatgtgcaccagcaactccgatgctagtaaaatcttccatgaaatgtcccaaaaattcatgataacgtttgaatggaaatccatttttatgggcaaatgcaatttcaacattgttatcatcgcgaaaagcatttccagcaatcaattcaaattcgggcttaatatttttttcgtcaaaaggcaaaagtggtacgttagcttgttcaagaccacgttgtgtgaaaaagtaatctgttgagtccgaaccttgaactttctttcccatttgatgtaacattagcgcaagtgcactcatgcctgaacctttaataccggtaaaatgatatgttttttccatgataaaattttctgtcagtaattctatttctttatcaatcactgacagaaatttcccttcttttcttacaattatttttttatttacttaaatttttatgagctcaaagacacacaaaataactgacaagtgatatctccaaagtaaattttaccataataaaatttaacttctctgtcagttttttcatttaaatttgaaaattaaacgattccacggtcaaagatatttttccgcttattttcaaaataacttcctttttgtgtgtcattagcagcggctccatgtggaactgccttcttcattccgcctttagcgactgcatcagaaacgttcattccttgatttttcatatcccgaattgggttatcattagctgaaggtcgcttattcaaaattgcggatgttgaacgacgaactgtgatatcctccttgtcccgctccaatggtgaaacatactgtttaggaggctttggaagtgttgctgctgcacgttttgcccgttcttttgactcgtcaacgctagttttcttaggcattttatcataggaacttacgccgtcatgattagagtttagcggacgatgctgtgtgctaaagcttgttttagctttataaggtttgaaactctcaggtctcttggcatcagtttttggcttattattttcaattgaagcttcatcctgaaggctgggatttcttgtcagcaactgctggttagtaaaaattacccgagtatctttttgaagtgcttcgtcatcaccaataactggaaataccactcttctttctaccatgttttgccctacttttttatagtttgtttaatctatttattacattttaattctttatgaagatgatgaaagtttatcaaagaatattgaaaactcttgtctttcctagcttttatagaatttttcttccactagataaaatatcaaaccaagatttagattctaagataaccgtttcaatatccattatagcttaatttctaagttttttaaagctatactccaagaatttcacgaatttctgcttcactaaggactttatccactgtatcgccttctaaaacattagcaattaaatcctttttacgctcttggatttccataattttttcttcaattgtacctttggtaatcaagcgaatgacttctaccgtatttttttgtcccatccgatgggcacgcgcaatagcctgttcttcaacagctgggttccaccacaagtcaaccaaaatgacgacatcagcactggttaaattaagcccaaccccaccggcttttaatgaaactaagaaagcatcacgactaccagcattgaaggcttgaaccattgaaagtcgatctttaattggagtagaaccagtcagtttataagcggtcatttcttgttcttccatcaatttttcaatatgtggaaaaacttttgtaaattgagagaaaatcaaaggacgatggcctgaatctttaatttgcgccaataattctcgtaaacgttcaagtttcccagaacttcctttatagtcatccataaataatgctggtgtattacaaatttgtctaagtcgtgtaattcctgccagaatttcaattcttgaacgtgataaagccgcactatccatttctaaaacttgtttttgcatcaattcgagttgtgctaaatagatcactttttggtcatcagctaattggttatagaccgtaatttccattttttctggaagttcttcaagcacatcttcttttttacgacgcataatgaaaggctgaatcaatcttgagataacagatggttccatcttattgaatttttcacgttttggtaaaaagcctggcatcaccacttggaaaatggcccaaatttcttcaattcgattttctagtggtgttcctgaaagggcaaaggtatgttcaacattcagagcagatagtgatttattggttttactactataatttttgacaacttgagcttcatccaaaagtaagtaattcaattttttatcctgatagtcttcaaaatctttcaagaagctaccataacttgtgatataaatttgatgtttttcttgaatttctttacttcgctcggcttttgtcccgtcaataacagcaaaatcaatctcatcagtaaatttctcaaattcacttgcccagttataagtaagactagctggtgcggtaattagaacactctcatcttttttcagattagaaagaataaaagtaatcgcttgaaccgttttacctaatcccatgtcatcagcaagaattcctcccaaattataatgagagagcatactcatccagcgaacacccgtttcctgataagaacgcaaggaagccttaatatgttctggtttctcgtaaggaaactcttcaggatgcgtcaagtgttgatagagtgatttaaatttttcagagaaggaagctccaccaatattttcaaatattttagaaatttgaaaacttcgattaatattaacatgcaaactgcttccttgaataacaaattggtcgtcaagttcatttaatgcagctttcaagcggtcaaatttttcattaaaatgataaaatttcccactttcactgatataaaattcagcattttcttgtaattttgcaataacatttgcaaattcaccatcttcaacctgagggatatcaaaggaaatatctaagagccctccctgactatcaatatgaatttcaggaacttcatccattctcatatttcttaaagttggcgacagttcaatctgaccaagtttttgaaaagcaggtaagattttcaaaaagaaattctctgataaattttctggaatatttaatgacgaattaaaagccttagcaaactgcaaacgttccatcagcgcaaaaatcttttgctctttacgcaaatctcttgaaaattctagggtttctaaatcgtggaaactatctattgagaaacttccataatcaaaagtcattgccaaactaatggtctgatcttccaacaaatcaaaagtaaatttagcatcaaaaggtctgacaacaaaatggtctggcgcttcaatctctcccaaagttgataattgttgaagagcctgagctaatttatccttatcagcatatgaaaatttaatttgtgattttttagcaaattgcttatctaaaacaaggagcagacgccgttgttcttgattgagtttataaaatacattattggcataaagaagtgaataatcataaaaattatgataatcctcactgtagagtttcaactcgatataatcttgctgactttcaaccttaaatttaaaaatctccgaatcattatcaagggctataaatgtaaaataattgaccgttctacctgtaatctgaagttgataattctctaaagctgaaactaagtccattgcttcttcaaggaataaaaatggaatattaagataacgaccatttttaatatataaggatttggtaagtgcttcatcggatttactatcaatttttaaaagaaaagttaaaaattcttgacttgcttcatcaaaattatcaaaaaagaggtcaatatagtgtagagaacccaaagaatactgactataattttttaaagcacgtagaaaataaggaatatctttaataacgtatgagcggcccaaatttttacttcttaattttaaatcaaaatacaaaaaataatccattgaaaaataatcataaagctgactattatcctcaatttgaacttcgatagagtattggtctgtattgaaatttaattgtgtctcaccatttacagcatctaaaaaagcaacattttcaccaaaaagcgctcgttcagctcctttgatttctttgtcttttgtttcctgacttcctttatcttgattttttagatactcttctatcgctgcaatatgtttgcaatagcggtggttttgttgaaaggcttcacaagtacaactatcttgcgcaccatctaggtcataacttacctcttcaccatcaatttctgctgttagtttaaaatcagtttcaattgggtcatttaagaagcctttcgcatagagggcgattccctcacttcgcactcgtgccggcatcattctactcatatttttatatttttcctcgaatcaattatttcaaaattttgcgtatattataccataattaccatttttttgctagaatcttcctcgttcttatcaatttttaaaataagagctgttttagtaaagaatatcctcctctttttactacttattcggtgtcatggttttgactgataatcttattataacaaatattaaaaataccgactagctgtcagtattttttaatcatcattatttacaaatatattttctactttccacgatactttttcaataagtaagctgagatgataagtagtaacccaactcctcctacaccgccctgtattcgctttatttcatgccaccactgattttcattactttttattttttcttattttttagtaagataaggtacttattttagtctttcttaccttctgagaataaaattctttgattttttacgtagaaatgatgtttttaaacttaagtaaatttttattataaatagtagaaaattgaactttcttttattttgtagtaaatagttcgtctctatattacgtctttatatagtagaaaacttaaaatttaacaatttattttcaaattcttggattttattacattagagataaaatatccccaaagatagaaatgactgtctaaaagctgtggtaaatttttcttaattttttctttttccacagcaaataatctgtaaatttaactttttttggtttgtggataagtccgtatgcatttggtattccttatcttttcctgtggataaaaaaacttttacacattatccacagttttgttaataactttttcttatggtggaaaactttcttttgttaatttcaacagactgtggaaaaatataaagtgaagtgatataatgagttatcaacaaactaaaaagtaaaggagtaatatggcatcccttaatgaaaatcaaaaattttgggcccgtgtaaccgaactagctcagcagagtatcgggaaacaagcttatgatttttttattgagcctgctcaattaatgtctgtcgagcaagatactgccaatatcttgcttgatagtggaatgaaaaaagattattggaaaaaacagtccgatttgatcacaacggcggggtttgagatctttggtcggatgattgattatgaactctatgcaaatgatgagttaactgaactggaacttcatcgtttaaataatcaatcttctattgaagagcagccgcgttctactgttaaacccacttctcctttggttagtggtctcaacgagaaatataattttgaaaattttgtgcaaggtcctggtaaccgttggactttggctgcggcaattgctgttgctgataaacctggtgatacctataatccactatttatttatggtggagctggtctaggtaagacgcatttaatgcatgcaattggaaatcagattttgactgacaatccgacggctcgaattaaatatgtttcttcggagaatttcgttaacgactatgttaatgcaacgcgaaaaaaccaaatggagaattttgaaaatacttatcgtaatttagatttacttctattggacgatgtgcaatttttcagtgataaagaggggacgaaaaatgaatttttcaataccttcaatgcactctatgataaaggttcccaaattgttttaacttctgatcgtattccgcaagaattaaataatttggaagatcgcttggtttcacgcttctcttggggtttgactactgacattacggctcctgactatgaaactcggatggctattcttttgattaaatctgaatcaagtcgtttagaatttccgagtgaaactctatcttatattgctggtcagattgactcaaacgttcgagaactcgagggcgctctaaatcgggtcgaatttgtggctcgagcaaatggcattgcggttgtcgatatcgagacagcaagtcaggctttgcgttctttaaaaaatgcaactcagcaatctttatcaaatcttactattaaaaaaattcaagatgaagttgctaattattatcatatttcattctcagatcttgttggtcctaagcgtcctaaggaaattgcctttccaagacagattgcgatgtatcttgtcagagaacttttaggtacaagtcttccggcaattggaactgcttttggcggccgtgatcacacaacggtaatgtacgcttataaacaaatttcggataagatgaaaaatgatatggatgttcaaaaagacatcgatagcattaaacgtaaattttgaacctgtggaaaactcaaggacttataaaatacttattctttaattatccacaggggaaaagcttatacttctaagtggatttgtcttatacagattatccacaggacctactactattactattatatttataaaaagaaattataaaggaatctcatgattaaattttcaattaataaaaatgcgtttcaaaatgctttgagaattaccaaacaagcaattggttctaaagtaacaattcctgctttaacaaaattaaaaattgaagttgaagaaaatggaattactttaattggttcaaatggtcaaatttcaattaagaattttttacctgttgataataaagatgcaagtatgcttatttcagggactggttcagttttgttagaagctgctttctttgaaaatgtggtaagtcaattacctgaagtcactcttgaatttactgaaaaagaacaaaagcaagttttgttaacttctggtaagtcagaaattactttaaaaggcctggattcagaaatctatccgcatttacaagaaatttccgaaggctcttcattgaaaatgaaagttaaagtacttaaagaaatttttacagaaacagtttttgctgtaagtactcaagaaaatcgtccaatttttacaggtgttcatttagaaactttatcaactggagaattaaaagcagtcgcaactgactcacatcggatgagtcaacgtttattgcctttagaagattcagaattaaaatttgatgttattttgccaaataaatcaatcaatagttttaaaaatgttttcacaaatgatgaagaagagattgaaattttcatcagtggaagccaaatgctttttagaaatgaaacaattagttattatagtcgtttgattgaaggatcttatcctgatactaatcggttaattccaaatgaagctgattatactttagatttagtttttgatgctgcgcaattgcgtcatacaatggatcgtgcgcgtttattgacagtaatgacaactaatggaactgtaaaattgacggtttctgatgattctgtagtaaccacagccaactctcctgaggtaggttctgtccatgaagaattaacagccttatcaaaagaaggaaatgacttagcaatcagctttaatcctgaatatttgattgatgctttgaaagtgattaaagcaccagaagttcgtattcgctttatttctaatgttcgtccgttcactttacaaccacgtaatgaagaatctggatttgttcaattgattacaccagtacgtacaaattaaaattactgacagctcttttgtcagcttagatttgctgacgaaaatgtctgtcagtaattttagattttgttataatggacttaacgaaagttaggtctattttttatggaaattttatatactgaaattacacaagatttaacagagggactattagagatttctcttgaagaacttgaaaaaaatcgaaaagtttattacattgtgccttcttcaatgtcatttgagaaggagaaagaaattttagagcgcttggctaagggaggtgatgcagcagtttttgacttactcgtcactcgttttaagcaattgccctattattttgataagcgggaaaaagcgacaacaaagacagagttaggaacagcaggcctttcaatgctttttcgacgtgttttaaggagttttttaaaagaagaaattccattgtatttttctctacaggattctgctggttttttggaaatgctaattcagttaagaacagagttactgacagcaaatatgtcagtagaaaatttacctgacagccctaaaaatcaagaattaaaaaagatcttaagtagatttgaagaaaagttagcaaatgactatgctaactactcagaatttagtgattttactagtcgtcttgctgatggggaatttgattttcaactcaaagatgtgacaattgtcattgatggatatactcgattttctgcggaagaagagctttttattgaaagtattcaagatagagtggcacgttttgtcattggaacttatagtgatgaaaattcactgacagccggatctgaaacaatttatatcagtacgagtcaaatgattgggcgttttcgcagtaaatttccagtagaactaagaaaaatggcttcttcatctgtcaatgaagtttacaataagttgacaaaattactcgatttagattcaagatttgccatttctgatcaaaatattgaaataaattctgctgatgcaaaatatttcagaatttgggaagccgaaaatcaaaaagttgaaattgaaggtgtcgcaaaggaaattagacaaaaaataagtcagggggcttttttcaaagattttacagttttagtaggcgatccagctgcttatgaaattactttgaaagaaatttttgaactttatgaaattccatttttctatgcccaagaagaatcaatgagtcagcatcctttggttatcttttttgaaagtttactttcaattaaaaagaataattatcggacagatgatgttgtcaatcttctaaaaagcaaggtttacactgatgtcaaccttgatgaagaagttattgattactttgaatactatgttcaaaaatataagatttctggtcgaaaaaaatttacggaagcattcaatgaaagtgagttttctaaaattgaattagtgaatcaacttcgcgaaaacttattgggaaatgattctcctttacaagtctttttggggacaaatcggcaaaaaacaggaaaaaaatgggtttctgatttacaagttttacttgaaaatggaaatgtaatggccaatatgaacacttatttttcagaagcagaatctgaaaataagcatcaaatggctgataaacatgaacaagtttggcaaatgcttatttcgatattgaatgagtttttggccgttttttctgatgaaaaattgaaaagtgtggagtttttagatattttattagcaggattgaaaaatgcaaaatatcgacaaattccagcaaacgttgatgttgtaaacatcaaagattatgaacttgttgaacctaaaactaataaatatatctatgccattggtttgagtcaaactaattttccaagaataaagaaaaattcaacacttttatccgatgaagaacgactagaaatcaatcaaacaactgatgaaaatcagtttattgaacagttgaacgttgtcaactatcaaaaaaatcagtttacagtcctttctttagtgaattcggcaaaagaaactttagttttgtccatgccacaaattatggcaaatgagcaaggagaattttcaccagttttccaattatttttgaatcatgcggatgaaaaaattcttcaaaaaattcaagaagtcaatctttttgaaagcttagagcacattggaaacagtcgttcagtgatttctatgattggaaaaattgagcgtgaacttattgaaactgaagaaaaaaatgatgacaaaagagttttttggtctagtattttccgaatcttagttaagtcaaatcctgattttcaaaaaatattattggatttagctaaagatattgatacggtcaacttatcaaaagaaaccttagacaaaatttatggtgataaactttatgcttctgtcagttcttttgaacgcttttataactgtgaatatcagtactttttagagaccactttgggtctggaaacttttgaaaatattgatataaattccaaaattgtcggtaactttttccatgaagtttttgaaaaagtcatgcaagaagaagctttgtcagctgaaaattttgatgaaaaattgacaaaagttttacatgatgttgacagtaattactctcgttattttactcaggatgcaactgcaagatttacttggaccaatttagaagaaattgttagacagactgcaacagttttaaaggaaacagtttctactgatgaacttaaaactttactgacagaaagtagttttggcttaccaaaaagtgaattaggtaatttttctgttgatgatatttacttacgaggaagaattgaccgtttggaccaactttcttctgattatttaggagctatagattacaaatcaagtgctcattcctttaaattacaggatgcttatgacggtctgagtttacaatttatgacctatttagacgtgattaaagaagcttttcctaatcaaaaaatatggggtgctctttatttacaatttaaaaatcaaccaattaacttatcagaaatcaatcatttatcagagattgctggcttattgaaagaatcaatgcgctatgatggtttagttttggaagaggcagctgaccaaattaaagcaatagaaaatattactgtaaaaaaatctaatatttacaatcaagaagaatttgaacagcttttaaaattgaatgaaaatcattatcagcatgctggtcagcgacttaagagtggtcagattgcaataaatccaattatgaaacgctccgaagggattgatcaaacaggtaatgttcgaggttgtcgctactgtccgcttaaatctatttgtcgatttgaagcaaatgtacacatgaatgatcacagtcgtgaaattggtcaaaaatctcaagcagaaatcttagcagaattaaaaggagaagggcgaaatgagtgaagtaaaattaactccagagcaaaatgaagccattcatagttctggtaagaatattctagtttcagcgagtgctggttccggaaaaacttttgttatggctcagagaattgtcgagaaagtcaaacaaggaattgaaattgatcgacttttcatttccacatttacaaaaaaagcagcaagcgaattacggatgcggcttgagcgagatttaaaaaaagccagacaagaaagttctgatgaaaatcaagctcgtaggttgacacttgctttacataacttgtcaaatgctgatattggaactatggatagtttcacccaaaaattgacaaaaacgaatttcaatcgagtaaatattgacccgaatttccgaatcttagctgatcaaacagagagtgatttaattagacaagaagtttttgaacaattggttgagtcttatctatcaggagatgaaggattgaatgtttcaaaagaaaaatttgaagaacttataaaaaatttttctaaagacagaaatattgctggttttcaaaaagtggtttacactacttaccgttttgcatcagcaactgaaaatccaataaagtggttagaaaatcaatttttaaaaggttttgaaacatataaatcactgacagacttgtctgcagatttttcagcagatataaaagagaatttactgatattttttgaacttctagaaacttcattaaccaatggagtaattgctaaaaaaggggctggacgtgataaggccaaccttattttagataataaaaatgaactcttagaagcaataaccactaaagattttgcaactttcacagaactatttttatcaatagatacagatattcgagtgggttcttcaaaagatgaaatactttcggctctgaaaaaagatttttcagcacaaaagcaagacttagtcggctcgaaatccaaacctggagaaattcggaagtttgttgataaaataaaacatggtcagttgattgaaaaatatcaaaatcaagcatttgaaatcgcagaaaatttacaaaaatttgttattgagttttaccaaagttatttagaacgtaaaaagaatgaaaatgcttttgagtactctgatatcgcacactttgccatcgaaattttagaggaaaatccagatatacgtgaaactttaagagaacattatgatgaaatcatgattgatgagtatcaggataccagccacactcaggagcgaatgctggaacttttatcgaatggacataatctcttcatggttggtgatattaagcaatcaatttatggctttcgtttagctgaccctggcctctttttagaaaaatataaagactatgccaagacagaaaatccaaatcaattaattcgcctaaaagaaaactttcgttcacgtggtgaggttttaacatttacaaatgatatctttaaacacctgatggatgaaaaattaggtgagatgacttatggcaaagaagaagccttagttcaaggaaacattactgattatccagttgaatctgagaaagatttttatccagaacttcttttatacaaagaaaatacaagtgatgaagaaacagatgaatccgaagtaagaatttcggatggagagattaaaggggcagctcaagaaataaaagaattgattgaagctggagttgagccaaaagatatagcaatcttggttcgttctaaatcaaataataataaaattgaggatattctgcttagttacgatattccggtcgttcttgatgaaggacgagttgattttttgaaatcaatggaagtcttaattatgctagacgttttacgagcaattgataatccactctatgatttatcattggttgcgatgttaaggtctccgttatttggatttaatgaagatgaattaacgagaatcagtactcaaggaagccatgaccttcgattttgggataaaattcttttgtcacttaataaagaaggacaaaatccagaacttatcaatccttccttagaggacaagcttaaagcattttataagaagtttacagagtggcgtaaacttgtaaaccaagttgcaattcatgatttactttggaaaatatatacagaaacctactattttgactatgttggtgccttaaaaaatggtgaaatgcgtcaagcgaacttacaagccttagcggttcgagcagaatcatatgaaagttctggttataaaggattatttaaatttgtaagattaatcaacaaatttatggaacaaaataatgatttagcttctgttaatataaaacttcctcaaaatgctgttcgagtgatgaccttccataaatcaaaaggattagaatttgattatgtctttttaatgaatttacaatctcgtttcaacgatcgtgatttgaaagaagatgttatcctaagtcgtgaaaatggtttaggaatgaagcttattgccgatttaaaggatgaagcagatgttataactgatttcccttatgctttagtgaaaatggaaacattcccttatatggtgaataaagacttaaaacaaagagcagctctctcagaagaaatgcgtgttttatatgttgcatttacaagagcaaagaaaaaactttatcttgtcggaaaaataaaagaaacggataaaaaatcaggacttgacctttacgataatgcaagtttagaaggaaagattttagaagataaatttcgtaattcaagtcgcggttttcaacactggatattggcgcttcaaaatgccacaaaacttccgatgaaactcaatgtctacacaaaagaagagttggaagcagaaaaacttgaatttacaagtcaacctgatttcaaaaaattggtcgaagaatcggaaaaatttgataatatcatggcctattctgatgaaatacaaaaagctcaaaaaattatgaattatgaatatccaaatcaagcagcaacagagctttcaagtattcaaacaccaagtcaggttaaaaaacgaagctatgaaaaacaattacaagtgggtgaaattcaaccgataagtgaatttactcgggtcaaaaagctagatttttctgattttggtcctaagaaagttactgctgcagaaatcggttcggcaacacatagttttatgcagtatgcagatttttctcaagcagatttatttagttttcaagcgacacttgatgaaatgggatttgatgaaaaaataaaaaatcaaattgatattgctaaaattttgactttgtttgatacagatttcggtcagtttttatcagaaaatgttgataaaacagttaaagaagcaccattttcaatgttgagaacagatgaatttgctaaagagcagtatattgttcggggaatttgtgatggatttgttaaacttactgataaaatcgttctatttgattataagacagatagatttacaagttcttcagctatttctgaaataaaagagcgttatagagatcagatgaatctttatagtgaggctttgaaaaaagcctacgatgtcaaccaagttgacaagtatctcattttattaggaggccctcagcaagtttttgttgaaaaactagatgattagattataatgacaggaattgtatagaaaggatagataatgctggaatatgaattaggttcgattgtcgagatgaagaaacctcatgcctgcactgttaaggcgactggtaaaaaagcaaatgcttgggaaatcactagattgggtgcagatatcaagataagatgtacaaactgcaatcatgaagtgatgatgagtcgttttgactttaataaaaaaataaaaaaggtgctcaagtgagccctttttttaattataaaccgatttgagattaaatttgaggtatttaataagccaaaagtaaagtaactttgtaaatcgccaaatcaaagggctaacaagaaccatcagcgaacaagcgataattgcaactaaccagtaccaccagtcaaaacctgttgctccattcgcattgccaaaagtaatatgtgggttatgagtagcaacagcgaaaatcataataaatggagcaaggaataaagctaatataatagcatagagagccaaaagaatcaaagcagtagtaattatcaaccagaaaccaagaacgaagttaaaaaagactaagccaaaaccagcaaataggttgatatgtttctttcttttttggggttcaattccttgagcaaaagctgataaatctgattcatataattcggctagggcaatcaatgtttcaaaatttggttcagttttattggattcccaacgtgaaatggcttgtctactaaaataaagttcttttgcaacttcttcttgtgtgagcttctgggcaagacgagctttttgtaaattttctccgagcattttttctccttaaatttaaatgggcaatctagtgatttgtttctgatttcattatcaactaaagcgaagttaaaagcaagaacatagtggtattttagggtaacattttgtggcaagcctttaaaataaaggctagtgatgatacgctctattgtttacgagccttgtgtaaacttgtaaacttagagattttctatgattttccttgcctttattgtgtttttaggcgatttacagtataattagaactaattaatcttaattttggagaatataaaacatggctttaacagcaggtatcgttggtttaccaaacgttggtaaatcaactctttttaatgcaattacaaaagcaggcgcagaagctgcaaactatccttttgcaacaattgacccaaatgtggggatggtagaagtaccggatgaacgtttaaacaagttaacagagttgattaaacctaagaaaactgttccgacaacttttgaatttacagatattgctgggattgttaaaggggcttcacgcggagaaggtctaggaaataaatttcttgccaatattcgtgaagtagatgccatcattcacgttgttcgagcttttgatgatgaaaatgtaatgcgtgaaaataatcgtgaagatgcttttattgatccaatggcagacattgaaacaattaatcttgaattaattttggccgatttagaatcagtcaataaacgttatgcgcgtgttgaaaaagttgctcgtacagcaaaagataaagatgcggtcgcagaatttaatgttttgaaaaagctcaaaccggttcttgaagatggtaaatcagcacgaacaattgactttgacgaagatgaaacaaaggttcttaaaagcttgttcttattgacaagtaaaccagttctttatgtggctaatgtttcagaagatgaagtaggcgaacctgataatatcgaatacgtgaaacaaattcgtgagtttgcggcgactgaaaatgctgaagttgctgtgatttctgctcgtgttgaagaagaaatctcagagttggaagatgatgaaaaagcagaatttttggaagcaattggcttaaaagaatctggtgttgatatgttgactcgtgcagcttaccaccttcttggcctggccacttactttactgctggtgaaaaagaagtccgtgcttggaccttcaagcgtggaatgaaagctccacaaatggcaggaattatccatacagactttgaaaaaggctttatccgcgcagtaactatgtcttatgatgatttgcttaaatacggttcagaaaaagctgttcgtgaagccggtcgcttgcgtgaagaaggaaaagaatatgttggtcaagatggcgacattatggaattccgtttcaacgtgtaaaccttgtaaatgaaatgaagaagtgcaccgaatcggtgcatttttgcaacctaaaaatgcttgagttgaagaataaaaaacgatactcttaaagcatgaaaggaaggcaacatggaaatctctcagataatcaaagaaaatcgtaaaatgaaaaatctcagtcaggaagaattggcgaaaaaaatgcatatttctcgtcaatcaatttcaaaatgggagacaggaaaatcactaccaacaacagaccaaattatcttacttagtgaaattttcgattgttctttggacacgttgctcaaaggtgacaaaaagatggaagaaaaagcaaaacatgagattgatgacaaacggactttgaagttaatttataaggtgggttggggatttatcattcctttactttttattttgaaatttgttttacatttgttttgatgataatgaaagactcaataggaatattgggtctttttgttcgctataaaataccatgccttgcttaatattacaatgattgaaaaaacaaaactttttattgacataaaggttacataagagtataactataagaaaacggaaacattttctgttaagaaggaggtgtaataatgtaaatagaagtttacacgcgcttaaattagcgcaaaaaaatgatgaataaaattattatcccatcaatttgattaagtgaagataacaaataaagatgaagttaatttgaaaaattttccttagtcaagaagtggctcaatgttttaaattaagcttaggagaaaacttatgaaactaaaaaaatatttaatcaatgtaggaactattttattgtttattttaatatttagtgctcctgcaaatgcgtcaacacaattggtaagcaataatggttcaacagttgtatctaatgctaacccaaccattaccaattcaatatcaggggtatctaaaaccctttttgttcccaatacattaacaaatagttattttactggaaatggtagttcctctattatcaataacaattggactcatgttaatactactactaactatccttattctgcaattgcatgggtggttgctaattttcccaaaggttctcaagcaggaacagcatttttcgtttctccttacaatcttcttacggcagggcactgcgtatataataaggatttaggtggatgggctacatcagtaagagtatatccaggaaataatggaacttatgctccttatgggtatttctcttcctctaagttatatgcggattataactgggtaaattcttctgatagcaatgcagaatcttcaacatataaccctagaaatgatttgggagcgatttctctaaatacaggtgtagggagaatgactggtttctttggaattaattcctcaattacaaaaggttcttctgttgttttaagtggttatcctggtgctaaatttactgttagccaaggagtaagttatggaaatatgtggacttctaaaggaaatgtaacagcggtaaatacagataccttgtcttacaacaatgatatgttacccggagatagtggaagtcctgtttatacctcaaataatcaagtttctgccgtaaatacagaacaaatattattttccaatagtagtaataatacaaatgttggtacaagattgaatggagaaaaaggttcattcgtttctgcttttactggttatacttcttacacaaatgtttatagattatataatccaaatagtggcgaacatttttatactacaaattcaaccgaacaaaccgttctagtaaaagctggatggcgatatgaaggggtggattggtttgcaccaacaaactctaaactaccaatctaccgtttgtataacccaaacacaggggatcatttttatacaggaaattctgcagagcgtgattcacttgtaaaagttgggtggagatatgaacaaatttcattctattctgacccctcaaatggtcaggcggtttatcggctctataatccaaatgcaaaagttggttcacacttttatacaacgagtctggcagaaaagaatagtcttgtaaaatcaggatggaaatatgaaggagtggcatggtatggtcttagctaaaaataaaaaaataatgatttcaacaattccgttagtaattttgagccttgtttgtttcaaagaaaatctacctgctcaggcatcaacaaagtcattagatacaggtgaaagttttactgaagtttacaatagggacaatggtttttatttaaatagtcctttttatgatatttcaaaggtttcaaaaagtgtttatgttggggaaagtggggcttttaatcaagttaaagttttgccaatctataatatgacgccaaagggttctgtgaatttttatcaaaatacagcaactaataatcttattggggcaaccctaccctcgctatccacgggaacaatagctttgacacaaggtgggcaatatactgctcaaaaagctggaacagctacagttgcattgacttatatgctgtctagtgatttcaaaaaagaattacttagtaaatatcctgatgcttggacaaatattgcacctactagctacggttctcctgattttatgtatgcgaaatatagtaatcaaactttctatgtaacaatcaaggaacataccgtcccactttatcgtatgtacaatccaaattctggagaacatttctatacggaaaattcctttgaacgtgattcactcgtgaaatctggttggaactatgaaggaatctcagaagaatctccaataaagacagtctataatcaagcagtttatcgtgtttataatccgaatgctggggaccatttttatactgaaaataaagcagaagttgctcatttggtttctctaggttggcgtgccgaggggatagctttttattcaagtacatcaactcaaactcctatttatcgtctctataatcctaatgcgacagtaggaactcatttttatactcaaagttcagctgagcgtgactctcttgtaagagcaggttggaactatgaaggaacggcttggtatggtggataattactatagagtgattatcttagatagagcaaacgtaaaaggctcaatagaaatattgggtctttttttttctcctctaggtaaataaacatgttataataatctcagaagctgatttttatgaatcggccttttggcatttattgaaatatttactgacagataaaaataggacagctgaaaagtctgtcagtaaaatgcgactgaataaagagcattttatcggtgaataaaagaattgtcagcgaagctgaaaattctgtcagtaaatttggtaggttaaactaatgaaaatctatattgtcggaacagttggttctggaaaatcaacgttggctaggaaattaagtgaaaaaaactcaatgcgagtgtttcacttggataatatcgttcatgaaggtgaaagaaatcgaacagataaagaagttttcgagtcaattgagtgtatttttaagaatgagtgttttatcattgaagatacattacgcgaacgatttattccattgttagacaaagttgacaagattatttatttagatttacctaagaacttactgaaatatcggataattaagcgctatgtaaaacaaaaattgagacttgaaaaatcaacttatcgaccaagtttacagatgttaaaacagatgtttatctggcaaaaaattgaccggagtgaactgataaatgctcaaaaaaataaaattgttttacacaataaaagagaaattcggcaatttataaaaaattttcaaaaatagagaagaaagaatagaaaatgacaaaaatgattgttggcttgggaaacccaggcgataaatatgaaaaaacaaaacataatatgggctttatggcacttgatttactggcaaaagaactgaatgttgattttaaagaagaaaaaccttttatgtcgcttgtcgcgtcaacgtttgtgaatggtgaaaaattgtttctcgtgaaacctctgacttttatgaatgaatctgggcgtgcggtggcgccacttttgaaatattataatatagacgaggcagatttaacggtcatgcatgatgacttggattcaccagtcgggcgcgtgcgtctaagacaaaaagggtcatcaggtggacaaaatggaataaaatcagtcattacacatgtgggaagtcaaacttttaaccgtgtaaaaattgggattggtcgtccaaaacatgggatgacagttgtgaatcatgtactctctggttttgacaatgaagataaggaaatcgctcaagatggaattttcaaagctgttgatgcaatgaaattctatcttgaaaatggtgattttcaaaagacaatgaataaatttaactaaatgaatattattgaattttttgaccaaaattggcaactacaaaaatggcaacaaggtttttcaaagcgtgagcgaactttactgacaggattgtcaggaacagcaaagagcttagtgatggcaaatgcttatgaaaatgttgctgacaaatatattattgttactgacagccagtttcatgcgaatgaactttatgatgaactgtcaactttgcttggtgaagaaaaagtttttcaatctttttctgacgataacatctacgcagagttcgcacttgcatctaaagatcgagttgcttatcgacttgaggcacttaatttcctacttgacgaaaagtcaacaggatttttggtcgtaccttttttggcattacggagctatttaccaagtcccgaaaattttttagaaaattatcttttactgacctctggggatgagtatgatttatcaaatttagttaatttattatcaaaagctggttatgaaaagacacagcgcgtgatgacgccaggtgaattttcaatgcgaggagatatcgttgatatttatcctttagatgcggaaaatccggtacgtttagagttttttggtgatgaagtagatacgattcgctcatttgatgtggagagtcaacgttcactgacaagccttgaacgtttggaaatatatccggccagtgattttattttgactgacaaagaatttgacaagggtgcaaaatcactgacagaaatgacaaatttactgacagacccgtcagcaaaatcatatatggaagaagtgatttcagcagctcaaaatcactattatcacaaagatttacgaaaatttgcggaggatttttatgataaaaaaacttcacttttaaattattttccaaaaaatgttcaaatattcattgatgattttcaaaaagtaaatgaaatgaataataagttagaaatggaattagcagatttcattttatctgaaaaagcaatggaaagaggatttgaagggcagacttatttgctagatacaatggcaaaagttagaaattataagcctgctaccttcttttcaaatttccaaaaagggctcggaaatctcagatttgaacaactttataatttcaaacaacattcaatgcaacaatttttcggtcaattagaacttttttacactgaagttgaacgatttattaagcaagagtttacagttgttttagctgtatcatcagaaaaactccgtaaatcactccatgaattagatttaagtttacaagaggttgacagagaatctattcaagtgggtaaagtcaatctgattgatttgcaattatccaatggttttaatttccttgatgaaaaattagtcgtcatgactgagcatgaaatatttggtaaaatgcgtaagaaaaaggcacgcaaactgaatattacaaatgcagaaagactaaaagattacaatgaactcgctgttggtgattttgttgtccataagaatcatgggattgggaaatatttaggtttacaaacgcttgaagtcggcggaatgcatcgtgattatctgaccattcaatatcaaaatggggatacaatttctgttccagttgatcacctagatttactcagtaaatatacagctggtgaaggaaaaagtcctaaaatcaataaactgaatgatgggcgttggcgtaaaaccatgtcttctgtcagtaaacaagttgaagatatttcagatgatttgattaaactttatgctgaacgtcaggcgaaaaaaggatttgcattctcgccggatgacaccagtcaagaagaatttgattctggtttttcatatgttgaaactgaagaccagatgcgttcaatcaatgaaattaagcatgatatggaacttgaacgaccaatggaccgcttgttagttggtgacgttggttttggcaaaaccgaagttgcaatgcgagcagccttcaaagccataaacgacgggaaacaagtcgcagttcttgtgccaacgactgttcttgctgagcagcattttaataattttactgaacgttttatcaactttggtgtaaatgtcgaagttctcagccgttttcaaacgaaaacacagcaaactgaaattctagccaaattgaaaaaaggacgagttgatttaattattggaacccaccgtttactttcaaaagatgttgaattttttgatttaggtttgatgattattgatgaagaacaacgttttggggttaagcataaagaacgtttgaaagaattaaaaacccaggttgatgttttgacattgacagccacacctattcctaggactctacatatgtcaatgcttggaattcgtgacttgtcagttattgaaacaccaccaacaaaccgttatccagttcaaacctatgtcatggaaacaaacttcggtgtggttcgtgatgcagtgttgagagaaatctctcgtggtggacaagtttactatgtttacaacagggttgacacgattgagcaaaaagtttctcaattagaagaattaattcctgaagcaagaattggttttatacacggccaaatgactgaagtacaacttgaaaatactttacttgcctttatcgcaggtgattatgatgtgcttgttgcaacgacaatcattgaaactggggttgatattccaaatgcgaatacgctttttattgaaaatgcggatatgatgggcttgtcacaactttatcaattaagagggcgagtggggcgttcaaatcgggtggcttacgcctatttcatgtatcgacctgaaaaaatattgtctgaagtttcggaaaaacgtttggaagctattaaaggctttacagaattaggctcaggtttcaagattgccatgcgtgatttgtctatccgtggtgctggtaatttactgggaagtgagcaatcaggatttattgattctgttggtttcgatttgtactcacaactgttggaagaagccattcacgctaaacttggaacaagtaagcaaaaacggacttcaaatgtggaaatttctttggaattggatgcctttattcctgcttattatatttctgatgaacgtcaaaaaattgaaatttacaaacgaattcgtcaaattgatagtcgtgagatttatgaagaactacaagaagaattggttgaccgttttggagaatatccagatgaagtcgcttatcttctggaaattggtctcttaaaacactttgcagataatgccttagttgaaaaaattgaaaaatcgaggtttgaagcaactgttactttggaaaaagtggctaataccacctatgatccacaagattatttcaaagctttggccaaaacaagcatgaaagcttctgtgggggaaaaatatggtaaaatgactttccgctttaaaattgaaaatcgaaattcagttgttcttttgagcgaaataatgaattttattgaagaattatcaaaaatacgagatagttacgaaaataagtaatcttttcgtaaaaaaagataaatatgatacaatatttttatataaaactataaaaaatagagtttaataattttaaagaaataaaaaaaacataaagagaaaaaattttcaagatgtaatttataaaattaaactcatatcttaaaggagatttataaaagtggatttaaaagcagcaaaagcggagttgagagaaaaaagccgtccttatcaaacttattcttactatcttatcattccaatctttattattcttgtttttctattatctttagtggggcacaataaaggaacttttggaacaatcgtttttgtttttgtgatttttgctcatgtttgggcaagtaaactggatttagtaagaaaaagaaaacatgtggcgccaattttaatgtatgtaactcaaggcttaggagttattcttatggttttattagttaccgaagtttcagcgggtgggacaggaaatattgctttaggactttcaagtcttattctacttccaattgaaattattgccattgttttcttctttatttcagctaatgatattaaaaaagcttatccaacaatgaaagaagatgccaaagcagcaaggcttgaatatcaagaacttagacgttcaaaataataaaaaaattactgacaggtctgtcagtaatttaataaggttctgtcactaatgatggagccttattattataaataaaggcattttcaaacaaaatgaaatatgttataatcaaaccatgagattagataagtttttaaaagtttcgcgcttgattaaacgtcgaccagttgcgaaagaagttgccgacaaaggtcggattaaaattaatggaaaattagcgaaatcttcatctgatgtaaaatttaatgacacaattgaaattcgtttcggaaataaaattgttgaagttcgggttgctgaattaaaagagtttacacgtaaagaagatgctgataaaatgtatgaaatgattagcgaaactcgtattacagaagaagttgagtaattatcatcaaaatagattggaggttgtcatggcaaagcaagtgattcaactaaataataagtacactcagaagcataaaaaaagaaatttaaacccagtaccaaaaagaaaacatttagggcttattttgatcgtggcaattttactttttagtttagcaagtatgagtttgataaaatcatatgaaactttgcacagtcaagtagctttagaacaaagtgcaaagaaacaatatgagagtctttctaaagaagtaacgattaaaaaagaagaaatatcaaaacttcaggatcctaactatctccaaaaatttgctcggagtgacggtcaagaatattcacaaagtgatgaaaaagtttttactactgacagtcccttgattggaagtaacgggtcaaaataatgattggacaagttgaaaacattacaagatttggactttttgtaaaaatttctactgacaaacttgacgaaagtacagaaaaacttgctgacaaagctgtcagtaaaaatagaggacttttgcgttggtcacaaatccctaaaaatgtacccaaagtacaaattggagatttgattggtgttgaaatttcaaaaatacacgaagatggtaaggttgatttaaattatcaagaaaaaaattttaaaaatgtctatgccgaatttttagaaacaagtcaccaaagacttacagaacttgagcaaaaaaatcgtgaattgaactaaataattaaaaagaaaaaatattatttagttttttctttgactattctattgactaaaaatagcacctattttatgaaaaattctaggaattaaaaagataaagattacaacagaaattattctatggaatggataagatgttgggcaaggttttaatcatgcaaaaacagagaacaaaaattaatagtggagtggccttggtgatgcttttaatgattatcacaggcttttttgctttttcacaaacaagatattttgctgacaaaaaggtcagtaaatccaaaaatattgttgtagctgacaaagttacagacaaagaaaaagaaactgaaacttggacttcaatcccccaaagagcagtggcttatcaagagttaacaacttatgaggactcaaaccttaccaaatcagttggtaaaattgcagctaagacacaattagatattgtcgaaattcttggaaaatcctttaagttaaagactggaaagtatatttctactgacaaaaaagctgtgatatcagatcttacaatttctagagagtcaacaaatacaacaatatatactgataaaagtgtcaatgtattttacaaccccgtaaccacttatgataatcaaataatgacaaatttaagtggcagtcatcaactttctgctgacaaaatcgctaagactaactggggaacttactacgaagtatctttagataatggccaaacgggttgggtttcagaaaatgatatttctttggaaaatccaaaaatcaaacaagttcaggcattattgaatcagaaatacaatgacaaaaagtattcaatctatgtcaaagaacttgacgataagtttacagctggtgtaaaccaagaacagaaaatgtattcagcaagtctttctaaaattccaattctttattggactcaaaaacgacttaatgaaggtttggcttcacttgatgacaaactattgtacaccccagccattaatactttttatggaagttataaaccagaaggaactggaaatttaccaaaaacagcagataataaatattacagtcttcaggatgtcatcaatagaacagccaaactctcagacaatgtcggaagtaatatgctcgcctattatgaaacccaagagtttaatccaaactatcaaaaagaaataaataggattgctggacaagagtggaatccaaaagagcgaaatgcctcagctcaaatggtaggtagaatgctagaagctctttataatgaaggaggggcttcctttaacgctttatttgatacctcttttgatgatgttaaaattagagcaggcgttcctaaaaatatatcagttgctcacaaaattggtggtgcagatacagataatcatgatgcagccattgtatttgcaagtaaaccatatcttttggtgattgaaactgatggggcaactgatgatgaaataaaagcaatttctcaagatgtttatggagttatgaaatgacaccagctcaacgtaaatttttaaaaatagtcaaagatgaacactattttgataaagattcaaaaatattattggctttatcaggtggtaaagactcaatgactctttttaactggctctatgatttaaaagaagttctcggtattgaactgggactggctcacattaatcatggcttacgagaagagtcaaagtttgaagaaattgctcttcgagaaatggcaacaaaacttaaagtaccaatttatattgacaagtttacaggagagtttacagaaaaaaatgcccgtgatttccgttatcagttttttgaaaagctaatgataagagaaaattacaatattttgctgacagctcatcatcaaggagatcttgttgaaacggtattaatgcgtcaaattacaggacgtcctttgagaagtcttcagggcattgctgaccgtcaaccttttgcaggtgggcaattaatcagaccattattgaaatttacaaaagaagaacttgatgcacaaacctattatgaagattcaacaaatcaaggactagattattttagaaatagaatacgtaatcaactaattccagaattaacaaaagaaaatcctcaattttcacaatcaatcagtgatttgagcttggaaattaaaaaggcgttggcagtaattaatcaaaaaatttcggaacttgaaattgttgatgaaaaaatatcatctgaaaaatttatctcccaaacaaaagaattacaacattttatcttacaagcattttttgctcaatatccagaaatagaagtaagtaagaaaaaatttgcggaagtacttcatattatcaatcgccctcaacaatatttcgcaaaattgaataaggaattttattttgtgaagactaaagatttcttttatcttgaaaaaattcaacttgaaagggagaattcagtagaaattgtaagtgaaaatccacaagatgaatcatttatggaggtttatttgcctcttgaaggagagcttgaaattcgtaaacgccagcctggggatcaaattctaatcaatggtcatcataaaaaattacgcaagttttttattgataacaaagttccattaaaggcccgagagaatccacttatcttcgttgataaaaaactctatgccattgtcggtcttgcgtgttctgatttgagtaaaatgctcaaaaatgataaaattagaagaatattatgggtcaaacccagtataggagaggaaatcaacgatgctcgaaaaaaatcttgataaggccattgaaaaagtattagtttcagaagaagaaattatagaaaaatccaaagaacttggagaaatattaacaaaagaatacgaaggaaaaaatccattagtcttaggaattcttcgtggttcagttcctttcttagctgaattaatcaaacatattgattgtcacttagaaactgactttatgactgtatcaagttatcacggcggtacaaaatcttctggtgaagtaaaattgattttagatgttgatacagcagtcaaaggtcgtgaaattttgattgttgaggatattattgatactggtcgtactttaaaatatctaaaagaacttttggaacatcgtggagcaaacgtaaaaattgtaacacttcttgacaaaccagaaggacgaattgttgaaattaaaccagattattcaggttttacaattcctaatgaatttgttgttggatttggtttggactacgaagaaaactatcgtaatcttccatatgtcggagttttaaaaccagaagtttataacaaataattcgttgattttagtcatctaaagttttctcagactaaagtatgaaaaaatctctgaccaatacttactattagcattccaaaaggaaatatgctataactaggtatagctgttattgactagcctgtatcctttattaccagtgatactaagaagtaaattcttggcttttctaataataaataaacaaaagataaggaaaatatgaataacaacaaacaaccaaaacaaggaaattttgtaaaaaatatcttgatgtgggtaatcttggctattgttgttgttgtcggtttcaatttcttcttcagtagtaatcaatcgagcgtggataaaattagctattcacaattgatgacgaaacttgacggtaacaagattgaaaacgtcacaatgcaaccttctgatagcttaattactgtaacaggtgaatataaagaacctgtaaaagtaaaaggaacaaataatttcccacttttaggtaattctagtagtgaagttaaaaacttccaagcttatattattccaactgacagtgttgtcaaggatatccaaaatgcagctaaaagtaatgatgtaaaacttagtgttgttcaagcttcatcaagtggtatgtgggttcaaattctctcatatatcattccaatgcttctatttgttggtatcttctggctcatgatgggcggaatgggcgctcgtggcggaggcggcggtggaaatccgatgtccttcggtaaatctcgtgctaaacaacaagatggtaaaacatctaaagttcgttttgctgacgttgccggttctgaagaggaaaaacaagagcttgtagaagttgttgatttccttaaaaatccgaaaaaatatcatgatttaggagctcgtatcccagcaggtgttcttcttgaaggccctccaggtacaggtaaaacattgcttgctaaggctgttgccggtgaagcaggagttcctttctatagtatctcaggttctgatttcgttgaaatgtttgtcggtgtcggtgcctcacgtgtccgtgacttatttgaaaatgctaagaaaactgcaccatcaattatctttattgatgaaattgatgctgttggtcgtcaacgtggtgcaggtcttggtggtggtaacgatgaacgtgaacaaacccttaaccaattgctcgttgaaatggatggtttccaagatgatggcaactcagtaatcgttattgctgcaactaaccgttcagatgtgcttgacccagcacttttacgtccaggtcgttttgaccgtaaagtcttggtcggagctccagatgttaaaggtcgtgaagccgttcttaaagttcatgctaaaaacaaacctttagcaagtgatgttgatttgcacaatgttgctacacaaactccaggctatgtcggagctgatttggaaaatgttttgaatgaagctgcacttgttgctgcacgtcaaaataaaaaagaaatcaatgctgctgacattgatgaaggaatggaccgtgcaatggctggtccagctaagaaagatcgtattcaatcaatgcgcgaacgtgaaatcgtggcttaccacgaagcaggtcacgctattgttggactcgttcttgaaaatggatctactgttcgtaaagttaccgttgttccacgtggacgcatcggtggttacatgcttgctcttccagatgaagaaatcatgcaaccaactaatttccatcttcaagaccaacttgccagccttatgggtggacgacttggtgaagaaattgtctttggtgtagctactccaggggcatcaaatgatatcgaaaaagcaacacacattgctcgttcaatggtaactgaatatgggatgtctaagaaacttggtatggtatcttatgaaggagaccatcaagtatttattggtcgcgactatggtcaaactaagacttactcagaagcaactgctgttatgattgatgatgaagtgcgtcgtattctcggtgaagcttatgaccgtgctaaagaagcaattgaaacacaccgtgagcaacataaagcaattgcggaagctctgcttaaatatgaaacacttgatgcgaaacaaatcatgtcactcttcaaaacaggaaaaatgcctgatgaagcagcggcagcagaagtaccagaaccaaaaacatttgaagaatctctcaaagatgcaaatgcgaatgttgatgatttttcaaacattaatatctataatggtgatgaaaaaacagattctaaaccagaagaaaataaagaaaaatcagaagatgaaacagccgaataaggctgtttttctttttttttatgttttagaataagtggtctagtttattcttgacaaaaaataatattttgatataattaaatagttgtcgtttgagacgactgactttcttattattcatctaaaatattattttgaaaagataacacagtttattcttgacaaaaaaatataaaagtgtataatagaaaagtactgtttgagacagcacaacaatatatggtccgttggtcaaggggttaagacaccgccttttcacggcggtaacacgggttcgaatcccgtacggactatatctggaggattacccaagtccggctgaagggaacggtcttgaaaaccgtcaggcgtgtaaaagcgtgcgtgggttcgaatcccacatcctcctttttaattatcgcgggatggagcagctaggtagctcgtcgggctcataacccgaaggtcataggttcaaatcctattcccgcaattttggctcggtagctcagttggtagagcaatggattgaagctccatgtgtcggcggttcgattccgtctcgcgccattccttatttagcggatgtagtttaatggtagaaccccagccttccaagctggctacgcgagttcgattctcgtcatccgcttaacttaatattttgggagtttagctcagttggttagagcactgtgttgataacgcaggggtcccaggttcgaatcctggaattcccatatttggtatttattgcataggagatatacctgttcccatgtcgaacacagaagtcaagtccttttgcgctggaagtacttgggggttgccccctgggagataaagtcgatgccaagtttacattgcggattagctcagttggtagtagcgcatgactgttaatcatgatgtcgtcagttcgagtctgacatccgcagtaactaagtcacctaagggtgactttttttattttataaatatcatcaataaatcttggcacgcctttttgtgtcaaggtttttatttacagctttgttggtagcggttacaatataattatactagttactatgtaaaggagtctgaaatgactgatactgtaaacttaaaagtacgagtgcaaaaacttggtaccgcattatcgaatatggtaatgccaaatattcctattttgattgcctggggggtgttgacgatgttcttcattcctgatggttttacccctaataaaacatttgcagcaatggttagtccgatgcttgctttttttattcccctaatgattggttacactggtggaaaaaatatttatgaacatcgtggaggagtggttggtgcaattgcgactttcggttcaattattgccacagctagtctttctctaggaggtctaaacactaaaggaaatgttcctatgattttaggtgcaatgattttgggtccttttggtgcttgggtaataaaaaaatttgatgactatgttcaaccgcatattaaagcaggtctggaaatgttaattaataatttctcagctggtttagttggatttggacttgcactttttgctgtaaaagtggttggtccacttgtagcttggctaaccgacgtgatgggacatggggtcgactttttaattgctaatcatttgattccccttgctaatctttttattgagccagcaaaaatattatttttaaataatgcaatcaatcaagggattttatcgccattgggaattcagcaagtttctgaaaatggaaaatcacttctatttttattagaagcgaatcctggaccaggacttggaattctgattgcttttatgctttttggtaagggttcagctaaagcgacggcacccggtgcgattttgattcaatttgtcggtggtatacatgaaatctattttccttatgtcatgatgaaacctgcgctcttttttgctgtgatggcaggtggggtatcaggaaccttgacaaataatttactaggctcgggtcttgcggctcctgcttctcctggttcaattattgcaatcacaggaatggcatcagctaaatcagcgggtggttttgtaaatgtcttatgtgtctggtcaggaatagctgtggcagcaattgtttcatttctagttgcatcttttattttaaaacgggataaatcaatgattgatgattctgcttttgagaatgcaaaagtaggtgtagctgcagataaagctgtcagtaaaggacaagtttctgtcagcaataatattactgaccaagtcgatttctctacgattaatcatattatctttgcttgtgatgcaggaatgggttcatcagcaatgggagcctctattttgaggaataaagctaagaaagcaggtttgctacaagatgttactaatgtcgctatagctaacttaaaagcaggttctgacacaattgttgtgacacaagatgaacttgctccacgagctgcgataatggctcctgaagcaatcagatactcagtggctaatttcctcaattcacctcgctatgatgaaattatcagtagtttattgactactgataatgatacaaatcaaacaataattactgacagacctgtcagtaaaaatgagatagacttgaaccaaattgatgaagttgtctttgctcatgatgatttacatattggttcaaatacaatgggcaaagaaacattaaaagcaatattccagatgcatggtgttaaaattcctatttctgatgttgaatttattggtttaggagcatttaatgccaaaaatatcatgattgtttcaacaaaagaatttacgacaagtgtaaaaaacgaagctccaaatgctcaacatctttttgttgagtcattaattactactcctgaatacatcaatatggtgaaacggatgaacaaataaaaatactagctgttaattggcagtctagttatgagtagaattttaaaaaaggaatttttatgtttttaacaagtcgtgagcaaaaattaatccagacatttttgaaacgtggaaagcttacgatagcagaaatgatggaaattacagatacaagtcgcagaacgctttatcgcgatttaaacaacttacaaaagtctttaccagaaaatctcagtttggaaaatactgatgaaggatattttttgaaaggggacatcaatcaacttactcaagcccatgaattaatagactattcaataagtgaacgtttgtatggtgagttgcttttattaattgaaaataaagcatctatcgcttctctaacagattattttggaattagtcaaccgacagtaactagtgatttgaagcaaattgagcaagctctgtttgaaaatgaactagtactaatccgagatcgtggcttaaaacttaaaggggcagaagaaaatattcgtccagtatttgtggcagtgatttataattcagcaagcattcaggaactacttcttaatcaactttctaacaataaaattttaagaataatagatttaaataaatttaagcaagttaatgaggcttttaaacgtatagatttacctgaaaaaatgactgacaaagtcaaagttttaatgcaacttttttgcttagttgttttgctgcgtttggatgaggggtattctgtaggtagtgaacctttgggcagaccaagtaagcaagccttaaactttgtcaataagttactgacagagttatcagtaacaaaatttgttgtttctgaaatcacttatcttgcatcagtttatgatattttatattttggctttggaagagagctgttatttatggaaaaatttgataccgatttttcttataaaattcgccaactcattgataaagtttcaacaattcttgagatagaatttgggaaagatgaccgtttatatggtttactatatgctcatctcaaagaatcagagatgttaccagtcctctttcctaaaaaagaaaatgattttatcaaaaagataaataaagataatcttgaaatttataaaacagtcaaagaatcattaagggaggtctttgataagaatttttcagaaatggaaattgcttttataagtcttcactttgtggcgactcttgaacgcagtgacctagttttacctttaagtgcggcacttgtcagcagtcgtggaagaatttcttgcgaatttatcatgagtaatttaagaaagaattttcccttcttaaaaaagatagaacttattcaaagttcgatccatatcactcaggaaaaatatgacgtcatttttacaacagagaaagagttagattacctctacatcaatccaatgctagatcaaaagaatttggaaaatattcgtcaccagctgaggttgattcaacaaaaatcacgagcacttacctctgattcagaaaaagaaaagaattttttaaatctcaatgacttattttcaataggcaatgaaatattaaaatcttttgaaatcctatctcttgaaaataaggcagaattacatgatactgtaaaacaaattattcagcgagtaaacccagaggatagtggagaactcgttcatttggtggaagaaagatttaaagaaacacatctagcaattccagaaacaaaaattgctctctttcacgcagttcatccatcaatctcaagcccaatttttaaaatctttgacttaagtcagccaattgaaggagtagcaatggatcatcaatctattcaaattggacgagttctattgttattagcccctccagaagttccagagtatgtttcctttttattaggtaaaatctcaagttcaattattgaaaacaagctttatactaggatatacgattccggaaattatgaaattgtaagtgagttactaagagagataattatcgaagctgttaaacattatgatgactaggtttacataagttgtaaacctagtaaaccaagaaaggtagtttttaaatggaaattcaaaaaagtctgattaaaattaatcaaaacttttcaaataaagaagaggccataaaatattgtggaagtttgttggttgatggaggttatgtcaaacctaactatatctcagcaatgattgaacgagatagagaattgtcagtctatatgggaaactttattgcaattcctcatggaactgatgaatcaaaaaaagaagttttaaaaacaggagtagccattgttcaagttcctcgtggtgtaaactttggaacagtagaaaatcctaagatagcaacaatgctatttggaattgcggggattaaagaggagcatcttgagctgattcaaaaaatatcaattttttgtgcggacgttgacaatgttgtaaaacttgctgatgctcagacaatcgaagaaattgcaaaatactttgaaaattaattaaaaaatggcacagcttttagtgccattttttatatttaccagcataatgtaaaagcttacaattgcttatatagagggattttagaggattctatttgaacttttactttctaaataaaggagcagtaagtaagatgaaaaaagcagtacattttggtgcaggaaatattggacgtggtttcataggtgaaattttgagtaaaaatggatttgatattcactttgttgacacaaataagtctataattgacgaacttaataatcgacattcttatgaaattgggattgcaagtagtgaacatgaaaaaatttctgtaaaagctgtctctggtattaacaatagtgagaatcctgaggcagtcattgaagcaattgcaaaagctgatattctaacaacagcgattggtcctaatgtcttgccttatattgctgagcttattgcaaaaggacttcagaaacgtaaggaagaaaaggttcagagcccgttagatattattgcctgtgagaatatgatagggggctctgaatttttggaagaaaaagtgtccgattatctgtcggaatctgataaactttatctttctaaatttattggttttcctaatgctgcagttgaccgtattgttcctgctcaaaaacataaagatgttctctatgttgaggtagaaccttttagtgagtgggtaatagatgcaagtcatttaaaaaataaaggaatcaaacttgaaggagttcattatacaactgacctcgaaccatttattgagcgtaaacttttttctgtaaactcaggacatgctgcagttgcctattctagcgcatataaaggttataaaacaatattagaaggtttacaggatgaagaaattttgaatatcctaaaagcagttcaaaaagaaacacgcgctttacttttatcaaaatgggctcaatattttaagcaagatgagttaattaaatatcatgaactaatcatttctcgcttttctaatccagaaattattgatgaagtgtcacgcgtggcaagaacacctatccggaaattaggatatgatgaacgttttattcgtccaataagagaattaaacgatcgtaagctttcttatcaaaatcatctagatattgttggaaaaatttttgcttaccatgatgaaaatgatgctcaagccattcaactccaagaaaaactaaaaataacagaactcccaatgctcattgaagaagtgactggtataagcaatcaaaagttgattttggaaatcgaaaaggttattaatcactataaaaaataaaatttgggagagatgatgattttttattaatacaatttatgattcaaaatttaaccgctttctattgaaaaaaaagataaaaagtgttattatagaatcatagaaaaagcactggaatgtgcgagctctttcatttttttgaccgactatatttgtattgcataggggttcatgagacattcggtagcgtaatacctcgaacgaaagtaggggaagctgatgcgaagcgagaacacccacctggcgttttagcgggttcaatacacggaagagcatacggcattcaatcagtgtttttttgtatatcaaaaattagacgaagcaataataaatctggagctatgagactgtatatttaaatagagctacgtttgagttttagagttgtttttgcattcatttattaacaatttttgttaatttattcgttggataatttttgtagaataaagatacctcaaatgtgtagaccttacacgaataataaaaggtcagtctaactttgtttgtacctagatatgtacttcaaactatctttcgattttgaaagcccatagtttaacttctatgggttttttgtttgtaaaaggatatgaatctaaaaggagtaaagatttatgctgattagaaattatgaatcaaaagatttagatgaagttattaatctgtttaaaaacactatttttgaagtaaatatttctgattatactttggaacagattaaagcttgggttgacgttgacacaaagttatttgatgataatcttggcaaaacctacgccagagtcatttctaatcatgagcagatagtaggatttggtaacattgatgataaaggatatattgatttattttatgtcagtgcagattatcaaaggcagggagtagggcaaaaacttctaaatgatttagaaaaaagctcgaattatactagttttatggttaattcatctattactgctaagcccttctttgaaaaaatgggctataaagaaacaaaaaagaactgtgtacacttgcgagggcaagattttgttaattttactttaaaaaagttgttgaataaagttgattttatttaacaacttaaaataatgttcaggcactgagacacgtaaaaagctgataggaatattgttattatgacaacgaaaacagttaacaaacatttgtttgtctggttaggaagttttctatttgggggatttggggttgaccgttttatgcgaggacaaattggagtggggatttgtaaattattattcaactgggctacttttggcatttggtcttttgtcgattggattgtagccttggtcaaggcttatagtacttacaacgatactgaagatattacatttattaatggtggatattctagataaaagctcatctatttgagttatttctcaaatttcttttagaagtttataaataaaaaatagaccaattattggcctattttttatttatttttatcaactaaatctaaaaggaattcattgacacttgggtaaatggcttcttcaccaaccatgctaataagtccagttctcttaaatgattcttttaatttaggattcattgaggcgaagacgatttggcgttcttccttatgaaaaatactgtaaatatcaatcaatagttttatagaagtaacgtcaatcatcggtacacctcttagagaaagaataacattagtatttgctggaagttcatcaattgcttgttttaacttgctactatttaaaaagaaaagcgggccagagatataaataactgtccaatcagtaaatacttcatgatgattttgactgattcgatcgggttcaatttgtgaactattaatctcaatttgggaaatttttacgataaagagtaagaaaccaacaatgattcctgctaatattgcagtacttaaatcgaaaataacagtgataatcatcgttacaaaaaattcgatgattccactttttaatttatttttgaataagaaacgaatggcttcccactcgttcattcttacggcggtcatgataagaacaccagcaagggcacttagtggaatatgagtcataaatggtgcaaatagaaacatggagaggagaagaataagggcgtgaataataccagttaagcgagtttgagcacctgcttttatagctacacttgttcgagcaattgcggctgttgctggaattcctccgaaaaagggaatgaaaatatttccgattccttgagcaacgagttcttggttattgtccattgggtgattggttgcacggcctgctgaggcaccacaaaggagactttcggtcattccaagtacggtaatgcttatggctgggataagtagagttttcatgtcttgaagattcaattcagtcaaacgtagatgagcttggggaataagggtggttggaatttttcctactaaaagaatatctagttttagggcaaggactgctaaagttgacagaaggatagccaacaatgaagctgggaattttttaccccatgatttaggatagaaaatcattaataagattgttaaaagtccaataattgttgaaggataatcaatgtgtaagccagagataaatttcattaaatcaaaaaaagaacctgtaaaatgttctattccgaaaaagtttttaatttgtccgctggcaatgatgatggcaataccagaagtaaaacctgttattactggtgagggaataagtgaaattaaatttcctaaacggaaaataccagcgagtaatagaaagattcctgccataaaagtagcaataaatattccattcattccgtatttaccaatgagtgaaattaaaatagccgccattgctcctgttggaccagaaatttgatagaaagctccagaaagtgagctaataattatacctgcaacaatggctgttataagtccggctgcggctgttgtaccacttgatacaccgaaggcaagggctagagggagggcaacggcggctacagtaattcccgccatcaaatcttgtaagaattttcgtcggttgtagtctttgaattctgagttaataatacctaaaaattgtttaatcataataattcctttaattttttatcacaatattctatgataacagagatgagtaatcatatcaaataattatcggaatcgaaatgaaatcaagattaggtaaatttcttgtaattaaaaaaccagaaaataaatttattactaatatctaatgaaaaattgaaggataactgctaaaataatgatagagattttattaggagaggaagataatgataattaaaacaataaatttggaaaactataaagaagttactgaacttattcgtgaatcttttagtcagtcagaacatggttatggtaatgaggctgaacttgttgataaaattcgtaatgaagaaggttatatcaaagatttggaaattgttgcttttgaagatggtaaaatcgttggtcacggtcttttgagtgaggtagagatagtaagtgactcacaaaaattcaaaggtttggtcttagctccccttgatgttttaactacttaccaaggtaaaggaattggggcagcagtattattggaacttgaaaaaagagcaaaaattttggcttatccgtttattagtattttaggacatgaaacttattatcctaagtttggttatgtaccagcaagtcaatatcaaatcaaagcaccctttgaagtccctgatgagaactttatgattaaagaattaactgacggtggcttagaaggaaaatcaggagtaattcactactcagaagcctttaactaagtaacaattttgtttaaaactctttgttagtaactctatatttaagacttaaataataaaaattcttgcattttggtctataaatcggtataataagctagtaagttggcccggtagctcagttggcttgaagcactgcttcaaggttgcggatagaaaaattgcgaagcaatttatcattactaccacagaattttagaattctagaagtggtcacaaaatattcaactttttataagttggcccggtagctcagttggtagagcagtagactcttaatctatgggtccagggttcgagcccctgccgagccataaatagtaaaagcactctaaatttttaaaagtttagagtgctttttttactgacagaaatctgtcagtaaagtaaatagtctgaaaatagtgtataatattgtcaaaagatttctgtcagtagaacaggatgtaagtagaggatgttttatggatttattaaaaaaatttaaccctaatttagataaaattgaaatttcattgattcgtcagtttgaccaacaggtttcatctattcctgatattattaagttgactttgggagaacctgatttttatacgcctgagcatgttaaacaagcagggattgcggcgattgaaaataatcaaagtcattatactggaatggctggtttactagaactacgtcaggcagctagtgaatttatgaataaaaaatatggtttatcttatgcagcagaagatgaaattttagttactgttggagtaacggaagccatttctagtgttttgttgtcaattttagttgctggtgatgaagttttgattcccgcgcctgcatatcctggttatgagccattaattacgcttgctggcggttctttggttgaaattgatacaagagctaatgattttgttcttacgcctgagatgcttgaacaagcgattgtcgagcgtgagggaaaagttaaggccgttattttgaattatccagcaaatcctacaggggtaacttataatcgggggcaaattaaggctttagctgaagttttgaaaaagcatgaagtatttgtgattgctgatgaagtttattctgaactaaattatactgaccaaccgcatgtgtcaattgctgaatatgcacctgagcaaacaatcgtacttaatggtttatcaaaatcgcatgcgatgactggttggcggattggattaatctttgcagcgcttgaattagtggcacagattattaagactcaccaatatttggtgacttcagcttcaactcagtcacagtttgcagcaattgaagctttgaaaaatggtgctgatgatgctcttccgatgaaaaaagaatatcttaaacgtcgtgattatattattgaaaagatgtcagcccttggttttaaaattattgaaccagatggagctttctacatttttgcaaaaattccagttgatttagaacaagattcattcaaatttgctgtggattttgcaaaagaaaatgcagttgccattattcctggtatcgcttttggtcagtacggtgaaggatttgtccgcttatcttatgcggcttcaatggatatgattgagcaagcaatggcaagattgacggattatgtgactaaaaaacgtggctgaggaatcggtcagtaaaattaaaaatcattgataacagttagaagagttgtcagtgatttttttgatataatgaaataaaatatcgaaaggagaaaatcatgcgtgatgccgaaactcaaggtctagtgctttacagtcgtaattacaaagaaaaagataaattggtcaagatttttacagagtcttttggtaaacggatgttttttgtcaaaaattttggaaaatccccttatgctagttccttacaagcttttactgatggaaaattgacggcaacgattaatgacgggggattttcttttatcgaggatgtcagtgaagtggtcgtttataaaaatattagttcagatattttcatcaatgctcatgcttcttatatcataagtttagctgatgcggccatttctgataatcaatacgacccagggctttatggatttctaaagcgaagtttagagcttttagatcaaggatttgatatggaagtcgtgactaacatttttgaattacaagttcttcatcgttttgggatttctttgaacttctcagaatgtgcattttgtcataaaaacgttggcccctttgatttttcttataaatttagtggctgcctttgtccccaacattttgatgaagatttacgacgaagtcatcttgacccaaatgtgatttatttggtcaatctttttcaagaaatatctttagatgaactcaaaaaaatctcgataaaagcagatatgaaactaaaaattcgtcaatttattgatgggctttatgatgaatatgtcggaattcatctcaaatccaaaaaattcttggacggaatgtctggttgggcagatattatgaaataaatctgtggataagtcgctagaagttctgtcagtaaatttatccacagtggaaaacttaaaattactgacagaaacctctaaatatttctgtcagtaaaaaatgaggataatttatggactcaaaatcatggggaagagtttttcgtgaaattcgcgaaatgaaaaatttgtcattagccaaagttgcaggagattatgagaattcaccaaattttattacttcaaagcaacaagtttcacgttttgaacttggtgaatctgatatcacacttacaaaaatttactgacagattttccgttagtaaatttatccatagaaaaaatcactgacaaatctgtcagtgatttttaattttattaaacgtgaattggtaagccatcagccaattcagctgtatccataatcgcttcaccaagtgttgggtgaggttggatagtcaatgaaatgtctttagaagtcaatccattttcaatcgctagtgacaaaccagaaatcaagtcagatgcaccagggccaacgatttgagcaccgattaaggccccttctttagtttcagtaatcaaacgtaagaaaccagtggtatcattcattgaaatggcacggccatttgcagcaaatgggaacttagaaattttaacatctttacggtctttaactgattcaggcgtttctccaactgttgccaattcagttgttgtataagctacagcaggcaaagcaacgtgtaagtccacgtcgtcctcagctccagcaatcgcagcagcagcaactttagcttggaaagaagctttgtgagcgagcattggaccaggaaccacatcaccgattgcataaatgtgaggaacattagttgcataagaatcgtcaacttcaatcaaaccacggtcagtcaatttaacatcagtgttgttcaagccgattaaatcagtatttggacgacgtccaacagaaacgagtaagtaatcaccagtcactgtttgttcttttccatcaacttcaaaagttaatgttacatctttgtcagtttgagtagctgatttagccattgctgaagtaaaaatttcagaaccagcagatttaacgcgattagcaatgatatcagacatttctttatcaaaaccttttaaaatgtggtccaaaccttcaacaattgtaatcttagaaccgagcatacggtaagctccaccaagctcagaaccaataactcctcccccaacaataatcaaatgtttaggaacttctggaagtgacaaagcaccagtagagtcaataatgcgaccaccaaatgggaaagaaggaatttcgataggacgtgaaccagttgagataatcacatcattaaattgcaaaagttggaacccatcttcttgttcaacatttattgtattgttatcaataaattctgcagttccttgaatcacgtcaactttgtgttttttaagtagcattttaacgccacctgtcaactggttgacaactttatcttgtttccatttttgggcagattcccagtttaatttaacatttccgacagaaagaccaaaaggattttctcctttttcttcctccaaagattcttggtaatgatgaccaatattaatcaatgcttttgatgggatacaaccaatatttaaacaaaccccaccaacattatctttttcaataattgtaacttttttaccaagttcagccgcacggatggctgcaacataaccaccagggcctgaaccaataacaaccaaatcaacttctgttgcttgtgcaccaacaaccataatatatcctctttcttgtaaacattagtgtcaacttgaatttacaatactgtaaactagttttttaaatctatgacagaaagaaacgaaaacaatatttttccgttcctttactaataagacaattagcgagtatcccctaggggactcgcctgtaataaatagatgctttagcaccatttattacagcctattagatttccataagcatgaactcagggtcagccaatagagatttcaagtagttaagtgatgtttgacccaacatcccatcaatcaaacggtggtcataagtcatagacaatttcatgttttgtcccacaacgatttcgccttcaccattaacaattggttctttaacgattgaacccagtcctaaaattacgacatcagaaccattaatgattggtgtaaaccaagaaccacgagcagatccaatatttgaaattgtaattgttgaaccttgcatttgttgaggtttaagtgttccttctcgtgtagcagtagctaattcagcgatttctttagcaatctcaagaattgatttagtttcagcttcatgaatcactggaacgtacaaaccagttggagcatttacagcgattccaaggttgacatgttcatgataaacaatttcttgtttttcatagtcaacagaagcattgatatctgggaatttatgagcagtagtagccaaagctttagcaacataagcaagataagttaatttaatatcttgttttgcagcaatttctttaaagacagcacgatgtttcacgagtttagaaacttcaacttggtcaaagtttgttactggtggaatgtgtgtatgttgagcagtcatgactttagaaacaactttacgagttggattcattgcttcacgtcgatcaccagcccctgctttaacgcttggcgctttttcagcaacaggagcagctggtttatcagccttaggtgctggagcagcttctggtgctgtttgagcgataggagcggcactgccagattcaaaagctttaacatcggccaacgttgtgtgaccgtgacgaccagttgcaggaacttgacttaaatcaataccagccttgcgtgcataatgacgaacagaaggcatcgcaagaatgtgaccagtagaagttgttttagtcaatggagcatttgcaggagtagctgctttaggtgctttaggtgcttctgcgactggagcaggactagcagctgctggagcagccccatttccattgtactcaatcaaaggagccccaacttctacagttgttccagcttcaacgaaaagtttagtgacttttccagaatatggagaaagaatttcttgcatgagtttatcattttgaacctctgcaacaggatcatcttctttaatttcgtctccaactttaactaaccagttggcgatatctccttcatgcattccttcaccaatatcaggcatcgtgaagatttgagcttcttcagaaggtgaatcagttgtagcagtatcagaaccagctgtttcttgagcagcaggagcagctgcagaagagcctgaaccgtcaccatcaaactcaaccaaaggagaatcaacttctacggttgttccagcttcaacgaaaagttttgttacggtaccagaataaggagagagaatttcttgcataagtttatcattttgtacttcagcaattgggtcatcttctttaacaacatctccaactttaactaaccagttggcaatgtctccttcgtgcattccttcgccaatatcaggcattttaaaaatctcagtcatagtcaaccacctctttaactttattcacaatatcttcagctttaactgcccagtcattttctgcttgtgcaaatgggaaaattgagtcaggaccactaacacgtccaattggcgctttaaggttcaaaacaaaacgttctgaaatttcggccatgacattcgctgcgataccggctgtacgttgagcttcttgaacaacgaccacacgtccagttttttcaactgttttaccaattgacgcaatatcaagaggagcaactgttctgaggtcaaggacttcagctttaattccatctttttcgagttgttcagcagctttaagagcaagtggaactgttccaccataagcaatgattgaaacatcagatccttctttagcgactgcagcagtatcaagtggtgtagtatagtaaccttcaggaacttcacctttaagcgagcgataaaggtgaaggttttcaaggaaaataacagggtcgttattttcaattgaagccagcaataatcctttagcatcagctggatttgaaggcattacaacacgaattccggggatttgtgaaaatagcccttcaattgaatccgcgtgcatttcaggcgttttagttccgattccataaggtgtacgcacgacaatattatttgaacgtgtgttattaaaacgataacgtgtccggctcatttgtccagcaattgagtcgaaaacttcaaagataaaggttccgaattggatttccataatggggtggaaaccttgtgttgcaagaccaattgccattccaccaattcctgattcagcaagtggcgtattgaaaacacgatcttctccatattttgcttgcagaccatcagtagcacggaaaaccccaccattttgtccaacgtcttcaccaaaaatgagtgcatctttatctttttcaagcgccaaatcaagcgcttctgtaattgctgcaatataagtttttactgccattcttatttgccctcgctttcaaattttgcaatttgttctgccattgcttggcttggcacttcaagtgtatttttaatgaagctagaaattttttgtttttcaacattgttggctttcttaatgtcggcatcaatacctgcatcaagttcagcaatataagcttcctctttctctgtatcccaaagtcctttttcagtcaggaaattacgcatgcgaacgagaggttcttttttccaccaagcttcaatatcttctttagtacgatagcgaagtgggtcatcaccagctgttgagtgtggttctaaacggtttgtaattgcttcaataacaactggaccatttccagctactgcccaagcacgagcttctttagaagcaagatacatggcaatcgcgtccattccatcaactacgatagaaggagcacctgcggcccaacctttagcagctaaatgaggagcagcactttggagactacgaggcgtcgaaattgcatagccgttattttggataaaggcaacaagtggggctttataagctccagcaaagttaattccttcataagtatcaccttgtgaagaaccaccatcaccagtgtaaacgaaagctacagcatcttttttacgttttttgagtccgagtgcgacaccagcagcttcaacgtattgagcaccaatgataatttgtgggaaccatgagtttacaggtttaccatcatcggtagtgtactcattaccaagttgatgtccacgagaccaaagaagacctttccaaattggccaaccttttgcgtaaatttgtggcaagtcacggtaacctgggaagagccagtcttcgtcagtgaaagcgaatgatgaggccatttgagaagcttcttgaccagcgtgaggtccaaagaatcccatacgtccttgtttagctaatttcattgaacgaatgtcaacttgacgtgcaaaaagcatacttttaaagagttcaacgagtttttcatcagaaagtcctgcacgtttaagaccatcttcgtcaacaatttttccttcttcgttaagaatttgaagcattggaaatgtagtgtcttgcagttctagctgcgctttgaaatctaagatttgttctgaatttgacataatagattccctttctattttatgtgtctataattagaaatttatcattttttggagaaatttcctaaggttatgcttgtgaaataacttaatctgttcggtagtcagctttgaacatttcagaaagttcagtattttgaattgttccaaaatattgtccttctttatttgtttcaaggacttcaagaattgctgaaggttcaaattcaagaccaataaattgctctttgatatctcgccaatctcgaacgcctaagaaatctccttggaaattaatttcagtgattttaccattttcgacattgacttgaatatcaatagctccgccggtaaatttagcgtgattttggaaggagaattttggtgattcgccataattccaatcccaagtcgcaaattgctcatctcgtatttttttgattgagctaagttggtcatcagttaaaactaattcaccatcttttccttcgtctgtgagatagtattttaatgcgtcaataaaactatctaaggttaagtcctcaggggcaaaatctttgatatttcccacacgagcgcgaactgatttagctgctttactgacaaatttttcatcagaaacattgagagaacgaatcattgcttcaacatcagtgtcccaaaggagggttccgtgatgcatcaaataacctccggcatagcgttgggcatttcccgaaatctttttaccctcaacttcaaggtcattgcgtccagtgatttcagctttgattccaacagcatggagtgcttcatacatcggttgaacaaattttttaaagttgacagagccagaattttcgacaggaacaaaaaaggtgaaacagatgtttccttcatcatgataaactgcaccaccgccagatactcgacgaacaacttgaacatcatgactgtcaatgtagtcttgattcacttcagcaaaagtgttttggttgcgccccacaataactgcacgtttattttgccataaagcaaaaacaggctcagttggttttaggtgataaagtagccagctgtccatcgcgatatttgtgtaagcgtcttgacctagatagttaataaattgcatgtttatgcatcccttccaaatccttgtgcttattttgtcaaacaagtttgacaaaataacacgcacgatttaattataccctttgtgaaacaaaatgtaaagagaaatgttttacgcttacaattactgtactatgtgattttcacctcaaaatattgtgaaatagatatcatttgtgatagatgaaaaaaagaccagtctattttgactggtcttggatttctcgacgaatttcgagggcacgttccggaaaatcggtgatgattccagctacatgttgttgaaaagcttgtcgtatttctgtttcttgattaactgtccaaagacgaaggggtctttttgaacttttgagaagaagtgggtgcttgaaggcgtaggttcttcggggatgaattcctgaaataaaatctgttgagctgcctttataatgactttttagggtcaaaagattttttgtcagataattaacctcagcctttgaatcaaaagtgtgtattttttttaatgaatcgaaattaaacgaactataaatatagctaaagggccatttagtttctgtcattaagtctgagagttttttttcaattccgggatagtcaaatttatcagttttaatttcgatatttaaataaccagtaaatgataggtctgtaagtaattttaaaacctctgacaaagttggaattttttcgtcagtaaattttggattgaaccaagaaccagcatcaaatttctttaaatctatagcattcatatttttgacaagacctttaccatttgttgtccggtcaattttctcatcgtgaataacaattaattcattatcgagtgataagtggacatcaagctcaattccgtcagcatggacacgaacagcttcatgaaaagcggccaatgtattttctggacagttggatttagaaccacgatgagcaaaaaccaatgttttagaagtgaggcttggcttgaatttcaaattgtttttgattttatttctgtcaagaaaatcatgaagtttaaaaactatttttgtgaagccggacattagtcacttcctttcgatttgggaatgatttttactgacaaggccataaaaaagaagcactgatagggtctgtcagtaaaaattaaagatgagtttccttgtattcttcttcgatttggctgacaaaaaggtgcattattttatcacgcttttcgcctagtctttttccttcggttgtatttaataaatcttttaacaaaaataatttttcataaaaatgattgagtgtggagttatttttttgactatgatagtcttctttagaattgtaatctaaaggtggcagatttgggtcataaaagactcgattttttgcccaaccatattcaagtgtccttacaattccccaagctcccattgcatcaaggcggtcagcatcttgcacaatttgtccattcaaagagagtgtttttctctcgattaaattacttgaaaaactcatgttgtcaataatcataaaaagttcatcaatgagctttttatcaattttaagctcatttaaaaattgcgcaactttagctttttgtttaggaacatcatctgttaatttttcatcataagtatcatgtaaataacaagttgctagaacaagttcttgatttgctgacggctctgtcagtaaaattttttgagcaagagcaacgacccgttcaatatggtcaaagccatgtccatcattatttttatcatgaatttcttgagcaaatcttttaattttctttaaatcaatcaagttaaatctccaaaataaatgacttgagtttacactagtgtcaactaaaagcaaatagtgtaaactggtaaatcctcaagattagtaaggctaaggaagtgaaatttgaaaatgaattatttgaaatagttgattcccattgcagacttgacttcatcgagagtttgactggctacagcttgggccttaagtgagcctgctttaagcatatcgtaaatgtagtccatattttttgcaaactcaatacgacgttcacggattggtgaaagttcgcggtcaagaacatcaagaaggaaacgttttgttttcacatcaccaagaccacccgcttgatattgggctttcatttcagcaatttgctctgcatcttcagctttaccaaaaacgtcaagataatggaaaaccatgtttccttcaattttaccaggatcttcaactttgatatggtcagggtcagtatacattgacatcacttttttcttgagtgtgtccatgtcatcagcaaggaaaattccgtttccaagagatttagacattttggcatttccgtcaagtccaggtaaacgaccagcagcttcattttcagggtaaattccttctggttcaactaaaacatctgtgtgataagcattattaaatgagcgaacaatttctcgtgtttgttcaatcattggtttttgatcatttccgactggaacatgagtggctttaaaagcagtaatatcagcagcttgagaaactggatacactaaaaagccggcagggattgattcaccaaaagctttttgtgcaatctctgtttttacagtaggattgcgttcaaggcgggcaagtgaaactaaattcatataatacattgagagttcagctagttcaggaatttgactttgaatgaaaatggttgatttttcagggtcaagtcctgctgctaagtagtcaagggcaacatcaccgacagattgacgaatgagttcaggttcttttgcatggtcagttaaagcttgttggtcagctaaaaagacaaacatattgtatttatcttcattttgcattttgacacgattttgcaaagagcctacatagtggccgatgtgaagttttcctgttggacggtctccagttaaaatagttggttttgtcattttgttctccttatgtgtgtttggattaggttgattattgaagagtgtaaactggtttacactaaataaaaaataaaaaaagcacccatagaactataaaaagtcctacgggcgctttgagcgcggtgccaccgtaaatttaaaatcaaatgattttcttagaacttgtcaaaaaacaagttgctctgtaacggaagcggccgtgattctttatttttttaaatcaaatttattagttaatcacaagcccattcactttgctgaaaacgttggtttgcacaaccaccaacttcctaaagatttcaaaatcaaagttactttcttgttgttttaaattttacactttttgtaatgaactgtcaaactttaaaaagtagaaaatcaatttgcttgaattcacaattgcaaaaagatatactcaaattacaagagagaattacaaatacaacttaagtattcaattcataaagcaattgcacagttctattaaggaggaaaaaaatgaaaaatatctctacagcatcagcacattgggaggacactttagaaaacggctttggcacaatttctgctgaaagttctcaaatttttacagaaactccctataatttcaaagcacgttcagaaagtcaagctcatattaccacaccagaagaacttttgggagctgctcatgcagcctgttttagtatggcattctcaatggttttaggacaaaaaggcttagtagcaacttctattgacacaacggcagatgttacttttgaagcaacagcagatggtccagcgattacaaaaattaaattgactaatcgttcagtggtaccagaactttctgaagctgattttcaagaaattgccaaagtagtaaaggaaagctgtccagtatctaaggctctgtcaggagttgatattgaacttgaagcgactttaggctagtttattttatagaataaaataaaaactaagttatcaatgaatagcttagttttttgcataaactggtaaaataatgactaaaaataaggcctttctgatataatttaactaacaataaatttaataaagtcctaacttaattaaaataagtgaggtttcaatgaaagaaaataaattattatcaccggcagccatttttctgttgggtgtgaattccattattggttcaggaattttcttactttctggcaaaatttatgaagatgcaggaatttggagtttactggctattttatgtgctggtttatcgatttttgtgattgcttttgcttatgccaacatgagtaaaatttattcaaaaaatggtggagcttttgtttatgctaaagaaacttttgggcgttttccaggctttattgtgggaatggtgacatggttgctaggtacagtgacactagctacagaggtttcggctttactgacagcaatgaaaatgattcttccaaatcttaatagtcggttaattggtatcattattattttagccctaggaatcatctcctattttgggagttcaattattgctggtttagacaatctgacttcttttgtgaaaattgtcttagttcttgtttttatttttacttgtctatggttggtacgtggtcttaatttttcaagtccaaatttactgacagcttcgtcagcaaatttaggtggctttaaaggatttctgtcagcttatggtactgtgttctttttcttcactggcttttcatttctaccggtgaatgctgaaaaaatgaaaaatccagcaaaaaatttaccaaaaatgatgtcccttgtcatgttaacctgtttggctgtttatctgattattcaaaccattaccattggggcattggggccagagctgactaaaacacttgtacctgcggcaacagcttttagtaaaatcgtgggtagcattggaattccgctctttgttgtcggaatatgtttttcaatttttggtgttattgttgcgaccacttttaatacaccaacaattttagccagtttggctcaggctcatgaagatgtgcctatgtttgtttctaaaaataatcgctttggaacccccacttgggcgattattttgacgacagtttgtgggatagctctctttttgagtggaaattatgtttttctgagtggcctgactgtctttatgagttttgttcaatatttatcaactggacttgctaacattaagaaaaaattccttttgattggaattggttcggttctcttttcattggttttactgacaagctttactttatccgtcctaattttaggattaggaatcttgatattacttgttatgatttattttgtcgttaaattagatgatgatgaacgtgaaaaatggctcaaagaacaccaagaaaagtcaaaaggagcagatgtcaatactgttaaacgtttgtaagtaatttttagatattttattttactgaagaaagctgtcagtaaaataaggagaaaaatatgaaaaaaaagaatatgcattttagttgttgagcagtatttttttaataattggtctaattttgcaattcatccccagtcattcaatacaaaatgctagttttactgctttaataattggactagttttagtttttttcattaaggacaaaaatgaatcgagaaaaccattacccgaaaagttttatcagaaaaaagttttttgggcttggatttttattccactctttgtaattttgtttatttattctatttttttgaaaaaagagtctccttataattttagttgttgatatgattatctttaactatttcggtacgaagtataaatggtagataaaaaatactgacagctcaattctgtcagtaaaaaaactcggtttcccgagttttttatttgtccattttttcaaaatgttcgactaatttaccagaaacatctgattccaacattttatgaatttgtttcaaggcagaggcaatcgccaactcacttgaatttccgtgagctttaacaacaggtgctttaagaccaacaaaagcagctccaccagctccatctgtactcatcaaatctttaagtccagacaaaggttttttaattagagccccaccgattttagtggtgacactaccagccatgatggctgattttatttctttcatgagaacagttgctgttccttcaatcgcttttaaaatggcgtttcccgtgaaaccatcggttactacaacatcagccccacctgaaagtaaatcacgagattcaatatttccgatgaagttgatttcagacatagctgacaaaatttcatgcgcttctttgacagttggcgaacctttagattcttcggcaccattagaaatcaaagcaacacgtggtttattgatgccgcgaacattttcagcgtaataagaaccaagaatggcaaaatcaacgagatgatgggcagtattttcagtatttgctcccaaatcaagcatatcaaaaccgcgaccatcagctgtcggtaaggttgacatcaaggctggacgtgacacttgcttaattctcttaaccaaaagtaagccggcggttaaaagtgcaccagttgagccggcagacaagaccgcatcagcctccccttttttcacagcagtcacagctcggacaagtgagctgtctttttttgatttaatggcagcaactggatcatcatgaaaatcaatgatttcagttgtttcaacaatctcaatatttgtttcatcgtctaaaaattgacgaatttttgccccatctccgtagagttggaaggtaacatcagaaagttctttctttgccaagtttacacctttgacaatattttcgggagcaaaatctcctcccattgcatcaattgcaattttcatatttttattttctccaaatcaaataatctctcattaaaattataacaaaaaaagtgaccagatagtcactttttttcacaataggaaatctattgaataaaattattcttcatttaaaatattttcaatctcaaccagtacagcatcttcgtcattagaaagaatgactttatcagctagttcaagaatttcaggtgctgcgttactgacagcaaaagaagaaccagcgtattcaaacatttccaaatcattcatttggtcaccaaaaacagctaaattttcagggagccagttaaaatgtgctaacaaatgtgccaaaccagaagctttagaaataccatttggcacgatgtcaatactagtaaaaccagttgttgttgcccttacgaaagagagtctgtctgtaatccattgttcacagtcacgcacgtggtcttcggggaagttggttgtaaccttgagcaatttgtcatcaatttcatctaagcgatggtaaagttgacagttaggataataaagttttgcatgagcaaggtattctttagaaataccttcaggataataagcacctttaaggccagaaattaaataatcatttttgggactaaacggcatctcttgcaagtcatcaattaattcttgagtttgagcaacagtcaaatcttttgcaaagagaatttctcctttataagcaacaactccaccattctcagcaacaaaagccatttgatctttatattctgaaaaaacttcaatcaaaccaagtaaagaacgtccagaagaagcagcaaaaagaagatttctatcttgaatttttttaattacttcagcgagttttttgtgattatacgaatggtcattgcgcagaaaagttccgtccatatctgtcgcaaaaagttttaaattttgattcatgacttctcccccagtccactgttagcgctaacagtggatgaaaatgaattctgtcagtaaattttactgacagaactgtaaacttggtttacacaacagtgtaaacgaactaaataataataaatttaatcggcccagagtgcttttactttttcttggacttctgcattatctaagaaatcatcataagtttcaccaatacggtcaatgacaccagatttaccaagaacaacaatgtgattggcaatagtattaatgaattcatggtcatgtgaagcaaagaggattgagcctttaaatgatttcaaaccatcattaagtgcagaaatagattccaaatccaagtgattagttgggtcatcaagaacaagcacattagctcgttgaagcatcattttagaaagcatgacacgaactttttctccccctgagaggacattgacagcttttaaagattcttcacctttgaaaagcatacgtccaaggaaaccgcgaagataagtattatcatcttcttcttttgtcaatacaaattgacgcaaccagtcaagaatagaatcacttgtatcaaaatctttggtattatcttttggaagatatgaacgagaagatgtaactccccatttaatatcgccagttacggtccaattatcttccacatcatccattaaagcacgaagtaacgttgtttgttgaatatcgttttgaccaataaatacggtcttatcaccaggatttaagatgaatgaaatattttcgataatcatttctccttcaatcgcaactgaaagattttctacacgaagtaaatcattaccgatttcgcgttcttgttcaaaaccaacaaaaggatatttgcgtgatgaaggaacgaattcttcaacttcaattttatcaagcattttcttacgtgatgttgcttgttttgatttagacgcattagcagagaaacgagcaataaactctttcaactcggcaattttttcttcagctttacggttttggtcaccttgcaagcgaagagcaagttcagaagactctttccagaaatcatagttccctgggtaaagtttgattttaccatagtcaaggtcagccatgtaagtacaaacattgttcaagaagtgacggtcatgggaaacaacgataacggtattttcaaaattaatcaaaaattcttcaagccaagcaatcgcttgaatatcaagtccattggtcggttcgtcaagaagaagcacatcaggtttaccaaaaagtgctttagcaagaaggactttaacgtgttcgccagaagtcaaattggccatcaaatctgtatgttgttcagctttaattccgaggttttgcaaaagacgagcagcgtcagcttcggcttcataaccacccatttcaccaaattctgcctcaagttcggcagctttcatgaagtcatcatctgtcgcatcagggttcatgtaaatggcatttttttcttgattaatggcgaaaagtttttcattccccatcatcacgacatcaagtggtgtttgatcttcgtaatcgtaatgattttgacgaagaacagacatgcgttcgtttggccccattgagatgtgacctgttgttggttgaatttcaccgtccaagattttcaagaaagttgatttaccagcaccattggcaccgattaaaccgtaacagtttcccggtgtaaacttgatgtttacttcgtcaaaaagcttgcggtcagagaattgtaatgaaatatcagatactgtaagcatgtattttccttttttattgatgagaaaaattctcaaatatttttcgataaagtagtttgactacttttgtgctaaaaaataagcattctgcccttattttatcataaatcttggactttataaagcccacttttttataaatcttgacaagattttcattcatgttcttacaaaaagatgaagtttagtttcaatttagcgtaattttagcattacttaagtcaaggtgactataatatacttattccaataaaatttttcataaagtttactcctaaataaaagaatgagcggctggttaccgctcatttttttatttatcgctatttttaatgaataaaataattgaaatagctaaagccacaaaaccaattccattaaattcgataaatgatatgaaaacatttgaagaatatcccaactgattaaagataagcacggcaggaattcctatccccaaataaataatgttaggactaaaaaattaaggctcctataaatagtttttattcatattttatccttctcctaactttctttggcatctacagaaatatttacaacataaataaacagtagaattgaaaatagactacctaatagacttgttaataaatccaaatcctaacgttcgccaaacttccataaatgtttctggggataaggctgttttttatgaaacaccaacaaatattcttcctaaaacaacttctaatttctaaaaaatatttgagtaagtttaaaaaactaaagccaatattgctccaagagtatttaaaattaaatcattgatatcaaaaagtcgattcctactttttgaaattaggacaaaggcaatcctttttgttcgcggattaacctaaagttttttcgtaacctgtatatgacattgtttctccttagataagtaaaatgtgttagtaggattgtacagttttaaatcaatgctagaaaccacaaagataaattttttgtatgtttagcatacaagtataaatcaagtttcattttagcctagttttagtaaaacttaagtcaagttgactataatatacttattccaataaaatttttcataaagtttactcctaaacaaaagaatgagcggctggttaccgctcattttttatattttttctaatgtttgctctaaatcagcaatcaagtcagttacatcttcaataccaaccgataatcgaatggttcctttggaaatccctgcactagcaagttcttcggcattcagctgctggtgagtggtcgaagcaggatgaatggccaatgatttggtatctccaacgttggctagaagtgagaaaatttcaagatgatcaatcaaatcacgcgcttttttctcatctttgtctttgagttcaaaggtaaagatagatccagcatcttttggataatatttctgatagagcgcatgataggaattactttcaagcagaggatggttaacaagttccaccttaggatgattgtctaaaaattctacaatctttttagtattggagatgtgacgttctacccggagtgagagtgtttctagcccctgtaagaaaagccaagaatgaaaaggcgataaagccgcacccgtatcacgtaataaaatagctctaatccgagtcacaaaagcaatttcacccaattcggcaaatttaatcccattgtagctttcatcagcttgtgtaaaatcaggaaatttaccatttgcccaatcaaagtttccgccatcaacgatgactccaccaatagaagtaccgtgaccaccaatgaatttcgttgctgaatgaacaattacattagcaccatgttcaaatggtttaaaggtcacaggggtagtaaacgttgcatcaacaataacgggaattccatgttttttagcaatttgaccaatggcatcataatcaatcacattatttcccggattgcccaaagtttcataataaatagctttggttttttcatcaatcgcctcttcaaaattattcgggtcatctggattgacaaatttagttgtaattccatattttggtaaagtcccagaaaaaaggtggtaggttccaccataaagggtactggcggaaacaatattatcaccgactgtagcgatattcaagatagcataagtaatagctgctgagccagaaccaacaccaagggctgcacttccaccttcaagagctgcgatgcgtgcttcaaaaacatcgttggttggatttcctaaacgtgaataaatagctccaggatcttgtaaagcaaaacgagcttcggcatggtctgaattgttaaaaacgaaagaagttgtttgatagaggggaacggcgcgtgaacctgtgacaggatcagggacttgtcctgtatggacttgcaaagtgtcgaatttataattgtgattagtcatagttttttctcctatttttgaaaattttagttagtataaaaaatagtagttaatcacattcgttgattattcgtcagcaattcttgaaccatagctttctcctttagctataaaacttattataattataagaaattcagaaaattctagcgatatgattttttaatggagctgatagaacttttaaaagtagaaataaaaaaatacaactcaaggttgtatttttattgattgtgcttttcaaagtaacgcattgtaataagaagagctttacgaaagatttttggatgtttacgagcaacatttaccatgaatttatcaccgaaagagtggaggtagcgaaggctcggtttaatctctgtcgcagctttataaaaaacttcagctaaatcagaagctttagcactatttttcataaaacggtcaagtcctgaagcaacagaatttaccaaaggttggtaagcagagtttgaactcatattctttttagaattttctagggcaatatttccccaacttgactgagttccaccgggttgaacacaaactgaacggataccaaattgggcaacttcgaggtccaaaacgtcagaccattgttgaagggcggcttttgtggcatgataataagcaccaagtggcatatagacatctccaccaattgatgaaatattaacaattcgtccataattttgagctctcattgttggtaagacaagttgagttaattcaacggcaccaaagaagttggtttcaaactgattgcgaattttatccattgggatttcttcggctggtccgtattcgccataacctgcattattgatgaggacgtcaatatgacctgcctcatctaaaatttgtttcacaaaggcttggtttgattcagagctagtaacatccagttttagtgctttgatgttgttctcacattgtggaattttttcaacgcggcgtgcaccagcgtaaactttccaaccacgtttggcaaaaagttctgctgcctcaaaccccattccatttgaagcacctgtgattgcaacaattttttgtgtcatctctttagagtcctttcaatttgtctgtatcttgttttcatgattttaaaagtaattataccactttagtaaatcaaagactaaaaaaacttccgcggagtaaacggaagttttaggagtatttatgaaaaaagtttatttaggagtatggaaactattatacgttataatgctgaaatgaaacttaaatgaaaaagaaaatgtttttgtatttttagaatcccttttctataaatcaattctaactataaggacctgatgattgagtgataatgctagtttgaagcattcttagtaagaaattgattttttataaatggtttatagaataaatcgtacagcgtttaattggacttgctatctgaaataacgtaaaattgtagtgaggaggacggttacaatgagtaaaaattataaaaaaatcctagtcgcaattgatggatctgagcaggcagaagaagcgttaaaagaagctattgtccttgctaaaagagacaactcacaattattcgttttacatgcgacggataaaaacagtatttatgcagctggtaacccagttcctgtggttcctgcaccagctattccagtagttccagcagttcccgtacttgaagaaagtgcagataatgaagctaaagaagttttagacaaagctttagcaattatcaataatgaagtgaaatttgaagaaattcgagttgacggttcggccaaaaatgaaattgtcgatttcgctaaagaacatgaaattgatatgattgtgatgggctcttcaggaaaaggcgctcttgaccgaatgttgcttggctctacagcagtttacgtggttaaacatgcaccttgtagtgtaacaatcatcaaataaattagatagatttcaagaatcggcaagcatttgccgatttttttgtattttaaaaataaattccttgacaatgaaattcttttcgtttacaattgtaaacatagaaatgagagagttggattgaacaatgaaagttacttttaaaacccttgatggacgtacaatgactaaagaatttgctagtttagatgaattcgtaacactacaaaatcgtgaaattccggcaattgatgattcagcgaaagttcttgaagttgtaatttctggacaagttgaagaatttagtggaaatgttgctgatttgtatttcaaacttagtaaataagaatctgaaatcatgaatggatgaggaaagatgacagattatgtttttaaggcaggtcgtaaagatttggcacctcttttgttattacatagcacgggtggagatgagcatcaattagtagaaattgctgaaatgattgccccttcacatcctattttgtcaattcgtggacgtattaatgagcaaggagtcaatcgttattttaaactccgaggcttaggtggttttactaaagaaaattttgatcttgaatctttagatgaagaaacagactggttgacggatgaggtcagtttgttggctgaaaaacatgaccttgacgtccataaaatgatagctatcggttattcaaatggtgcaaatgtagctttgaatatgtttcttagaggaaaaataaattttgataaaattattgcctttcatgggatgcaattggaagactttgaacagaccgttcaacttgatgataagcatgtctttctaagctatgcaccaaatgatatgattgttcctcagaaaaactttggtgatttaaaaggtgatttggaagattcaggctgtcagcttgaaatatatgaaagttcacttggtcatcaattgacgcaagaggaagttttagccgctaaaaaatggcttacagaaacaaaataattttgtattgaaaaagtttcagtgcaaagtaactaaataggagaaaacaaatggctgaattaacaaaaattgaaacaaaaatacctgaaaatcttactcttggtggtgttcaccacgtaacagcaatcacctcaagtgctcaaaaaatctatgattttttcacaaatatcttgggtctgcgtttagcaaaattaacagtcaatcaagatgactatgaaacttatcacctctttttcacagaagaagatgggcatggagctgatatgactttctttgatttcaaagatattcctaaaggaaatcatggagttaataatattgaacgtgcttcatttcgtgtaccgacagatgcgtccttagattattggactcgtcgttttgacaatgcccatgttaaacatggcgaaatttctagtaaatttggtcaaaaagccttagagtttgaagattttgatggtcaattgtatcaattgatttctgaccaaaataatagtggggatgattcaaaaggacgttcttggcaactttccaatgttccgcaagaacatggaattactggacttggccctgtttttgtaaaagttgaaaatgccgaaaatcttcggaccattttggaaacagtttttggcttccgttacgctgggcaagaagctgatttacatctttttgaagtggcgaatggtggaaatggagcagctttgattcttcaagaagctggtgaaaaagaagcttacgcttatcaaggttatggtacgattcatcatttagctctgggaacaacaaatcctgaaactttaaactattggattgaacgcattaaggctttccgtttgccacattctggtttggttgaccgtttctatttctcaagtgaatatgtcagagtagcaccaggagttctctttgaaattgcgacttacacaccagggattggggcattggacatggcaaaatcaggtctaggagctgttgattcttatgaagaagctttaattacttctggtttctggattgaccaaactaaggaagaatcaggtttatctttgagcttacctcctcatttattccccggagatgaagctactaaagcgagaacagccgcaagtttacgtccattggacacttcagatgctcatcgtgaccgcacaaaagatgaactatggactgttgaaaaagtattggaacacaaagctggaactccggctgaaacagtgcaataaaggagaactgatgaaatcatatcaagcaaatgagctcgacgaaaaaacagtctataaacttctgtcaggcagtattgttccacgcccaattgcttgggtgaccagtcaaaatctcgaaggtctagttaatgtggcaccctttagttttttcaatgttgcttcgtcaaatccaccacttttatccatttcgtttacgggaaataaagatagtttgaataatttattgacgacgaaagaagcagtggttcaccttgtgaatgaggataatgtggagctaatgaatcaaacggcagcaccattagcggagcatattagtgaagcggaagaattttcacttgaacttgtcccttctcagaaagttcaggttccaagtttaaaggagtcaaatgttcgtttagaaactaaattgtatcatcatttacctttaggagagagtgggcatttagttcttcttgaagttgtcaatttctcttttgcagaggaactattggatgaggaaaactttcatgtcaatctaaataaactcaaaccagttgggcgtttagcgggtgatgattacagtaccttaggaaatcgattcagccttttacgacctagataaataaaaaaacttactgatgattggtcagtaagtttttgtttgctttaaaaataaaaaaataacccgaaggtcatttttattatttaacttctttaaagattacgtgtttacgcaattttttagagtattttttaagttccaatttgtctggggtgttgcgtttgttcttttgagtaaggtacagacgttcaccagattctttgtgttcaagtgtaatatttacgcgcatgatagtccctttctataacttttgtcgaattatttagtgtcgcgaactttgcggcctttgtagtagcctttaagtgaaacgcgatgtgagtgacggtagtcaccagtagtttcgtcaaaagtaacagttggagctgtcaatttgtaatgtgtacgacgacggtttttctttgctgatgaagtgtgacgtgcaggtactgccattgtttttttcctccgtagaattttatctcgttcttgcagagtgcaaaaacgtactttattagtatagcataaattttcagaaatgcaagttttgtaaagtaaaattacttgacaattttttgcaaacctttctgtcagtaaaatttgagtaagcaaaagtactgacaaatatctttgacaactaaaatgatagggcctttagcgcaaatttgataaaatagaagtaacttaacggataacttaaaaatttaagctcagcttcgaaagaatcaaagcggcgtaaggagaagacaatcaggtcgtaaaaactcctcacaaagcagggcaatgttctaggacaattaaatttttaaggagaaatgaatgaagaactggaaaaaactgattcttgtttttgtcattgcaggcgtggcattaattgcttactttggctttaatcagccttttttggcacgcttaattgttacaattgctgggggagtcttggctttctcaatgctgattgaaatgattaaaactttacggtctggctcttatggtgttgacttattggccatcacggccattattgctactttactagtgggcgaatattgggcctctttgattattattctcatgcttgttggaggtgagagtttagaagactatgcaaatggtcgagctcaccgagctttagctgctttattagataagtcgcctgatattgctcatgtgcaaaaaggagataaggtggtcgatttgccgatagaccatgtggaagtcgggagtcatttattgattagaccgatggaaattattccaattgacgggaaacttatttctgaggcagtggtacttgatacagcgtcattgacgggtgaaaccaagccgaatgaattagtaaaaggtgatcctgttctttcgggagctatcaatgggaattctagtatccagattgaaactacggtgatagcggcagaatcacagtttcaaaaaattgtagaactggttaaagaaacggagaaaactccagctcaatttgtacgtctggctgatcgttatgctgttccttttacaattattgcctatcttattgcagcagttgcttactttatttctggtgacccagtgcggattgcggaagtcctagtggttgcaagcccttgtccattgattttggcagcccctatcgcgtttgtttcgggaatgagtcgctctagtcaaaatggagcattaatcaaaaatggaacagtcatcgaaaaattagcaaaagctcgggaaatatttttagataaaacaggtacaattactgaggggacaattaaggttgacagtctaaaaccaatagaaacggtagatgaagtagaacttttacagttggtttacacggttgaaaaatcaagtggtcatattttggcaaaagctgttgttgaatatgctgaaaataaaaaggttcaaccattaaaattgacctctttaactgaggttgctggacttggtgtgattggagaaatcaaaggtcaagaaattaaaattggccgaagttcttttgcttatgcacctgaaaatcttaactatgaaacagcattttatgtgagtaaagctggtaaatatattggggcggtcactttttctgatactttaagaccagaaactaaagaaacaattgctcagatgagaaaaattggtcttgaaaagattacaatgttgacgggtgacaatcaacttgttgctgataaaattgcgagcactgttggaattgacaatgtttatgcaggtttgatgccagatgaaaaattaaaatttattaaaaatgcgacgaatagaccagtaattatggttggcgatggagttaatgacgctccagctctagccacagcagatgttggaatttcgattggtgtgggctcaggtacagttgcaagtgaagcggctgacattgttctattgcaaaatgaccttaggaaagtgacgacatctattgaaatcagtcgtgatacgttaaaaattgctaaacaagcggtcatgattgggattatcatttgtattattttgatgtttattgcagctctgggagtgattccagctgtgattggagctttgttccaagagatcattgatgttgtttcaattctctatgcgcttcgggctttaagaggataaagaaaaaatttactgacggaatgcttaaaagtcctctgtcagtaaattttttttatttttttagtaattttattagatgttccagttcatcaagattatcaaaatgaatggataaattcccttgatattttttatttgcttgaatcttaaccctatttcccaattttttcatcagttctttttcagtttcgtcagtaaaaagattgatatttaatttactgacagatttgtcagtaactttttcttcaccataaataatagcttcaagtgctctgacattgagctgctctttaattattttatcaacgagctctaattgctttttaggatttttttcagctaaaagtgttctagcgtgagcaggtgaaatatctcgattttcaacatgcttcaaaattgtgtcaggcaaaccaagtaaacgaataagattagagacataagaccttgattttccaagggccttagcgatttgatcgtgggtcattcccaatttgtcagccagttgtgccaagcttttggactcttctagtggattgagattttctctctgcaaattttctaaaattgagagagtcatcatttcttcatcagaatagcttctaataattgctggtatagtttctaaaccagctaattttgaagcttgaaaccgacgttcacctgctaaaagctcatagccaacaagttttgatttacgaacgattatgggttgtaaaacgccattttcttggatagaattagccaattcttttaatttatcctcatcaaaaacaagacgaggctggtaagggttttttacaattgttgacaacttaagttgagtgatttgttctaccatatttttcactttctgtcagtaaattttattgtgctctattttactgacagatttgtcagttcctctttttttgttcatcaatccattctttacgactgtgaagtgctttttcatatcttcccatatcatcaggacggaaataatcagcatttttaattttatcaggtaagtactgttggtttacccagtgattaggaaaattatgagcatattggtattctacagaccttcctaaatcttttgccccagcgtaatggccatcctgtaagtgtggtggtacagcaagatttccatattttcctaaatcagcaatggcttcatccatcgctaaataagccgcgtttgatttaggggataaagccaagtcaataatgatattggcaaggggaatccgtgcctcaggaaaaccgagtttttcggctgctgataatgctgtaaccgtatgaagtgcggcatcaggatttgctaaaccaatatcttcataagccataacggttaagcgccgggctagactctgcaaatctccgccctcaattaaacgagccgcatagtgtaaacttgcgttgacatcagaaccacgaattgacttttgtaaagcagaaagcaagtcataatgagcatcgccctctttatcaaaagttgcagcttttctttgtaaagaattttccatatcatctaaagtgacatggtgttcttctgaggaaagaacggctaattctaaggcattaaaagtagaacgtaaatccccattagttgaatgaattaaaaagtaaagtgcatcatcgtcaatggtcacatcaaaatcaaatccacgttctttatcttgtaaacttaggtttacagcaaattctaaatcttctggttctaaaggttttaattcaaaaatctgtacgcgagaacgaatcgctggaacaactgaaaaataagggttttcggttgttgctccaattaaaataatttgtccgttttctaaaagtggtaaaagaaaatcttgtttaggtttgtctaggcgatgaatttcatcaagtaataaaacaagctgaccagaaaattcggcttctgaggctatttcttgaagtctttttttagtgtctgtcgttgcattaaatgtccgaaatgcgacattcattgttccagcaattgctgaagcaattgaagttttaccaatgccaggaggtccgtagagaatcatacttgaaagaagttgagtttcgaccattcggcgaatgatttttcctttaccaactaaatgtttttgtccaacaatttcatcaatatttcgtggtctcattcgtcttgcaagattttgtgccatattattctccaatccataggtttacaacaaatgtaaatctggtttacataaggcttttgtctagatagaaagtgagaatgtaatcatcaatatattcaccatcaatgaaaaattcttttttcaaacgtccttcttcaacaaagcctaatttattataaagtttcaaggctgctggatttgaacccatcacttgaattgtaatttttttgaatccttctttttttgcaaaatcaataaagaagtttattagtgtagtagccacgcccttacctctggcttcttgtgctgtcataatgccaaaggtgacagtatgtcttccaaattcagatttgtggcgggggccgtaatcaagtattccaagaatttcatcattttctactgccagaaaataagtggttccagtcataattttaccgataattttttctgctgaggaatccatgacatgtggagttgaagctaaggtccaattttcattttccaattgagcaactttgacaaagtcacgtggttctatttttctaatttccattaaatctttctccaaattctaaaaaaatatctatttacacattctaaacgtaaaaaagctattaaatgaactgatttattaagtcttgcgacttttctagagcaaatttttgttataattattttaacataatataaagagggtgtgaacaatggctaaatttgggtttttagatgttttggaagaagttttagaaaaaggatttacttatgattttgaaatgaattgggataagcgtaattttgcggtagaagtcagctttttactagaggcagaaaatagttctggagcgcttttgactgatgcagaaggagtagaatcagcagaaaatatcgtctatgaggatgcagttttattttataatcccgctaaatcacgttttgatgaaaatgattatttggcaacaattccttatggtgaaaaaggcttatctcgtgaatttttggcttattttgctcaatttttacaagaaagtgccgatcaaggcttggatgatttaatggactttctagctgatgaagctgccgaagaattttcagtcaattgggataaagaagcttttgaaaatggcattgctgatttatctgaaacagacttttataagtatccaagatattaagaaatttagaaagatttaagaaataaaaaatgagtattttaaatgtaaaaaatctatcccacggttttggtgaccgcgcaatttttgaagatgtaagtttccgtttgctaaaaggtgagcacatcggctttgttggggcaaatggtgagggtaaatcaactttcatgaatattatcacaggaactctggttcctgatgagggaaaagtaatctggtctaaaaaacaccgggttggctatatggatcaacacgctgcgcttggaaaaggtaaaacgacgcgtgaagcattggctgaggcttttcaatatctttttgatatagaagcgcaaatcaatgatacttacatgaaaatggcagaaatgtcagaagatgagatgaatgctgcgcttgagaatgtaggagaacttcaagaagaattggataatagtgacttttatctcattgatgccaaagttgaagaaacagcacgaggacttggtttaactcctcttttggataaagatgtagccgagctttctggagggcaaagaacaaaaattttacttggtaaacttttgcttgaaaaaccagatatcttgcttttggatgaaccaacaaactatttggatgaagaacatattttatggttgaaaaattaccttaaaaactatgaaaatgcctttattttgatttcgcatgatgtgccatttatggatgaagtggtcaatatcatttatcatgtgcatggtctagggattacccgctattcaatggggtatgcggaatttgaacgtgtctttgaagagaaaaaggcacagcttgaatctttgcataatgcgcaggtcgctgaacaagctaaacttaaagatttcattgcccgtaaaaaagcgaatgtggcaacgtctggccaagcaaaagcgcgtgagaaaaaattggcgaaaatggaaattgttgagactatttctgaaaagccaaaacctcattttgattttaaatttagtagaaaaccaagtcgtctcgtttttgaggcaaaagatttagttattggttacaatgaacctttgtcgtcagaaattaatttaaaagtagaatctggacaaaaaattgcctttattggttccaacgggattgggaaatcgactttgctcaagagtttaatgggcttgattccgagtcttgatggggaagttgaaaaaggaaatttccaagatattgcttactatgagcaagaaatcaaaaatccttcgcaaaaaacggtacttgatgatttatgggatgagtatccaagttggaatcaagcagaactccgcggggcacttgctcgagtgggcttgacggccaaacaaattgaatcacgtgtttatgttctttcaggtggagaacaagcaaaattacgttttgctaaattaatgaataccgaatctaacattctcatcttggatgaaccaaccaatcatttggacgtggacgctaaagaagaactcaaacgtgcattgattgaatatccgggaactgttttaatggtttcacatgaaccagaattttatgaaggtctagtttctgatgtcattaactgtgaagaatggacaactcgtattttgtaattactgattaattcttatgctagttcatctctaatttttcttaaaaattggtagttgaactgcagttatactagcttgcacaaacacaagaaatggtttgcatgaaaaattaaacagtattaggagaaaaatgactcagaaacttcatccttgggaaaatcccgaacaagattatgcacgaactttggcaaaacgccgctcagagcggcgttatcggagcttacagttagtaaagacgcttaaaattttactgacagaatttaaaaagtacgatgtgaacaattttaactcagagatattgagttggattgatttgcttgaagatgctgttgaatatgttgatgatgaagattttaagtcagcaaaaaaatttgtttcgcgaatgcaaagagaactaaaaaaacttgaaaagtaaattttttactgacagaaaagaggactttaagggcactatgaaaagttatagttttcaagctgaactggaaattatcggtatcaatccctttgtggctgtaccgccagatattttgcagaaaatatttcaggattcaggacgagaaaaatcgcccattcctatttgtggtcagattaatgaaaaaacttatcagcaaaatctaatgtttttcaaaggggattggcgcttatatgtcaatacgacgatgctgaaaaattcgcctaaaagaatcggggaaatctttgattttacaatttcctatgattcagagccacgaattgtcaaacaaccacaagttttaagtgaagcattagccaaaaatccggaagcaaaaaaagtatttgaccaattaattccctctaaacaagttgaaattaatcgttatattgcaaggttgaaaacagaagaagctatcgagcgaaatgttaggcgagcgattggtttcttactgggaaagaactcttttgtaggccgagataaaccatagaaagaaagatgaaataaatgaataattggaattcaatcacaataaaaatcagtcgggaagccgaagaggccatttcagctttgctgatagaggcgggttcagccggcgttgaaattaatgacagtgctgattatcttaatcacgaagaccaatttggcgaagttcttcctgaaattgaacaatctgattttgttgaaattactgcttattatccagaaaatatgccaattgtggaactcaaagccgaaattgaacataaaatcgcaaatttgagtgattatttttcactgacaggtctgtcagtaacaacgaataacctgtcagaaacaaattgggcagaagcttggaaaaagtattttgaaccagcacgaattacgcatgatttaaccattgtgccgagttggacagaggattacgtggcgacaggctctgaaaaattgattcgacttgaccctggtatggcttttgggactggaacacatccaacgaccaaaatgtcactttatgccttagaacaagttcttcgtggtggagaaacgttacttgacgttggaacaggttcgggcgtgctgtcagttgcagcttcatatcttggggcagcagaaatatttgcttatgatattgatgaagtggctgtgcgtgtggctttagaaaatattgaactcaatcctggtcatgaaaaaattcacgtttcagcaaacaatctgcttgaaggaattgacaaaaaagcggatgtcattgtggctaatattttggctgatattcttgttttaatgacggaagacgcattccgcttggtcaaagaagaaggctatctcattatgtcaggaattattgctgacaaagcggacatggtcattgcatcagcagaaaaagctggatttttccttgaaacacgaatgattcaaggcgaatggaactgcctgattttcaagaaaacagaaaatcgtgaaggcgtcattggtggataaaaggcttaaataaagtcgtttatctttcagtcaatggagaagcataataaagaaaagattagattcaaaactttattctaagaaatgattggaaaaaaatatggccaaccaatattttgtatttaaaaaatcaccagaactgggcgaagaatttatcattgaaaatcaagcagcagctcatcatattttcactgtgatgcgggctaaaagtggtgaccaaatccgtcttgtttttactgatggtgaaattgggctgtcagaagtcatctcgccaagtgaccaatcagtgaagctgataaaattactgacagagtcctcagaattgcctgttcaaattacagtagctgtaggatttcctaaaggggataagctcgattttattgttgaaaaatcaacagaattaggagctacagccatttggtcagcaccttttaaagcttctgtcagtaaatgggacaagaaaaaactgacaaaaaaacaagaaaaattggaaaaagttgctctaggagcagccgaacaatcacgcagacaaatgattccagaacttcaactttttgagcaatttactgatttacttgataaattttctgattttgaccaagttcttatcgcttatgaagaatcagcaaaaatgggtgagaaaacaatgttcaaacaagcactgacagaaatgtcacccaaccaaaaagtgcttatcatttttggaccagaaggcggaattagtccagacgaaatcacaaaattttccgatttaggtgcaaaaatgattggcttagggccgcgaattttaagagcagaaacggctccattatatgccctctcaagtatttcagcttattttgaattattataaataaagaaaaatttttaggaaatcgattatgaaaaaacgtgcacaacgtaacaaaaaacgaattcgctgggcttcagttctcacagttttcgttcttttaattggaataattgcaattgcttttgctggggttcatttgttaagtcctaaaacaaatacaagcccaaaaatcagtcaaacttcaagtcaagaaaaagcaaaaagcactgcctcatctagtgcttctcaaccaaaagaaacaaaatggctggctggatcaaatgaaaatcaactgcccattttgatgtttcattatgtcacttcaagggctgatcagctcccacaagatagtaataacatcaatattgtaacctttgaaaatgaattaaaagcgctgaaagaaaaaggctacacaacggttagtggctcagatgccgaaaaaattctaacgaccaaagaaaaaccaagtgataaaatggtttggcttacttttgatgatggttcagtcacaatgtatactgaaattttccctttattgaaaaaatacaatatgcacgccacgaattttattattacaggttatgtgaataaaggccaaggcggaattttgacctgggaacaaatcaaggaaatgaaagcaagtggacttgttgattttggcagtcatacggtcagccatcctgatttaggaaagctcactttggaagctcaacgaacagaacttgaacaatcaaaagcagatttagataaaaacctcgagcaaaaaacagatatcatctgttatccagcagggggttataaccagaataccttgaatttagctaacgagttaggttataagtttggtttgcttgacccgggccgtaacggtgctgtcgcaatagcagccaaagaaagtgatggtctattaacgctaccacgctttagaatgatgagttctaccacaactgagcaaatgctacaaatgattcaaccctcaaccgattataatgaaaaaaataaataaactccgaataatcggagttttatctttagttttgcaatagtcatccttttgcttaacctacaaatgtgatagaatagattaaattaagtgaaataaaccttaacttacaaaatttgatgagatgatatattaatctaaataaggaggaaaactggtcaccattttagagtcatttttaaaatggtctagtatctaaagttatgcctaaagaaccagacttaaccggagcagaagttgtcaatatctgttctgactacatgaatgaaacagaccttttactcgtagaaaaagcacttgcttgtgcttcacttgcccatgcagaccaatatcgtgcatcaggagaagcttactttgtccaccctacccaagttgcaggaattttagccaaattaaaactggatgctgttaccgtttcctgtggttttttgcatgatgttgttgaagataccaattttacccaaggtgatttgcaagaattatttggcgacgaaattgctgaaattgttgatggagttactaagttaggtaaagttgagtataagtcacacgaagaacaattggctgaaaatcaccgtaagatgcttatggctatgtccaaagacattcgtgttattttggtcaaattggctgaccgtttgcacaatatgcgcacgcttaaacatctcagaccagataaacaaaagcggatttcacgtgaaaccatggaaatttatgcccctcttgctcatcgcttggggattgccagtatcaagtgggaattagaagatttatcattccgttatcttgaagaagcagaattttatcgcattcgtggtctcatgaatgaaaaaagaacggctcgtgaagcgcttgttgctgaagtaattggtaaattacaagaacgagtcgaaaaagctggagttgacgcagaaatttacggtcgtccaaaacatatttattctatttatcgtaaaatgcacgataagaaaaaacgttttgatgagatttatgacctgattgccattcgttgtatcacagaaacaacaagtgacgtttacacgactttaggttatattcatgacctttggaaaccaatgccaggtcgttttaaagactatattgccaatccaaaagccaatggttatcaatctgtccatacaaccgtttatggtcccaaagggccaatggaattccaaattagaacacgagaaatgcaccaaatcgctgagtttggggttgccgctcactgggcttacaaacaaggaattaaagcaaaagttgatgttcatgaaatttctgaaaccttgaattggattcatgaacttgtggaattgcgtgaagaagctggtgattcagcagaagattttgtcaaagccgttcaagaagatattttatcagataagatttatgtcttcactccaaatggtgaagtccaagaattaccaagaggttcaggtcctattgactttgcttatgctatccatacaaaagttggtgaccatgcgactggagcgaaagtaaatggacgaatgaaaccattatctgttcaactaaaaacaggtgatcgggttgaaattattaccagctcaagctcttttggaccaagccgtgactggattaatctagttaaaactaataaagctagaaacaaaatcaaacaattctttaagaaccaagataaagaattgtcggtcaataaaggccgtgaaatgttacaagaagctttggaagaaggtggatttgtaccaaatcagtatttagataagaaacatctagatgaagtcttcaataagattagctaccgtaatgcggaagctttgtatgcggcgattggatttggtgagctttcagcaacaacaattgccaatcgtttaactgaaaatgaacgtcgtgaagttgagagagccaaacaaaaagccgaagctgaagagctgatgaagggtgaagttaaacgcgaatcaagtaaaaacatcatgaagattcgtcacgatggtggagtcagtgtttcagggattgatagcctactagttcgtatcgccaaatgttgtaatcctgttccaggggacccaattgtggggtatattacaaaagggcgtggtgtttcagttcatagagctgattgtcaaaatgtgcgaagtatggaagactttgaacaaagacttgttgaagttgaatgggatgattcagaaaacttagtgaaagaatatgtcgctaatattgatgtctatggctttaatcgtcctggattactcaatgatgtgatgcaagttttatcaaattctactaaaaatttgatttcaattaatgctcaacccactaaagataaaaaaatggcgaatattcacatcgctttaggcattaaaaatctatcagatttgactttgattgttgataaaatcaaaatgaccccagatgtttattctgtaaaacggacaaatgcttaaaaaaagagcttgacttagtcaagctcttttaaattactttctttaataatataattgggacgtttttttgtttccaggaatattttagcgatatatttaccaataattccaagagagagaagttgtaagccgcccaaaagtaaaatcaaaacaatcaaagttggaaaaccttgaacagggtcaccaaaaatcagcgttttaagaagataaaaaatactgagtaaaagtgaggctaaaaaactaaaaaaaccaacaaatgtcgcaatattgagcggcatttccgaaaaatttataatcccatcaatagaataacggagaagttgactaaaagaccaagaagtttgaccagcacttcgttcgtgattttcgtattctaaataagttacatcataaccgacccaagaaaaaagtccttttgaaaaacgattattttctctgagtgtcaaaatactatccacaacttgacgagtcataagccgaaaatctctggctccgtctacaataggtgtagtcgatactttattaataatcttataaaaaagtcgagagaaaaatgaaatcagtggagattcaccagaacgtgaaattctgcgagcaccaacactatcatagccttcttgaagtttctgatacatagaaacaattagttcaggtggatcttgtaaatcaacatccattactgtaacaagtggctctgtagtagcttctaagccagcaagtaaagctgcttctttaccaaaatttcttgagaaactaatgtagttaatattgtcaacttgactcgctaatttttttataagaggaagcgtgtggtcactagaaccgtcgtttacaaagtaaaaaaccttttttagctcaagtttttctgttttgtcatttacctctttaataaagagctcaatcgtttcttcttcgttataaacggggacaacaatcgctaattcttccatttttttcctttattgtttttttatcttatcttatcttagtacctatttatgataatagctaaagagtcctgtgatgtcaagcttccttttgatgttattaaaatgaagaaatgcccaaagagagctgattaaaattgaactttttgtgctatactgtcagtaaagagattatcataggagtgaaatataaagattatgaaaatagtaattcaacgtgtaaagtcagcttctgtcagtattgatggagtcattaaggaaaaaattaatcaaggctttttattgttggttggggttgaagatgctgacagcaattttgatttggattatgcagtacgtaaaatcgcgcaaatgcgaattttttcagatgaagctgataaaatgaatctctccgttcaagatattcaaggagagattttatcaatttctcagtttactttgtatgcggaaactaaaaaagggaatcgtccgagcttttctgcagcaggaaaacctgattttgctaaagcaatgtatgaaaaatttaatgatagcttagctcagattgtgccggttaaagcaggagtttttggggcagatatgcaagttgaattgataaatgatggtcctgtcactattattttagatacgaaagaagctagaaaaaatgcctaaaagactgcaaaaaagtagcgtaaaaaagcgggtttctgttcgctctgtcagtaaaataaaaacttatcaggcctcagaaaagcctgaccaaattggtgaaatctggcaaaataatattattcaatcccttgatgaagattatttaaaggaacaggcaagaaaacaacaaagtcaaaacctgactgaacgtcagaaacgaaaaattgaggaaatgcaaagcaatccggagatgattcaagcgcgtgaagaacttaaagaagagtttctcaatacgcatccacaatatgccaagatgacgagtgaagaattgcaagaatcaatgactcatcatgctttagaagatgaaaagcttagaaaacaaaagctccgtcatcacattgaagcatttgctgacggaattattgcggttatcattacaattatgctccttgaaattcctgtcccttctggtaatcaaggttattgggagttcatcagttcagttggaatcttcttagttagttttgttgttacagctaatttttggttcaatcgtcacaagatttttgctctgacagaggaaattacggaaaaaatcattgttcaagattttatctttattggtttgctttcactaattccgctgttgaccaaatggattatggttgctccaacatcatttagtgccctgaattttggtctggttttgattgtgattttacttcagcaggagcttttaagttattcaattactaaagatcattttcataaaatgcctaaatcatttaaattctggcgtcgtgtttggttaatcaggctattttcaactattctaatgaatgttgtcatcatgattattgccattatttttccattttatggacattggctctttgttattgttcctatttttaactttttgttccgcatggttaatgaccgcaatcaggaggaagaagtttatgctgctacacgttctatcggtgttccttatttgaaagaaggttaataatgactgtaaaaaatattatttttgatttaggtggtgtaattttagacttaggttttgaacgaatggtcaactcctttgagaacttaggaataaaagatttttctgcttattttaatccgcaaaagcaagtcgattttttgaggaattagaattaggccttatttctcccgaaattttttatgacaagtttagagaagcaacaaatagccaactgacagatgaaataattgaagaaaattggaatttaattctaaaagatttccaaaaagaacgaatggatttactgacagagctgtcagcagatttttcactctatcttttttcaaatacgaatgctattcacgctaagtgttttgagcaacgttgtattgaagaaatgggtcagcctctatcaacttattttagaaaaacctattattcacatgatttgcatttaagaaagccaacagttgaaagttttcaagaggttcttcgtcagtcaaatttaaaggctgatgaaactttatttgttgatgacaatgcggataatatcttgggggcgcaagcagcaggtttgaaaacgtatcatctaaaggcaccaaaagtactgacagaactcaattttcaagaaataatttactgacaagtctgtcagtaattttttttggaaaaaatatttttatactgcataaagttagttcttgacaattgtcagacaattcggtaaaatacagtttattgaaattatttagttacaaattcagaaaaatgaggatttattatgggatttatgagaaaagctgattttgagctttatcgagatgcagataaacactataatcaggtgttaaccacacgtgattttcttgcactaggtgttggaacaattatttcgacttctatttttactttaccaggtcaggtcgctgctcaatttgcaggcccaggtgttgttttttcttacctgcttgctgcattggtcgctggttttgttgccttggcttatgctgaaatgtcaacagtgatgccatttgcgggttcagcctattcttggatttcagtcttatttggcgaaggttttggttggattgctggttgggctttgcttgcggaatattttattgccgttgcctttgttggttcaggcttctcagcaaatctgcaacaattgctagcgccactcggtttccatctaccaaaagtattggccaatccatttggtacagacggtggagttgtcgatattatttcacttttagtcattttactctcggcaattattgtctttcgtggggcatctgatgctggacgaatcagtcaaattcttgttgtgcttaaagtagcagctgttattgctttcattatcgttgggattacggtcattaagccagcaaattaccatccatttattccaccacacaatcccaaaacaggttttggtggcttctcgggaatctggtctggggtgtcaatgattttcttggcctatatcggttttgattcaattgcagccaattcagcggaagctaaaaacccccaaaaaacaatgccacgtggaattattgggtcgcttctgattgctgttgttctatttgcagcagtaaccttggtacttgtagggatgcatccttactcagcctatgcaggaaatgcagcgccagttggttgggctcttcaacaatcaggttattctgttttatcagaagttgtaacagctattgcacttgccggaatgtttatcgctcttttgggaatggttcttgcaggttcacgtttgctttatgcttttggacgcgatggacttttacctaaaggtttgggtaaaatgaatgctcgaaatcttccagcaaatggtgtgtggaccttagccgttgttgctattgtcatcggggcattcttcccctttgctttccttgctcaacttatttcagcaggaactttgattgctttcatgtttgttacacttggaatctattcacttcgtcgtcgtcaaggaaaagatttgccagaagcaacttacaaaatgcctttctacccagttttaccagctcttggttttattggttcactatttgtattttggggattggatgtgcaagcaaaactttattcaggaatttggttccttattggaattttgatttattttgcttatggaaatcgtcgaagcagaaaatcagaagaaaaataaaaagatattataaaaaatgggctcaaaatcttttggaaccatttttttgtcatcattttggagcggacaaaaattgctaaaattactaaaataagttaaaatagggaagttatcagcaactatgatatgaggagtaaattatccaaaaatgaaagaatatgaaaaacaacatcgaatcttttatgtctttttacgcaatcttgtcgcttttttacttttgattttgaatggaaaaagtaaatactacaatgttgaccgaattcctaaagatgaaaattatatattagtcgcccctcaccgaatggcttgggagccagtttggtttgcttttgcaactcgtcctaaacaatttattttcatggcgaaaaaagaattgtttaaaggatttggaggttggtggattaaaatgtgtggtgcctttccagttgaccgcgaaaatccaggaactaagcctttaaaacatgcggttaaaatgcttaaagaatcagataaatcaatgattatgtttccatcaggaagtcgtcatagtgcagagatgaaaggtggcgttgcggtcattgctaaaatggcaaaagtccgaattgtacctgccgtctatcaagggcctttgacgatgaaaggtgttttcaagcgccaaaaagtttcaataaatattggacatccaattgatatttcagatattaaaaaaatggatgaagcaggcattgccgaagttaaccgtcgaatggaagttgcttttgcagagcttgatagagaattgaacccagattttcattatgaagcaaaataaaaaaacctagcaaattgatttgctaggtttttttttgacttattctgaatcaaaaagtcctgcttctgtcagattgaaatcagacagaaagttcaaaataattgatttttcttgttcattatatttatcgaaaatttgtccaagtttaatacccatgattttatgcattttatcgtgaatggtcgctacttttcgacctttgactgtcaggtgatagaaaattttctttttatcactttcagattgataagtagttaaaaactgatatttgattaaattttggacagcacgagtcactccgccgcgagtgacggataattttgtggctaattcaataccggttaaatcttctttggtcaaagctgacaaaatgtgaagggcaacaactgacaaagtcaaaacttctttttctaatttatcattatctaattgagctaaaatccagcttctttcctgagaacgattgtcagttgcatgtcgtaactcacgcaattcttttgaaatttgttggtttaggtctgctgaggtcatcttatccatgcttacattatacaataaaagggaattagaagtctttcccaaatttttctgcactggtaaatgctttttcttttaattcatccgcacgttctgggtagcgagcatatccttctacgaaaagttgttgacggttctcgtcagtaattcctaccattttcattgtttggtcaatataagcagcacctaaatcgttagccatatgtgttgggtcttgttcattatgataaaatcctccagctgattgaatgtgaagcgatttttttccttcaagtaagccaatcggaccattttcagtataacggaaaagttttctaggcacagcaataacatcaatatattgtttcaattcagcagtgacaaagccgttgtacatcgggttgacgaaaacatatttgtcagctgatagaaattcttctaaatattcttcgtgtcgatgtagtaaatttttatcatcagtactcagtgtatcaggagcatatttattacgtttccaagcagcaaaagtttcattatcaagagctgggaccttttctgaaaataaatcacggatgattattttatctaaaggatgagactcttgataagattttttgaattcttctactgtagcaagagaccagctaaagtcgtcagtatgtgggtgagctaaaattataagtaaagttgtcatttttttatccttctttctttttgttgataagcaacattataaacttaattttgttgcttgtcaacatgaaaacgaattaaattcgaattatttgtggtatttcagtttgtaaaagctatgtaaaagtgttacaattaatggtaatatccacttattttgtgaaagagaaattatgccgaatattattagaaaacttgtcgaaaacgacaaaaaagagctcaaaaaactcaatagaatggcgcttcaagttgaaagtttcgctgatgaaatggaacatttgactgatgagcaattgaaagccaaaactcccgaattaaaagcacgtattgcaaaaggagaaagtcttgatgatcttctctatgaagcatttgctgtctgtcgtgaagcggcccgccgtgtgcttgggttgtaccctttccacgttcaaattatgggtgggattgtcttacataatggtgacgttcccgaaatgcgtactggtgaaggtaaaactttaactgcgacaatgccagtttatcttaacgctttgtcaggtaaaggcgttcacgttgttactgtcaatgaatatttggcaacacgtgatatgactgaaatgggtgaactttacagctggcttggattgactgttggtttgaacttgaattcaaaatcaccagaagaaaaacgtgaagcttacaactgtgacatcacttattcaacatcagctgagcttggctttgattatcttcgtgataacatggtgacacgtgccgaagatatggttcaaaagccattgaactatgcacttgtcgatgaagttgactcaatcttggtcgatgaagccagaacacctttgattatttctggacaagctgaaagttcatcagcactttactatcgtgctgaccaattcactaagacattaaaaggtcaaaacttgaatgttgctacttctgaatatgaagaaggcgacgattacaagattgatttacaatcaaaaacaatttccttaactgaagaaggaattgataaggccgaaaaattcttccaaatcgaaaatctttatgatatggaaaatgttgccttaactcactttgtagataatgctttacgtgccaactttatcatgcttcacgacatcgactatatggttgatgaaaaccaagaagttttgattattgaccaatttactggacgtacgatgcctggacgtcgctattctgatggtcttcatcaagcaattgaagctaaagaagctgtgccgattcaagacgaatcaaaaacaatggcttcaattacgattcaaaactacttccggatgtataaaaaactgtcagggatgacaggtactgctaaaaccgaagaagaagaattccgtgagatttataacattcaaatcacaccaattccaacaaaccgtcctgttcaacgtttagaccatccagatttactttacccaactttggaagctaaatttaaagcagttattgatgatattaaacgtcgtcatgctgaaggtcaaccaatattgattggtactgttgctgtcgaaacttccgaattgatttctaagaaattggttgaagcaaaaattcctcacgaagttttgaatgcgaaaaatcacttccgtgaagcacaaatcatcatgaatgcgggtcaacaaggagcagtaacgattgcgaccaacatggccggtcgtgggactgatatcaagcttgggcctggtgtaattgatcatgcagaccctgaattccgaggtcttgctgttattggtactgagcgtcatgaatctcgtcgtattgataatcaattacgtggtcgttctggacgtcaaggtgacccaggggtttcacaattctatctttctcttgaagatgaattaatgaaacgttttggttcggaacgtgtttcagctttcctagatagaatgcgtatttctggtgaagatgctgtcatcaaatctggcttgattactcgtcagattgaaagttcacaaaaacgtgtcgaaggaaataactacgattctcgtaaacaagtcttgcaatatgatgatgtcatccgtgagcaacgtgaagttatttatgcgcaacgtcaggaagttatcttggctacagaagatatgactcctgttttgatgggcatgttcaagcgaacaattgatcgtcaagtggatggtcatgaacttgcaggaagtcttaaagatgaagaaaatgtcaaaaatctcttgcaaacattacacaatacaatgttgccagaagatggcattgaattgtctgaactgacaggcttgtcagtacaagcaatgaaagatttgatttttgataaagtcaaagctcgttatgcttcacaaatggaaaaattatctgacccagaacgtcagttggaattccaacgtgcagttatcttacgagttgttgataataactggtcagaacacattgatgcgcttgaccaaatgcgtcaatcagtaggacttcgtggttatgcccaaaataaccctattgttgaatatcaagaagaatcatataaaatgtacaataatatgattggtgcgattgaatttgaagtgactcgtttgatgatgaaagctcaaattcaaccacaaacggcaatccgtcaggaagcgccaagaatgacaaccacagcttcacaagaaaatattacaaatgttgatactgaacattctgtcagtgaagaaatttcatttgaaaatgttggacgtaacgacctttgtccttgtggttctggtaagaagtttaaaaattgtcacggacgtacacatattgcctaaaaggccaattaatttactgacagctctgtcagtaaatttttttatcactaatggacgcaaataagtatagaattaaataaatttttgatacaatagataaaataacaaagcgaaatacgaggaattggaatgagttttaaagaaataagtcctaagataaatattgatgcgattaagatgttgggacatctcaacagtgagcaacaagaaaaaaaattgcaacgagataaagaacttgaagcaattataaaaggtgaagatgaccgtttactcttgattattgggccatgttcgtcagacaatgaagaagcagttttagaatatgctcgccgtttagctaaacttcaagaagcagttaaagataaaatttttatggtcatgcgtgtctatactgcaaaaccccgtacaaatggcgatggctataaaggattgattcacgaaccagatgctgatggtcataccgatttaatcaatggaatcaaaatggttcgtgacttacattacaaggtcatcactgaaactggtttgacaactgctgatgaaatgctttacccagaaaatcttccaatggtagatgatttggtcagctaccatgcaattggtgcacgttctgttgaaaatcaacaacaccgttttgttgcatctgggattgatgtgccaactggtttgaaaaatccaacatcaggaaatttgaaagtgatgtttaatggaatttacgccgctcaacaatcacaagatttcctctttggtcgtgcagaagttcaaacatcaggaaatcctttagcacatgcgattttgcgtggtggacaagatgaaaatggaaaatatcatccaaactactacactgataacttgcttgatacaattgaaatttatgaaaaaatgggcttgaaaaatccttttattgtcattgatacaaaccatgataactctggtaagaaatttatggaacaaatccgtattgttcgtcaaaccttagttaatcgtgactgggatgataaaattcgccaaaatgttcgtggcttcatgattgaatcttacctagaagatggtcgccaagataaaccagaagtatttggtaaatcaattactgacccatgtttaggttgggataaaacagaagcacttgttcaagaaatttacgaagctgaaaacaaaaataactaaaaataaaagctgtcagaactgacagctttttttcagctcattttcttcaggaaaataatataaaaaatacttatttgatgataaaagaaatcaaagtctagcaaccattcaaaagcagccatgaaaaaaaaaatgaaaaattaacagcagatattgcaaaccctttcgttttgtggtacaatttcaagagtgatagatattttagatatcgtcaataaaaatgaaaaaacatctaaggagaaccataaaaatggcatctaaagaattccacatcgttgcagaaactggtatccatgcacgtccagctacattgcttgtgcaaacagcttcaaaattcacatcagaaatcactttggaatacaaaggtaaatcagtaaaccttaaatcaatcatgggtgttatgtcactcggtgttggtcaaggcgctgacgttactatttcagctgaaggtgcagatgctgacgatgcaatctcaacaatcgctgaaacaatgactaaagaaggactcgcagaataatcatgacaactatgcttaaaggtatcgccgcatcatcaggtgtagcagtagctaaggcatacttgcttgtccaaccagatttgtctttcgaaacaaagacaattgctgatacagctaatgaagaagctcgccttgatgcagcacttgctacatctcaaagcgagcttcaacttattaaggacaaagcagtaacaacccttggtgaagaagcagcatctgtatttgacgctcatatgatggtcctcgctgacccagatatgactgctcaaattaaagcagtaatcaacgacaaaaaagttaacgctgaatcagccctcaaagaagtaactgatatgtttatcggtatctttgaaggaatgactgataatgcttatatgcaagaacgtgcagctgacattaaagacgttacaaaacgtgttttggctcaccttcttggtgttaaattgccaagtccagcgcttatcgatgaagaagtaatcatcgtagcagaagacttgacaccatctgatacagcccaattggacaagaaattcgttaaagcctttgttactaacattggtggacgtacttctcactctgcaattatggctcgtactttggaaattcctgctgttcttggaacaaataatattactgaacttgtttctgaaggtcaacttttggctgtttcaggattgactggtgaagtaattcttgatccatctactgaacaacaaagcgaattccgcaaagctggtgaagcttatgctgctcaaaaagcagaatgggctgctcttaaagacgctgaaactgttacagctgacggacgtcattatgagcttgctgctaatatcggaacacctaaagacgttgaaggtgttaacgataacggtgctgaagcaattggtctttatcgtacagaattcttgtacatggatgcacaagatttccctacagaagatgaccaatacgaagcatataaagctgtacttgaaggaatgaacggtaaaccagttgttgtccgtacaatggacatcggtggtgacaaaacattgccttactttgaccttcctaaagaaatgaacccattcctcggatggcgtgcacttcgtatcagcctttcaacagctggtgacggaatgttccgtacacaattgcgtgcacttttgcgtgcttctgtacacggacaacttcgtatcatgttcccaatggttgctctcgtaactgagttccgtgcagctaagaagatttatgacgaagaaaaagcaaaattgattgctgaaggtgttccagttgcagatggtatcgaagtaggtatcatgattgaaattccagcagcagcaatgcttgcagaccaatttgctaaggaagttgatttcttctcaattggtacaaacgacctcatccaatatacaatggctgcagaccgtatgaatgaacaagtttcttacctttaccaaccttacaatccatcaatccttcgtttgattaacaatgtaatcaaagcagctcacgctgaaggtaaatgggctggtatgtgtggtgaaatggccggcgaccaaactgctgtaccattgcttatgggtatggggcttgacgaattctctatgtcagcaacatcagtactccaaactcgttcacttatgaaacgtttggattctaagaaaatggaagaattgtctagcaaagctttgagcgaatgtgcaacaatggaagaagttattgccctcgttgaagaatacactaaataatcttttcgattgatttgaataaatgaatcctgtcagttctgacaggattttttgtaatctatttatcaacaacaaatttactgacagaaaaacttatccacgtggataagtttttttgtgttattttaatgttaaagcgctacaatgatgataagtggagagaaatgacaaaactaaatttttttgattactggttagttggagagggaggttacggtctcgttttgatattcattttacctggccaaattaatattaatttctggcttattttgacgagtaagcaaactagcggttcagtttttaatattattgccctaccaattttgatggccttgcctaatctaattcaacgggtgatgacctcaacttctatttattggactaaacaaaaatatattattctgatattgaattgtattttactttcagtgacaactttttggttgctaacattgccttttgggcagtaaaaaagttactgacaaaaaatctgtcagtaactcatacatgcttaaaatggtaatcctttagtgaattttccaagtttttgttcagtaactttttcgatttggcttagcgcatcgttaacagcgtcagcaaccatatcttgtaaagtttcaggatcttcagggtcaatcacatcaggtttgatgtcgagagatttcaaagtgcggtcaccggaaaattcaacggttacaaggtcttgagcagatttaccaacaaaagttgtattggcaatttcttcttgtgaaacttgcatttgtttttgaagtttttgtgcttgtttcatcattgattgcatattcatcatggaaatattacctcttttagaaattttgttgaaagcctttcaacacttctctattttaccataaaaaaagataataaaaaaataggaaaataaaggagagacaaatgaaacttatgtaaagtcactttttatttactgacagaagtagaaagggttgaggagcgttctgtcagtaaaaaatgagacaaaaaaactcagccttagctgagttttattagtgcggtgggcgggacttgaacccgcaccaagaaaattcccgacaggatccttaatcctgcgcgtctgccaattccgccaccaccgcgaaaacagtacctaaatataataccattttcattgttctctgtcaagaattaactcgtaatttactgacaagattcatagtaaattatggattataagctttcataaattttgaaattgtttgacgataaagttcagggtttgtttcaaatgatttggcgtgagcagcccctttgataaccaataattcttttggcgttccttttttgacagctttataatttttgtaaaccatcgaagtagggacgtaagtatcattacttccatgaatcaatagaataggaagtttatcttttgtcagtgcttttgtagcactagcctcttggaaaaaccaaccttgtcgcaatttactttcaagagaaacactataaacgagtgggaaaggtggaatattataactttcttttgcttgataagtaatttcatcccaagcgttggtatatccacaatcttcaataatattttttactgacgaaggcaaagatttttcgctggaagccatcattactgtagaagctcccatggacagtccataaagacttatttgactctcaggattcttgtcagttaaatagttagcccaagcaatgacatcaaatttgtcatgataaccaaaagtgatgaatttgccttctgactgaccggccccacgattatctggcatgagcacattataacctaattcatgaaaaagttgaccatactggcgcatagccgacttatcttggcgaaaaccatgtaccacgattactgtattattagttttgtgctcagctggaacataccatgcatcaagtttcagaccatcatttttaattgactcagtactttttgataatttatcgaatttttgtaccaaagaataattaggactgctacttttgacctggccaatctgttgattatttcgaacacaggcaatttgataaaaatataaagttgctcctaaattaataactaaaagaagagcaaaaaggccaattatcacacgccagatttgtttttttctaaattttttcataaattttattatacatgaaattcaaaataataccaaaaaataatgtctgcaatgtcatacaaaccgcttgctgtatggattgatgcccttttttgtggtaaactatactaaataggaatttcttgtgaaagaaatttcaatgtttttaaaaagtgaggagtaaaaaggaaagtatgaaaaaagtattgctgtcatttctaaccattatgacaattttgatgattggtggagttaaagtctctgctgattcaacacaatctgaaatttatcgcttatacaataagaacactggcgagcatttttataccagtagtgcttttgagcgtgattctgtcagtaaatcaggctggtcttacgaaggagtgggttgggtttctcctaaaaaatctgcaactccaatttatcgagtattcaatcccaatgctcgtggtggagaccactattatactaaaagtaattatgaagctactcaactcgtaaaaaaaggctggaaatgggataataatgctcaacctgtcttctattctggtgggaatattccagtatacgttgcttttaatccaaatgcaagctctggttcacataactttactaaaaattcaaatgaacaaaatagtcttcttaaatctggttgggaatatggagcggtcgcttggacttcggaaacctggataactcccaaaccacaaccatcttggaaaccgggtgtttctcgcttctatactattccaggcattgctcataccgtttttggtgataacatcatggaagaagcagatgtaaataaactaggaccagtaactttaaaagtagatactgatttagacctaactggttcaggacgaggttatcatggaaaacttatgattggtgacatgggtggagtggagacaacgtctcttttggaattcagtatgatgctaaaagtggtttggatgatgggcaatggtctggtaaagggctgtatctatcagaaaatgttgcagacggaggagtgcatgaaggagggaatgctttgtatgtcgcttatggttctgcaccaattggtaaaacagtacatctcagcttagcttactatcaaagtcgtcaacttgtcgctttctttgcaaatggggtgttgatgggaagtcaaaaagtaaactttaaggaaacaaaatcaacaactaatgcgatattaaatagtgatcgaactggtctgacagaaaccaatgctctttatatgctcagtgcccaaggagcgactgcttttggtggagactctattaacgcggcctttactaacattacaactgaaggagcacctttgggttatgaaaattggatagacagcccaggaaatggtgcgcttaattggtggaatatcctagccaaggattattcaagtattcatcaatcaaatggtatagcaggaagtcaaatgataccaacacaagcacgtgtgactgtaaaagggacttctagcttgccagcaggttacgattgggattcattcccaggagctaaacaacccacaggaggaattcaaattccagcgggaatacctattcgttaaaaataaatttagcttttttaataaaagtgtgatagaatgaagaaaatagaataaatactccaccgggagttaaatcgtatgaacgattgtttacatttcagtaggtctgagaagaaatgtagatggtcgttctttttttagctgaggaggcaaaaatgacttggatttatttacttatagcgggaacatttgaagtggcttgggcaacaacaatgaagttgagccacggcttttcaaatttgaagtttgcactactgacaatcatcggaatgattgctagctttggttttcttgcactagctctaaaaaaattacctttagggattgcttatccaatttggacggggattggagccgttggctcaatcttaatcggacttattctattcaaagataaagtcccaccattaacttggcttttcattgcctgtttagtcgtgggtattattggaataaaagtaacaagcggtcactaaagatgatacagtcttttaattttttagtatatagatttcatgatataataagagaattggtaaaaaataaaagaaatagcaatagaataatctatttgctatttttaatgaggaggaaaaaatgaaaaacaaaaaaagcatgatgaatttagcaatttctaatctgtttttagtatttttgggtgcaggtttagttattcctgttttgccaacccttaaagaacaaatgcacttttcaggaacaacaatgggaatgatgatttctatttttgcaattgctcaattggttgcttcaccagtcgctggtgctttatctgataaaattgggcgcaaaaaactcattgccattggaatgattattttttctttttctgaacttttatttggtttagcacaagcgaaaacaggcttttatatttcgcgagcgctagggggtgtcgcagctgcgatgctcatgccttcagttactgcttacgtggctgatatgaccacaattgctgaacgtcctaaagcgatgggacttgtttcagcagcaatcagtggtggctttattattggtcctggagtgggtggttttattgcccattttggaatacgtgttcctttttatgttgcagcaattttagctttccttggttttattttaacaatcacaattttaagagaaccagagcgcacaattgaaagtcatcaagaaatcgaaaaagtttcatttcttgatattctcaaaaatccattatttggttcactctttattataattttgatttcatcatttggtttacaggcctttgagtcaatttatagtatcatggcaagcattaactttggttttagtatgagtgaaattgctttggtaattacagtgagtggaattttagccctctttttccaacttttcttatttgatgcaatcgtcaataaaattggtgaacttggcttgattcaattaactttctttgccagtgcaattttcattgctgttattgcctttacaaaatcaaatttagtcgttgctctttctacatttgttgtttttctagcctttgatttatttaggccggctgtaacaacctatctttcaaagcatgcgggcaatcgccaaggggcaatcaatggcttgaactcagcctttacgagttttggaaatattttagggccaatggccgcgggttatatgtttgaccttaaccatttatttccatattatatctctgcgattattctactgggaaccggatttttatcactattcttaaacagaaaaaatttcagtaaaatctaaatataatttttttattcaaaaagcctacactaatctgtaggttttttgtatttatgtattaataataattaaaaaagtattaaatttcgtaaatattaaagtggatgaagtattacaaaacatagtattaaggtttgtctagaaataacagtaatttgttgatttttaacaatatatgaactatactagaagcaaagaaatgggtaaaaaaatttctattttgtctattaagaaatacggattcttaagtatctaagaaaatgagaaaagtttaatatgaagttatcaattgtagttccggtgtataacgaagaagaaagcatcgaaatattcataaaggaagtggaagaaaaaaccaaaagtttaccattagaaaaaattttttattttgtaaatgacggttcaactgataagacattaaaaataataaaaaagctagccgaaaagagagctgatatacaatatatcagcttttcgagaaattttggtaaagaagccgctctattagcaggtttagaagtagcggttggtgactttgttacgattatggatgtagacttacaagacccgccagaaatgcttccagaaatgtttgaaaagttgcaagaaggatatgatgttgtggggacaagacgaacaagtcgaaccggagaacctcctattcgctctttctttgcaaagcttttctataaaataataaataaaatttctaaaacacaaatagtcgatggtgcgcgtgattatcgattgatgactcgacaagtggtagatagcatcttaaagcttcaggaaagtaatcgattttccaaaggtttgttttcttgggtgggttatgaagttacttatttagaatatgagaatagagaacggagtagaggacaaacttcatggtctttttggagtttattacggtattctgttgatggtttcgttaatttttccgagttaccattaaatatagcgacatttgttggtattctttgtttttttatatcaatcattctgagtcttttttatacagtaaaaacacttgtttggggcgatagtgtgcaaggattcccaacgcttgttatcttagttctaatgttgggaggattgcaacttttagcctctggaatcatcggaaaatatctagctaaaacgtttattgaagtaaaaaaacgtcctaattatatcatcaaagaaagtaatataaagtccgaagatgaaccattgaacaatcagaaaggtaaaaggttagtaatgtgataaaaaaagaaaaatttccctttctgctcatagtccttttttacattttattttttataacaaatcaagttgactggctgggtggagatgccttgtggttctctaaagttaattcttcgccacttacttttgctatagacagatatgagacttggtcctctcgattttggattgagggagcagtgcttctatcaagtaaaaatctgttgatttttttcatcctaacaattgtttttatctttctgttattttattcgataagtcaacttatttcttttaataaatttataagtaatttagtgcttgttttagtttttataatactatttccaatggtctctcttaaatctgcaggactaattgctacaattgtgaattacgtctggcctagtgccttatttgcatactggttaatgattgaccgtcagagaaattcagaagagaaaattgcgatttataagattgttattgccactctttctctaatactatcagtatttaatgaaggattggcaattgtactttttctctatcttatcattcaagttgttattgagaaaaaagaatttttgaacccatatcggatagtttgtcttctcgtttctttattgagtattttaaatgtcttgctatgcccgggaaatcaaaaaagaggagctttagaaatggtccattggtttccaacttttaaccatttatcattttttgataagttactaattcaattcaacaatatcgcttcaaatttgattgttagtcataactttatagagattttatttctattgttattattgagagcagttcagaaaagacagatattgtccgtaatactatctgctgtgcttataatgttatccaaaatctcacaaaaattaatttcagatccacttagtgtaattgtgcaccattcatcggaaaagaagtttaattataatataactggcaagttactaggaccgagtgttatttttatgataatgctggctatgattgtctttgttattatcttattggatggtaaatcaaagaaaagtttcgtagctattggttctttagctgtcaccttttcggcgggaatggctattagtttatcaccgacactattagcgtcatcagaccggccactgttatttttatattttgtaataatctttaattgtgctattttagcagacgatataattggatttaataaaagtaaagacagtctaaatcctgttgaggaaatatccaaataaaaaagattcaacttattaatgagttgaatcttttttataaaaatgaataaaaaacctcctgatgtaatcttatacagtcaggaggaaaaggagtaagcgtattggtcactggattttctataattttttcaaatagggtagaaaaatccatttataaaaggagtcaaggggattatttaggtcgctctcaaagttaaattcaggttctacaagcctttataaacctgtttcatagaaaacctcttaaattgaaaaataaaatgggacaaatttggggcaattatggtataaaatcatagctacgatttaatctcattgaatttttgagtttataaagttaaggaactaagtatattattttgaagatttgaacaaaaaataaactaaagagtcattaagaattgaactaatgactttttattttgttaagctatatgtttttctctttgtaaactaataatcagtattgagcttaacaaggtgctatacttaattttatgagatcacagtctctgttgtagaatagaaaccaaaattggtttctatttttgattactattgtaatttggaattaaagtgatatacttagctcatgggtggtttagcgaaagcaccacaccttcatcattagctgctcaattgtgagtagcttttttaaaataatgtgtagtggtaaagaattaagttgctaataagagtgaggaatgtctaacgaataagaataaagagaaaaaagcgattataagcttactattttttgggtttgtagtaagtatattagttatatacctagtaataagttttctgatgtgagaaaaattttgagttctgttcgcaagaacattttttagttaaataattatcgaagtttaaggcttaaattgactttaactgatattagtgttacacttgcgaagcgggatggagcagttaggtagctcgtcgggctcataacccgaaggtcataggttcaaatcctattcccgcaatatttcaagggctttagggagcccttatttttcttatataaaactcacccttaagtaataaaaattttttgttaaataggcagcgcctagaatggaagtgaaaatgaaaacaggagataaaattacattatcaaatggtgaacaagcaacggtcgtttctggagatattaatctctataagaatgcactaattgttgaattagaaaaccatgatgtcagggtggttgatagagaaaccctgacacttgctaaagcaaatcctcatgaaaatctggggaatcacaagaaaatcaataagttttaaatagaccaatttgactttggtaagaataggtgttactattaagaggtaggttttgtctcgagtttaaatgttttagcaatgcactttttcgcaaaataggatttacagatgatgcgaaaggatgtattatatgaataaaggaacaataaattggtttaacgctgacaaaggctatggttttattatggcagatgatatgcaagatgtgtttgcttatctcttatctattcaaggaaatgattttaaaaaatacgatgaaggtcaaaaggttacttttgatatcaaaatgacgtctcgtggacgttatgcttcaaacgtacataaaagataaatgagttaaagcatggggtgtcctttgcttttttatttattgctattgcaaaaacgaattaaaatgttatactgagtgagggaaagattagttgctttccctacagttcataaaatccatgtcactacgacatggattttattaatgagtgagtagtttgacattgactataattagtgttattattaagaagtaaattttgtcatgagtaaaatgttttatagattcacttttcgcaaaatgagatttacaattttgtcgaaaggaaataaatattatggcaaatggaacagtaaaatggtttaacgcagataaaggatttggctttatcacttcagaagaaggtaaagatttgttcgctcacttctcagcaatccaatctgatggattcaaatcacttgacgaaggtcaaaaagttgaatttgatgttgaagaaggtcaacgtggacctcaagcagttaatatcacaaaagcataattatatctgaaaatcgtgcaaaagctgaagtaatgacttcagttttttttatatttagttgcaatgatgagagagtatgatatacttatccagcaagaggaaactcacacttcccatgcataaattagggccactctaatatagagtggtttttttaatgtttattaattaaaattaatatttaaaagatttatataaaaaaccacctatcacagcacataatgataagcagtttttggtgcatgttcatagattaagaagttaatatttaaaacatacaaattaataataccatatagatagacttaaggtcaaaaatagagagatgtgttataatggagtaccttaaacataagtgccagcaaatgctggcttttttattttcttagttatttgaagtgctataattattgggttagtaaattaaaaaaatgaatcatatctcttgaatactcgttctaaatgtgttaaattaaagtaagaaaaatattataatctttagaaagaggttgcttatgatttggtcattaattgttggtgcattaatcggattaatcgctggtgcgattacaaaaaaggggagttcaatgggatggatttctaatatcttagcggggttagttggatcttttgtaggtcaagccttacttggaacttggggaccttcgcttgctggcatggcattaataccatccattgttggtgcagtgattgtggttgctgttgtatctttcgtcctatctaaaatgaattaatagatcttaggatctagaaaggaggagttttggcaactggaaagaaagtaatactcattatccttgatctccttttacttacgcttgttctaccaatgacgtgggattattataatttcatggaatatgattggataacaacaacctctagtaacattcccttcataggtaaatatatgacagactatttgttttgggggaacatcgttttaacagtcatattaattatcgccttgattgtaattcttttttaccctcgaacctatatggatgtacaactcacttcaaataatggagatttaactttgaagaagtctgccattgaaggttttgtaggtgaaaaagtaaaagaaaatgattaccttaaaaactcaaaaatcgctgtttcactttttaaaaataagataaaaattgatataaagggtgagattgttcctcgagttgaagtggcccaaaaagctcaagttctggaacaggaaatcattgaagggttaaaaagtttctttggattggaacatacggttaaacttaaagtaaaagtcaatacattaagtaaagatgataaccctaaacgccaacgtgttatgtaggagggatcaatggattatttcgaaaaaaatcgatacccattaaaaaagttataagtattttattatgtacagaaatattatcaacaagttatgaaaaccatttcttttttgttcaaaaaaacctgtcagaactttgacaggtcaatattttattgatattgcattactttttgtgctttgtaggctacgtcaatcatcgcaccaccaaggcactcttctccatcatagaaaacaactgcttgtccgggagtaattgctcgaacaggttcgtcgaaatcaacggttactttatcaccattaacgtgaatagttactcctgtatcttcttggcgataacggaattttgctgtacagtgaaggtcaaaagtttctggcatttctctggtaaagctcaaatcgcttgcgtcaagacttgttgaataaaggtgttcatgatggaaaccttgtccaacataaagggtattagtagttaagtctttaccaacaacaaaccatgggtcacttgttaattggccgtgttgtccaccgataccaagaccaccacgttgaccgattgtataatacatcaaaccggcgtgatttcccatttcgataccgtcaagtgtcatcattttacctggttgagctggtaaatattctccaaggaactttttgaaattcttttcaccaatgaagcagattcctgttgaatctttcttcttagcagttgcaagtcctgctttttcagcaatcttacgtacttcaggcttttccaaatgtcccaatgggaacattgttttcttgagttgttcttgggtcaattgacttaagaaataagtttggtctttgttgttgtccgcaccacgtaacatatgaacgataccattttcatctgtacgaacttgggcataatgacctgttgcgacgtagtctgctcctaattccatagcataatctaggaaagctttaaatttaatttccttattacacatgacatcaggatttggggtacgtccagcgcgatattcagcaaggaagtattcaaaaacacggtcccagtattctttttcaaaattgactgagtaataaggaacgccaatttgatcagctactgcagctacatctttgtagtcttcagtggctgtacagacaccattttcgtcggtatcatcccagtttttcatgaagacaccaataacatcataaccttgttctttaagaagcaaagctgtgactgagctatcgacaccaccggacattccgacaacgacacgtgtttgtgctggactcttaccagacataagttgagtatttgtgttatccattaatttttcaccatctctttctattttgattttgaaaagaaataaaagtgctgacgaaaaaaactagacgatttcgtcagtaaattttttcttttcaagttagacaaaatatcagttgaaggctgacttttgtaaatgttgcagttgaaggctgaacattaataggtaactggaatattataacacattgcctaagtaaaaactagcctttgaataaaaaaagtagtcaaaaaaagtggtataatgtcataatgattaaacatagtgaaaatcctttagttttcaatacagctattggaacaaaaaaacgtaatgaaacagtcgtacctaaggaagttctttgtcctttttgtgatgtggaaaatctgacaggtattttaaaaacttctgaccataaaatttggttaaaaaataaatttccaacactcaaaaattcaatgatgactgtgattattgagtctgatggacatttaggtgatatttctacttatggtgtggaagaaaatcgtgaggttttttcttttgcttttgaatgttgggatgaaatgattcaatctggcaaatatcaatccgttttgatgttcaaaaattttgggcctcgctctggcggaacattgcgtcaccctcatttgcaagttgttggcttagaagaaactgacggttatgctcaaattgcaaaagaaaattttgaaggagtcgaaatcagaaagaatggtctgactgtcactttgtctactcgacctattatgggctttgtggaatttaatgttattatttctgaacttgaaaatgttgaaaaattggctgacaatgttcacgggattacctcttatttaatgacagactatatgaatgggcgttgtgattcttataatctctttttccatcatttcgatgataaatatatttgtaaaattgttcctcgctttattacttctccttattttattggttataaaatcccgcaagtcaatggaattgaagcattagaagaaattgctgacgagattagaaatcgtttagataaaaagtactgacaggtttgtcagtatttttttaatacacttaatataagtttgatttttgtatctttggtataatagaaatatgaaatttatcaagaaaaataaatgggcacttcttgcaagtttttttattccattattattaatggttatcgttcttgcaataactgggatttattgggggagttcacggtcaattttggctggggatgcatatcatcagtatgtcgccattcattctctctatcgtaatattttacattcgggcggttcttctggtttcttatatacttttaccagtggtctcggcctcaatctttatgctttttcggcttactacatgggaagttttctcatgccacttacatttttctttgatgtaaaatcaatgcctgatgctttatatttactgaccatactaaaatttggcttgattggtctatcagcatttgtcagtttcaaaaacatgtatcaaaaactttctaaattgattgttttgtcaataagtactgctttcgcactgatgagttttttaacctcacagcttgaaattacgatgtggttagatgttttcattctcttgcctctaattatttggggacttcatcgcttaatggatgaacgaaaacgctggctttatttcgttagtttattgattctatttatccaaaattattattttggctttatggtggctattttcttagtgctctatttcttggcacggatgacttacgaaaaatggtcttggacaaaagtgcttgattttgtggtttcttctgctttagctggtctgtccagcctaatcatgctcttacccatgtatcttgatttgaagtctaataattccgatgctctttcaactttgtcaggtgtctttacagaaaattctcatctttttgaccttttcgctaagaattttgttggcacttatgatactactcaattcaatgccattccaatgatttatgttggaatgatgcctttagctttggctattctcttctttttcactaaaagtattcgtctcagaagtaaatttgcctttctaggaatcattgctttctttgttgcttcattttatcttcaagctttagatttactatggcaagggatgcattcaccaaatatgttcttgcaccgctatgctttcttatttagtttgtttcttgttttaatggctttggaaactctatctcgctgggaggaaataaagacttggcatattttgactattagtctttttctaattacaggttttcttgctactttaatttttggacactataaatatgtaatgacttctcaagttatgttgactttcttattcggtcttgcttatttaatcttgtctattaattctgttaggaaatggatttcagctcatctatttgttattatcctctttgttttcatgactgttgaatctggtgttaataccctttatcaggttcaaggaatacaaaaagagtggaattttgctagtcgtgattactataatacccaagtgaattctatagaaccgattgccaaaaaggtgaatgagcttactggttctggttttgccagaatggataacactgttcctgatacagcaaacgatggcatgaagtacaattttaatgcactttcccaattttcatctgttcgtaacagcaacgccagttcaatcatgcgtcaattaggatttcacactgacagtacttatttgaatttacgttatccggggaatacattactgatggattcgatttttggaattaaatataatataagccaagctcaacctccaaaatttggattttcaccagtttccaatgctctcagtaatttgagcaaaaactcaaatgcgatgggtcttggtgtcttcgttcccaatggatttgaagatgctaaattcactgataaagctcaagctagcagctttattaataatcaaacagctttagttaacgctttgacaaaatcgaaaactacattctttactccattttacacgaccagtgaagaaactgctgataaaatcacgggtgctggcaattctgttactctgactcggccaaaaacttctacagctactgatgtttcagttacctacggaattaccgtggcggcaaatagtcaaatttatttatctgttcccaatattacttatctaaatagtaatgctgagaatacattgattactatttctgatgtttccaatccaaaaatgacacgttctctcaatagttattacgttggtacaaacgatactggctccttcttgaatttaggaagtttcagtaaggaaactaagctaaaagtgaccttagcatttcctgaaaattcacaagttacttttgataccacttcattctggcgtctggacactacagcttaccaaaaagaaatggctcttctacaatctcgtagtcctaaaacagaaatgattaaaaacggggttcgcatgacttatacggaaaaagaaaagggcgatattttcttgacaattccttatgataaaggctggtcagcaaaagttgatggaaaaaaagtggctgtcagtaaagctcaatctggttttatgaaagttagcgttcctgctggcagtcatcgtcttgaactaaaattcttccctaatggactaaaagaaggaatcatttgctttattttaggaattctgttatttattggttacaactattttactaataaacctaaaaaatctggaggaacaaaaaatgaaagctaaatcaattatcccctttacgctcggaatcctagttgctgtcagcatccctgtttcctattctttaaagaccaaacattttgaagtcaatttcaaaaaaggtggcttgcttgacccagaattgtataaaaaataaggcagattgtctttaaaaaattctatcagtaaattctaaataaaaaaacgttgattattcaacgttttttatttttgtttttgtcaaaagtaaggaattcaaaataacagaaactgatgataaactcattgctgctgcagcgagcattggattgagtaatccaaaagctgcaagcggaatgccaatgacattataaacgaaagcccaaaaataattttgcttaattttggaaattgtttttttagctacttcaaagaaagtggaaattttatgaatctgaccgctagtaacagtcacatcaccagcttccatagctatatctgacccagttgccattgccagcccgacggttgctgacgctaaagcaatagcatcattgattccatcaccaaccatcattgaatttgagctattttgcacaatttctgctttttcttcaggtcttaaaccacttttaacttcatctaaatgaacaagtttttgaatttttgctgccgaattttgattatctcctgtcaacataacagtctttagaccacgtttttgcaaggtctgaattgtcttaagcgcatcatcctttagacttgaactaaaaacagccatcgctaataatttttccttatttgccaaataaatgaccgtatcatctgtttctgggactgacagatttaagtctgtcattaatttatcattgccagcaaaatattcctgaccattaattttagcagaaagtccacgacccgcaagttctgataaatctgtcagttcatataaatcaccttgaaatttaagagatttagccaaagggtgattagagtgagcttctagactagccaataatttaaactcatcacttgccattttttcttcaatagaattaaagctgtcagtaactttttcactttctgtcagtaatttaaaatctgtcagttcaaattcacctgttgtaatggtcccagttttatcaaaaaatactgttttaactaatccggcaagttccaaagcattggcatttttaatcaacaaaccatttttagcagccaaaccagtcccagaaataatggcagttggtgtagctaaaccaagcgcacaaggacaagcaatgaccaaaacagctactgaatgcatgattgctgtcagtaaaattccactgacagcccaagtcgcaatgaaagttatcagagcaataactaacacaactggcacaaaaatccctgaaatcttgtcagctaatttttgaatgtttggttttgagccttgtgcttcactcatcatttcaaccattcttgaaattgttgaatcatttaaatcatgaacaacaaccgctttaacttcaccatctaaattaattgttccttcaaaaatgacttcatcatccatttttacaacaggtaaggcttcacctgtcaaaatagattcatcaaaagatgctttgccagaaagaatcatcgcatccaaaggcactttctctcctggcaaaatgcgaatcacttgtcccatttgaacttcttcaatcgctaaatcagtcgattccgtatgaacaaaagttgctcgactagacattaatccagtaattgcttgcgttgttttctcttttgcattatgttctaaaagtttacccatgaccaccaaagtgataattaccatcgatgattcaaaattcaaagcattcgcttggctcataaaaacagccaaaatcaaactcgaaaagtatgcaaccgaagttcctaaagccactaaaacatccatatttgccgatttatttcgcaaagcatgataagccccaacataaaagcgccaaccaataatgaattgtactggagttgccaaaatcaattgtacgattggttcatgtaaaaacatgacccaatttgcatgtactccgaagatatcagcaaacattgcaactactaaaggtaaagtcaaaattaaagcaatccaaaaagacaaagccaaatttcttgctttttttgcagcttgacgtgcaattttttcctgatgagctttgtcattaacaatggctccataacccgctttttccactaagttaataatttcttggtcagaaatattatcgtcagcaacaattttggctttctcagtcgccaaatttaccgttgcttccataattttatctgactgattcaatgtttttgaaactgtatttacacaatttgcacaggtcattcctgtaattacaaatgattgactccgcatttttacctcttctatattttatctctaaatatagtttacaattgtaaacgaaaaaagtcaagaaaaaatcatcttcatttggggaatgaagatgacctgttattatttagtaaaacaatatttggggtttgctttaccaatttcattctagcaaatttaaattcaattcacaaacgaagtgttttttaaattactttataaccagcctctgcaacggcaacagccattttatccatatctgctggggcagaaaatttaactagtgcttctttttttttcaaagagactttcgctttttcaacaccatcaatagcttccaaagcatttgtcacatgcattacacagtggtcacaagtcattccctcaatttttaaagtttctttcattttatattctcctttttaagcagaaatctgctcatgttcatgtttacaagcacaaagtccacttgtttctaagcaattacaatgtttttgtcctaccacttctttggcattaagtgattcttgcaaaagttcaatatcctttgccgtcaaagtcgatttttcaatcatctcttgcaaaacattgacatgtttcgtttcacaaactttttggatcagaccatcggccattaaatttatagccgtacattcttccatcaatggacgataaacaaattttcttccttctttttcggtagaaagcatttctttttttaccagtcgaccaagtaaagtcttaacagtggccaatgaccattctaattcttgggggatttgcgcataaatttcatcaactcgcgcttctcctagagaccaaattacacgcataacgattaattcggcatttgatacattaaattctacttcgttcattttttctcctttctctattcattttcataagataagtttacacgtgtaaacactaaaagtcaagtattcaacctaaaaaataaaattcgaattttatcattcgaatttttaagtttaatcttaaccaaataattcttccataattttacgtccagtgggtgtttgggccaaaccaccctcagctgtttctctaaaagcagctggtagagaccgtcccacattatacatggtattgaccacctcatcaactggaatcactgttttaacccctgccaaagccatatcagctgaaatcattgcttgtgacgcccccattgcattacggtgaacacaagggatttcaaccaaaccagcaacagggtcacaaattaagcctaacatgttttgcaagacaatagcaatcgcatagcctgcttgttctgcagagccaccagcagctaaaacgagtgcagctgatgccattgccgaagcagaaccgacctctgcttggcaaccaccctctgctccagaaatcgttgcattatttgcaatcgcaagtccaaaggctcctgctacaaataaaaattccacttgctgttcatgactcaagtctaaagttttaatagccgaagttaaaacacctggcaaacagccggctgatccggcagttggtgtcgcacaaatgagccccatttgggcattcacttcattgacggcaaccgcatcacgagctgctcctaagatgagctcacccgaaagtgctttgcctgatttaatataatcatccatcaactttgcatcgccaccagtaagacctgtaagtgattttttaccagcaagcccctttttaacagaatcaagcatcgtttctaggttatgttccatcatttcccaaatttgttcacgatttcgtccagtttgttccatttcaatggcaatcattaattctgtgaccgaggaataatttttagaatcctcgattaattcttctatatttttaaacatatttattcctatactgcttttaattaaagaaattaacggcgtgcaaacgaggaataagtttcatttcctcaattacttccttaacatttggtgtatcaacttctaaaatcataatcgctttttcacccttagcttctctggttacattcatttgtgcgatattaatttgatgttctgaaaggacactagaaactctagcaatcatccctggaacgtcttcatgaatgaccacaaatgtcggaacaccagctgaaattgcgatatcaaagccattcaattccgttacttgaatcattccaccaccgattgaaattccagtcacggtcattgttcgatctccttttttggcgattaaacgtgcggtattgggatgttctgctttttcttctggatgtggaacataagaaatttccattccttgttcaaaagcaagctgaggcgccattggcagacgttcatcatctgtatccattcctaaaacacctgcaacaagagcaacatctgttccatgaccccgataggttttagcaaaagattcataaagatgaatctccaatttttctggaagttcaccgaaaatagaacgtacaattttaccaattcgagcagcaccagctgtgtgcgagcttgaaggtccaatcatcactggaccaatgatgtcaaagacacttttatatcttaaattatccatttaaacctcagttcttacaaagatagtttttaaactatcttttatcttcaaatatcataacataattttcaagctttttcaggcaaaaaaaatagctccgcagagctattttctattgacgtcctttgtaaattgaacgcgattgaccataccatattttggttagccatctttgaatccaaggttgaacccatttatctaaaccaaatgaacgacctgaaccattcataagtgcaattgccactggaataaaccaaatgttaacccagtagaacattcctgaaagtgagaacataacagtcaatgcggctgttgctgccgctgcaatccaagtgaacaatccaaaaataagggcaagtgcaaggaagatttcaacaattgacatgaatttttgcataaacaatgcgacttcacggtttggaatcataaacttaaagataggttccatccaatgtggcactttgtcaaaaacagtcattgggtcagaaccgtaagcgtacgagaggccccattcagttgctttatgagcagcttcaccaccaccacttgaagcggctgttgttgctgcgcctgtagcacctgcggctgcatcggctacactagaacttgatgaagcggctgttgaagcgcctgcggctgcgtcagctgcttttggtgcttcttgcaaccatgagaatgggaatttaaggtcatttgtaaaccaagaacctttaccaaaccaagtcgttgggttgaagtattgaccatcaccgacaattttcttaattgcttcggtaaaccaaaccacaccatagaaaatacgaagtggaacagcccaaagtacatttccttgacgtgaagtatgaccacgcataaagttacgattatcttttacgcggaagacttcatccaaggcataacgccagaaataatgtgctgaacgaatttgcaaagtatagataaagtaaacaatattcttcatcaacattgcccagaaaccagttagacgcatgctaccgattttggcaactccccaagttgaaccaattgaaaccattgttccttggtatttactttcatgtttatgtttgcttccgccattgatgtctgcaagaatatttgccgctgctgtgtgtgctgtttgttccgcagcttcaacgatttgtggtgttggacgaccagtatctggttcaatatatcctgaaacgtcaccagcaacataaatcccttttccttcaaaaccaacagcttccatgtattcatttgcttgaagacgatgtccacgttctgtttcattaaggtctgtttttgcagctgtatttccttgaacaccagttgtccaaattaatgtgtgagttggaagttctttggcaactttttcttcgtcacgcccaccaacattcactttgatatgatcttttgctacttcaacaataccatggtttgttaaaacatgaacatttttcttttcaagataagcatgagctttatctgcttgtttacggtctaaagtattaaggattgttggcatcatttcaacaacgttgattgtgatttcttcttcaggaatcttccaatctgttgaaacttttttacgccaatcaatcaattcacctgccatttcaatcccagtaaatcctgatccggcaactgaaattgttaaaagagcacggcgtttttcatcatcaacttctgttgatgcatattggacgattttttccaaatgacgtttgattcgcattgcatcttcaagtgaccaaagtgtaaacccgtgttctttaacaccaggaactccaaagtcatttggttcgccaccaagggcaacaatgacataatcatagctataacgaccatgttttgtgattacttgtttgttttctttgtcaagactgacgacagagtcagtgacaagactaacgtttttacgttttcctaaaagcttttggaaatcatattgtacagttgtgaatggaacacgtcctgctgcaacttcgtgaagttgagtcatggttgtgtggtaactatgtttgtcaatcagtgtgatgtcagcatctgctttgagctttttagaaagctcacgcgtcgcatgtactcctgcaacaccaccaccgatgactacgatttgtttcttagtcatttagaatggttctcctactagtaatataataataacgtcaggcactattatatcctttttagagcaatttgtaaactgttacacaagaaaaacttttccaaatttttttatggaaaagttttatatttatattttgttttaacttaaattgcacctttgtggaaaagttggtcattgatatatttgaagaaataatgaccagaacgaatttcaaaggtataaacaagataaaccatgtgtttcatgaatgttgctgaaaaaccacttaattttgtttttccaactgtcccaaccgcatagcctgaaccaatagaaaccagtgttccacgataatttccaacaaatttggttttttcgccacctttaatatctgcaatgatatttttagcggccgtgcttcctgtttgttctgctgcttctacaatttgaggagtagggcgaccattttcgggaacaatataacctgatacatctcctgcaacatagatgccatgattttcttcgccaatcgcttccatgtattcatttgcttgaagacgatgaccacgttctgtttcggaaagttgacaagcttctgcttctgtatttccttgtacccctgttgtccaaattaaggtatttcctggaatttctttaacaactttttcctcgtcacgtccaccaacattaacagtgatatgatcttgtgctacagctgtaattccatgatttacaagaacattgatgtttttattttgaaggtaaacgagtgctttatctgctaaactacggtctaaaatattcataattgttggcatcatttcaacaatattgattgtaaattcagattctggaatgccgtattttttagatgcttttttacgccaatcaatcaattctccggccatttcaattccagtgaatcctgaaccagccacgctaaaggttaacaattttttgcgtttttctgaatcagcttctttagctgctgcttgaaccatttctttcaaatgtgcttttattttcaaagcatcttcaagtgaccaaagtgtgaagccatattcgttaacacctggtacaccaaagtcattgggttctccacccattgaaacgactaaataatcatagtcatagctatttttatctgtaatcacctttttgttagctttatcaagttcaacaagtgactcttttaccactttaacgttattaaattttccaattgttcgattcaaatgatattgaacagcatctgcctcaacacgacttgctgcaacttcatgaagttgggtcattgaagtttgaaaatcatgtttatctataactgtaatttctgcatcatttttcaaattttttgcaagtaagcgtgtggctgaaactccagcaaatccagcacctacaataacgatttttttcttagccatttctcttggcctcctactaataataattccaaaaaatattatacctcttatcgaaataaatatacatttttctgtttataaatttactttctgtaatttttaaaataaaaaaccgcagtatacggcttttttaaataatttaataatttttcatgacttgcccttcagatacacctaaacatttcatgaaaggaagtatatagtcaatgtcttcaatatttttcttttgcatcagtgaaattcggctaatgccttgactaacttctactgtgactttatggtcgtcgttaataaaaaggtgaatactatcacatgctccttgatgaatactgacgcctaaaatttttcctttttgaacttcacaggtttgagcgccatggagatagctatctactactaatttcattacggttgtttcaattttaaaattctttggtttttgctgatcatcaatttttgaatcttgggcaaattccatgttgttatttttcatggtttagctcctttccatttcttaattctattttatcaagttttattatgaaaaaaaaatgatataaaaataaaatttatttaatacttttaagactataatactgcctttcttactagtttaaattttactgacggtcagcaaaaaagactgaccacatcagtctttttttattttgttgagaaaatcaatgactgcttggttgaatttctcaatttcttctaaatgtaagatatgcccacatccttcaaaaatttgaacttctgaatttggattgttttgtaattcacgcgctgcttgagcatgaattgctggaaaaatcggagatttctcgccggcaaaaaataaatgtggttttttttcttgcccaagctcaggacgccaatcttgcaaaataacattttgcagtaaaggacgatagcgtttgaaatcaaaaggtttcattccatgtcccagtgttcgttttacactatctgacaactttttttgtgtcaaacgagtttttggaaaatcatcaataaatactgacagctctgtcagtgttttcccatattgaccattgagccaatctgccgatttgaagaaagttggggcctgatcttctgtaattattgctgatacattttcgtcagtaaataattcttcataagccataattgttgccgcacccatcgaatggccaattaagacaacattttttaattgcaaatagtcaattaattcttttaggtccattgccaaacggtgtaaagtcaagccataatctacttgttgtgaatctccatgtgagcgatgatcataagtaatcacccgataaccagcatttacaaatgtttctatttgggcaaaccacgtaacttcactggacgaatagccaccaattagaatcagaggttgatttaactgaataccataatcatgaaaatttatttttactaaatcatttgttgtaaaaaaagacatttttgtttcctctcaagctttttccaatgttttcattgtaacaaaaattctgtcagcactgaccaattatgatttctagtaactgattattcttcagccagataaaaatactgacaataagaaaaaaatttctgtcagtaaaattttttaatgatgaatttaaaaactgacagcttagctatcagtttaatcacgagatatgagtaaatcataagttttctatcattatttcatttttatcactgattattctaatccaaatgatcaccatttgaagcaaaaacatttttaaaccaatgaaatgattttttaggaatacgtttatgactttttggatccacataaacagcaccgtaacgtttatcaatagcaccagacgacgcaggaatatcaatcaatccccaaccaagataacccataacttctaccccgtcagtaaatattgcctttttcatggcttcaagatgtttctgatgataagaaattctcaagtcatcagcaatttctgtttgcacatcccagatttctgactgaccaatgccattttcaataggaaaaacaggcaacccaaattcattatataatctacttataattcttctaaagccttctgggtcaatggaccaatcccattgattatgttcaagcaacggatttaatttcatccctttagtcaaataagaatttggtgcatcattttctgtcagctgacttgcatcaagtaaaattgagcgataataagaaaaagaaataaagtcagaaattccattttttaaaatttcttcatctcctttttgaaaatccatttggatgttctgatttttaacataggtcataacctcatgcgaataatgaccaaaagcataaacatcacagagatttcgattataaaattcatcaaattttctaagatataaattatcttttggtgaaaaagttgcgggatatatttccgtagtcgccaacattcctcctatttttgcttcaaaattttcatgcaaaaattgggttaattcgcaatgagcaagcatggtatgatgaaaaacagtatacatatcagagagtgtcagctcttttttcaaaactcccgaataatgctcgaaaccgtcagcaaaataaagattatgctcattaaaaacaatccaatatttgactttgtcagcaaatcttttcatcatttcttgtccaaatcttacaaatgcttctttcacttttcgactcaaaaatccattgtacttttcagccagatttaatggcatatcgaaatgatagagacatatcataggctcaattccacgagccagcaaatcatcaatcagatgattataaaaagcaattccttcctcattaaattcaccatcgccgtcaggaacaattcgtgaccaagaaatttggaaacgatacatattcatattcatttctttcataagatctagatcttgtgaataatgatgataattatcatttgttacttgccaatctttggcagaacgtccagcggtattcacatcatagacagagggcccttttcctccttcattccaggcgccttcggtttgcattgacgaagttgaattcccccagaaaaaatcttttggcattttattttccattttgtccccttttatctttaattttataaaaagaaatcccgaagaaaaagtttctccggagtttctaatctccttattcaattactaagcaataacttcttcagcttcagcatttgcttcttgttctaacaacattttgtcatattttttagcaaatggaagataaatcaaaattgattctaaaagcgcaataacttgcagcacagcatattgccaacctccgattaaaaagccagaaataattggtggagtggtccaaggcgcggcaacaccattcattggcggaacaatgtgaaaataaatcgctccgtaaaccgtagccgaaacgactactggaacaagaaagaatggcagagcaagaactggatttaaaacaagtggcaatccaaataagaaaggttcattgatattaaataaacctgggactaactctactttaccaattgacttcatctgttctgaacgagcaaagaaaatcgtaaagataattaatccaaaagtaattcctgaacccgaaagattaataaagttattatagaattcattggtcacaatatgagcaccattagctaaactcaatttgtgagattgataaagggatgcattggcaaaggtatttggaatcagaaaggcagaggtaattgctcccatgataattccaccatgaaccccaaagaaccagaagaatggaactaagagtgagataataataattccaccaaatgaaccgcctaaaccttgtagagggacagataaccaatgataaataaaggttactgcatcggtatgaccaatcttatcaaataaagcatagacaaccgtagcagcgacgacaattactcctgttggaatcattgaagtgaattgattagcaacatttgatgggacttgttcaggaagtgtaatcttccagcctgctttcatcattgctgaataagcccagcctgatagaataccaataataatggccgcaatcattccttgaccaccgttccaagttaaattgagcactcctgtcactggattatttagaaatacttgcatggcatgaggaagcttttcaaaagcagccgttgcttgtgttcctgtgagattcccaatgcctgaggcttctttcccagtagctagtgccgctgtgattggatttgcaatacttagagattgaacaatgaaaaatgcagagagagaagttaatcctccttgtaaagcaacatcaccaaatccagcttctttgacataagaatagccaataccgactgctgcccaaatcgctaaaataccgaatgatacgttaaatgcttgggtaaaaattgctgaccagccattgtctgataaccattttgccacaggtggaattggaatattcgccagaatcaagaaaattgacccaacaatgataaatggcatggcaaaaagcattccatttttcaaagcagtcatcgctcgtgtattcacgaatttcataattggcggtaagactttattatttatgaagccattcataaataaacctcctttaagatgtgagcccgactgttctgaaatgaagaaaattatcttttgtgctggcgttttgccccaccaacaagtgctttagcacttagctggaatgctcaacgtattttatctatctacgcagcaagctgctacgctgtccattcgctctaagcgactaaagtcgcaaggcgaatcgcattttcacttatctcaagaaggtcgaactcaatttgttaagacagttcagatactttgaagactgtactcttttaattgaaccgcttacaatataataataccccttacaattttttttgcaaggggcttttctatctttgttacctgttacaggattagttacatttatcagctttttccattgcctgatgagctagtatttcaataaaagcaatgactgggagctgagaagtcaaattttcaagtgggtcataggcggaatattccgtttggaatccataggttaaatttatatttgaaagtttggataaggtcgtttctggatgatttgtaattgaaataatctttgctggtgcttcctctcttagtttgacaactcgttcaataatcttgtctgtttcgcccgaagcggataagacaatgcttaaaacatctggtgcacctttgcctttaacggcttgataaggatcagaaatggcataagattctaaaccaatatttgtaaaatagcgggcaccatattcagctaaagctcctgaagaacctactccaataaaaataatataacgagcttctcgaattagtttgacagcttcttctaattttcttcccgcttccttagaggttatttttcgtaaaaataggtcgagttgtaataaattttcatagtaattaactggaatttctgtcagttgattttggtttttaagataatattttagttctacccagccctcaaatccaagttttctggtcatgcgcataactgttgctgtggaaacatggacagcttgtgcaagctgtctgactgacattttatcaatacttgataaattagataagataaaattaaatgtcgcagtttctagttcattgagcgttcgaacttgttcgggcaagaaatcaatcatttttactgacccaacctttcttatgttgttgattatttatttgttatcctgagcgagcttcatcagtatcgacttttatttaataaataaattactgacagaatttttaagccgtactccgatttagtgacagataaattgttccttttattcacattttactgacagaattttgagggtcaactctaaactcttctgtgacttccccaaaaaaataagctagtcgacaaattgtcaaccagcttattttactttttattctttagctctcactttttactgacagctaattattataagatttaactgataaatgttcagattgtcatctttattttacaacaatattaactaatttatttggaacagcaattactttgaccacgtttttaccttcaagagcctcagcaactgattcacgaccaattttttcaagttcttcacgcgctaaatctttagcaattttaatttttgcttttaatttaccattaatttgaacaacaatttcaacttctgattcaattaatttgctttcatcaaatgttggccaagcaacataagaaattccagcttcattacctaattttacccaaagttcttcagcaatatgtggagcaaatggcgccaaaagttggacaaagccattagcgtattctaacggtaaagcttttgctttattaactgcattaacaaaaatcattaattgggaaattgcagtgttaaagtacatcaagtccaaacgctcagtaacatttttcactgtttcattgtaaactttgtccaattctccattattttcagctttaatctctgaattttcaatcattcgaacagctcggtctaggaatttacgagccccttcaaggccttcttctgaccatggaatacttgcatcaagtggacccatgaacatttcataaacacgtaaagtatcagctccataatgttcaacaacatcatcaggattaacaacatttttaagagatttagacattttagctggagcttgttcaagggcttcacctgtttccatatggtaaaagccaccatcacgtttttcaaccttatcagttgcaactaaggccccacgatgatcacgataagaggttccgagaatcattccttggttaaagagtttttggaaaggttctttagttggaacaactcctaaatcataaagcactttatgccagaaacgagcgtaaagtaagtgaagaacagcatgttcagcccctcccacatagatatcaactggcaaccattctttgagaagttctgggtctgccaaagcttcgctattatttgggtcaatatagcgaaggtaataccaacttgaacctgcccattgtggcattgtattagtttcacggcgaccttttaggccatctgcgcgtgtgacttccaaccaatctgtcaagttagccaaaggagactcacctgttcctgacggtttgatatcagaggttactggtaaaacaagagggagttcatcttctgagagcgctgttgatgtgccatcttcccaatgaataattggaattggttcaccccaataacgttgacgactaaagagccagtcacgcaagcggtaagtgattttctttttcccaattttcttttcttctaaaaatgcaatggctttttcaatcgcttgcgctttatcaagcccattgagaaattcagaattaatatgaggaccatcttctgtataaacagcttcttctacatttccaccttcaacaacaggcaaaatttcaagtccatagaccttagcaaattcccagtcacgttcgtcgtgagcaggaactgccataacagcaccatgtccataagaagcaagaacataatctgcaacccaaattggcattttacggccattaattgggttaatcgcgtaagctccggtaaatgctccagttttttctttagaaaggtctgtacgggctaaatcagatttcaagctcgctttacgacggtattcagcaacagcttctttttgctcagctgtcgtaatagcatcaactaaatcatgttcaggtgcaagcacagcataagttgccccaaaaagggtatcaggacgagtcgtaaagacttcaaatgatttgtcggttcctgcaacttcaaaagtcacatctgctcctactgatttccctatccaattccgttgcatttctttgattgattcaggccaatcaacttcttcaaggtcttcaagtaaacgttccgcataagctgtaattttaagcatccattggcgcattggtttacgaacaacaggataacccccgcgttcagaagttccgtctggaagcacttcttcattagcaatagccgttccgagttcttcaacccagttaacagctacttctgcttcataagctaaccctttttcataaagtttagtaaaaatccactgtgtccatttataaaaattagggtcagttgtattaacttcacgttcccagtcataactaaaacctaagctattgatttgacgtttaaagttagcaatattttcagctgtaaattctgctgggtcatttcctgtatccattgcatattgttcagcaggtaaaccaaaggcatcccagcccattggatgaagaacattgaacccttgagcgcgtttgtaacggctcaaaatatcagttgcagtataaccttcggggtgtccaacgtgaagtcctgcaccagatggataagggaacatgtctagagcataaaattttggtttatttttatctgttcctgtacggaaagttttgttatccgcccagtatttttgccatttggcttctatttcttgatgattgtattccatattaaagatttgagttcaattttattaaactcagttcctttctcataatattgctaatgtaaattgtcttttataataaattataagcgagagttaggtcacttcccgaaagctgtaagccatatttttgctcatattttttgattttattaatcagcgtatttcgatgaacataaagtatttttgctgctttcgtttgattgctacttgctttatacattgcttcaactagtttttggtcttcaggattttctaataattctttacggatttcttgtaaaattctattttctgatagatttagactttctgataaaatgtattcactaaaagtttgctgactttcaaaaattttgtattcttcagaatatacttcagagagtttatttttctcgacaaaacggccaacataagccgtcacctcttcacccatatcttgcgaaagggtttgaaaaatatcaaaaagttctgagtttgtgggactatcagttgaaaatgcttctatcacaattttttcttccccaatgctttttacaaaatcaggtaaaagtagctttaaagtattttccaattcttcaaaattatttcctgaaaattgtaaaatacgatagcggccattaggaagtttatcagtcttcaattttctgtcagtaaaaatcaattctgtcagtaacttttctcgctctgtcagttgactggggtcaactttctcgtaaagttttctaattttttctagttccattttttaaaaaagcgacctctggtcgcttgaagtcttatcctaaatccactttgaattccaacaattactagtttagatttgttctgaaggaagatgtaattcaaagagtggtgacaatggacggcgttcgtgaatacgaataatcgcatcagcaagcaagtgagcaattgaaagttgaacaattttttcactttgacgatcttctggcatttcaatagtatccaaaacaacgagtttagtaattgctgaattattaattctctcgatagctggtcctgaaagtacggcatgagtacatgaagcgtagacttcagttgcaccaagttctttaagggcattggccgctaaagtaattgttccggccgtatcaatcatgtcatcaatcaagatacattttttcccttgaacatcaccgatgatattcataatttctgccacattggcacgaggacgacgtttatcaatgatagcaagtggtgctttcaagaagtttgctaacttgcgcgcacgtcctactccaccatggtcaggcgaaacgacaacgatatcatcaccagcagaaaccaattgacgacggaaatattcagcaatcaatggtgaacccataaggtggtcaactggaatgttgaagaatccttgaatttgtggtgcatgaaggtcgaaagtaattaaacggtcggcaccagcaatttgaagcatgtttgctacgagttttgatgtgattggttcacgagcacgagctttacggtcttgacgagcataaccatagtaaggtaagacaatgttaattgatgcagcagaggcacgacgcaatgcatccatcataatcaagagttccatcaagttatcattgacagggtcacttgttgattgaaggataaacacatgatcaccacgaactgattcgtcaatatgaacgacagtttcgccatccgaatgtgcaccaacacttacttttccaagctcaattccaatttctttagccactttttgggctaattcgtggttagaagagagcgaaaacaacttcaaatttgaatacgacatgaagagcctttctttaattcctacagaacatagcagttctattttatgtaattctattttacattaaattctcaattttttcaaacgctcatcggctttattttaatggaaccgttgacaagtaaaaaagcattgcccaaactgaacaaaacttttttacttcttattttatattttataaaagctctttgaaaagccctctgacgaaaaattcttcatcaaaatcttgtaaatcattaagcttttcgcctaaaccaatcaatttaactggaattttaagactttgaacgattgacaagacaatcccaccttttgccgaaccatcaagtttagtcagagcaattcctgtaattggagtaactgctgaaaattctttggcttgttgaatggcattttggcctgttgttgcatcaagtgccaaaatcgtttcatgcggagcatctggaatttctcgtttaatcactttaccaattttttccagctctttcatcaaattatctttattttgcaaacgtcctgcagtatccacaagtaaaatatcataattttcagctttagcttttgcgagagcgtcaaaaacgactgccgctggatctgaaccagctggttttgtgactacttcaacgcctgaacgatttccccattcaactaattggtcaatagcacctgcccggaaagtatccgcagctgctaagagtacttttttgccttcatttttataacgagcagctaatttaccaatggtcgttgtttttccaacaccatttaccccaacaaaaaggaaaacacttaatccatccgtttggatatccaattttgtcggtaatttttcaccgtcaaacttatcaacaattttttcaataatcaattgacgcaagtcatctgttgatttagcattaactaattttgcttccttgcgcaattcttcagtcacttccattgccaaatccacaccgacatctgacataattaaagtttcttcaagttcttcaaagaattcttcatcaactgtccggaagttagcaaaaagttcattaaagccgtcagaaaaagtcttacgagttaaagttaatgactgttcatattttttctcagtttcctcacgtgattgagtgaaaatattagccagagcatcaatatcaatgacaatctcttcttcctcatcttcgtcagtaacttttttctcagtcacttctgtagtttcagagattactttttcgtcagtaattttttctaatttttcatcattttctggtttaacaattttttcgtcagtaacttctacttcaaccttttcagaaataataggttcattttcactgacaggttcatccgtaatttctggctcaacatcaatcattttactgacagactcgtcagtaactttttctacttttgctggctcttcatttacctcaggccgtttagtagtttcattttctttttcatttttgactgcttcagtgatttcactagatagcttttcactgacaggcacatcatgattagtttcctcttgtttcttctttccgaagagtcggtcaaaaagtcccattttttctccttaataaaatatcacattttgatgataaagttcattcataaaatgaatgaaagattttaatttaatttttttcttaaaaatgcaagccctaaaacaaggactccaacggctgaaaaatcgattacctttgaaagcaaaacgaaagccgtggtctctacaaaaaaggctaataaaatgactgacaaagcatgaaaaataaaaaccaagcccataaaaagagtcattattaccatttttctatgattttcaccctcgctagcaagctctaaaagcggtcgatttagaaggactgacagtaaaaaaatcgttccaatagcagccgttaaaatcgggtgccagagcttgaaagcaagattatttccatgcgtcaaataaacagctaagagtgaaattaaaaaaccaataattgccactaaagaaacaggatttaactctttttttctaattaaagaccagagcatatgaacaactggaaaggctgttgcaattcctaaagctaaagtgtccgaattcccaagcatttttaaaaacaaataggcaataactggtaaaataatcgcaaaaattaaactcggcaaatacttttttagttgaacttcatctttcattattagtccttagagtacatatttttcaataatatgagcaacagcatgttggtcattagttaaatcagaaataattcttgcttcttctttaacagctgggacagcattcgccatagcaacaccatatcctgcccaagaaatcattgataaatcgtttgcttcatctcccatggccattacattttctggttttaagtttaactgattaatcaattgtgtcaaaccataagctttattaattccttttggcataaattctaaaagcttcgcttgagttttaaaaatctcaaattggtcaaaataagattcaggaattttatcgagactagcgtccaacaattctttttctgtacaagaaacaatcttattataaaccacatcaagtggaacttgatcaaaatcaactttgataaaagttaaaagcttatttaaagtgtcatattgcgagtcaattttactttttgtcatataaactttttcttcgctcaaaacatcgcaaggaatgccaagatttgaagtcaattctttaatttctaaaatttcatcatgtgaaaaactttttttagataagatttgacccgtatttctttggaccagaccaccattaaaggtaattgaaaaatcttcaaaatcaagcatttctaacgttttgagaaagggttgaattgcaatcaaaggacgccccgttgttaaaacaacatggacccctttttgtcttgctgcattaatagccagacgattttcttttgaaatttcttttgaagaattgagtaaggtcccatccaaatctagggcaatgagtttaatttctttattcattgtttaattatagcacactgtatcagtcaggttcaataatgctcactaaggtcggattgagaattaaacatttactaatatttttagattattcataaaaatatttgacaaatctaaatcttttgattacacttagaataattaaaaaaacgaggtccaataaatgacttatttacaagcttctcttaacttgttgttgaaggagggctcacactagctaatttaagctaaatgtgtgagtcctctttgacgttagtcattaacgaggacgaagagacgtcctcaggacgtctttttttaatgttttattatcaatttaatagtcaataaaagagagacgtctctgtttattgatttagaaagctaggaattatcgttggaaactaatcaatccttaaagaaaaaaatggccgcacgccatattactatgattgctcttggtggagcaattggtgctggtcttttcaaaggaagctcatcagccattgctgccgctggtccctctgtcttaatcgcttattttatcggaggaatcgttctttattttgtaatgaagagtttagaaaagcttgttctaagttcaaaagatccacacggcttgtctggacttgttcagccttatctgggcaatcatacggctgattttactgactgggtttattggtcaatgtggatgattaatatcattgctgaggctgttgctgctgcaagttttttgcaactctggtttgctaatgttcccacttgggtttttgtcttgattattgcccttttaacttcccttattaacttattctcagttgctctctttgctgagacagaatactggttggcatttattaaaattagtgttgttattttgttgattatttttggtgtttttcttgtggcaaaacaaatttttgatactaatctagtgactactttctctggaatgaccgctcatggtggctttgctcctcatggctttaaaggagtcattaattctttattaattgttatctattcgtatggtggttctgaattaattgcaattacagttagtgaaacagaagatcctaaaagagccattcctaaagccatccgcggtgtaatcggtcgaattatttcattttatattattccgatgttcttacttcttgtgatttataattggcaaacattggctacttcttcaatgagcccttttgtgatggtctttaataaaatgcatattccttttgctggcgatattgtcaacttgattatcattcttgccctcttctcatcaattaattctggaatctatgcttcatctcgccttttgtatttccgtttaaaaaatcgtcaaggtaaaatggcacaaagtatggctcatttaaataaacatcatgttcctcaaagagcagtaattttctgttcaggtacactctatatcggtgttgttctttcttattttgtcggtgatcgtttgtttaattacttggctggttccctttcttacactgttttagccgtttggattttaattagtctcgctggttttggtctctctcttaaaacaaaatcattatccagtagaacaatgagtctcttagcactgattgctctctttctcattctgattggtattttatttactaatccaatcggcgtgactgtcttcacagcaattctttatttcatcatctttatcagttatcgaaaaaagaatgattctgtcagtaatttaaactaataaaaaagacttgataattaatcaagtctttttgtttttactgacagaattatctgtcagtatttttttgctcaaaagatttttgaacaaaataaccagaaagccaaattgcaaatagaatccctaacattcctaaaagcatggcggcaacttcggccattagtaattttgaattaaaaatatccgctaagcgatagtttaaacgtacaaaccagagaattagaccgacagttgctcccaaaactccaaaaaagagggtattgacagccgttcccaaaatttgttgagatataatttctctttgatttttaaattggtcaagactcatgttttcgtcctgctcaacaacttccgaaaggctagctgctaaagccatcgctgattctgctaccgctccaagcatggaaataaccatgaccacaatggctacatttgaaaaattaagtcccacatttaatgacagattttccaattcatcaacatcttctgtagcaaatccctgaaattgaccaaaatgttgaatgattaaagcaagaatgagcaaagataaaacaacaatgatactcgttttaaaagcaatcaatgtgacttcactttcatcagcagacataaagatagcaattgccaaaataattactgacagaactatcagaactgctattgcattaaatccccaagaaattaaagtaattaacacaaaaatagcaataaaattaaaggtcaaaccaattaaatttcgtaagccatcttttttggcaacgataagcatcaatacaatcagtaaaattaataggatcaagagtgcattcataaagaactctcctttccttgatgatttctagtcaaagcaaaacttgtgaaaacagcggtaattggcacagctaacacgattccaatggccgaaataattgtttgtaataacccaagattaagaccaaccgttgcaatataagaccaagagtttccatttctcaataataaaagcgtcatcggcaaagtttccgccatgaaaatcatgaacaaaacatttgtcaaagttccaatgagctcttgcccaattgaaattcccgatttaatgtaatcttttctgaccatatttattttgttcaatttattttgtctagccataccaaaaaggcctgcaacaatatcacctgtaccatccatgattgcccctaaaactgaaatcattgtcccaacaaagaaaaactctgatggattttgggtgacatagtccaaatattcaaaatgaatacccgaattccctgtcatttttagaacgaataaaacaattgaaaaagttaaagcagtggttaatacggtagttataaaagtatagagcatctgttttgtcggtcccaagacaaataaaagggaggaagctgcaaaaattactgacagaatcccgaatagcaaaatgacaggcggattaaattcaacgttaagggcgatgacaatcacaaagtaaagaaggtttaagaccagagataagaaaagaaaaattgaagccctaaatcgttcaaaactaatgacaaaaccaataaataaaacgagtagtccaacaattagtgcatccctttttaaggtcacaatttgataatttcccgatattttctttaagattacttgctgaccaacacgataaatttgtcctgttgtttgagagagagttgttgtattttttaaatttaaattgccaggctctgctccttttgcattgaggacttttattgacaattcttgcgtgacttgacggtctttattttgaaaatcatcactcacttcgtgactacttaccgttttggcaaccgtaattttgccaactggcgcctcgtacaaaaattggtcatgactcacaagaaaaaatgcaacaatagcaaagattatgggaagtagcattttcttgaatatccattttatattcataactttccttttttcatcgactaaaacaatgaattttagtcctatttttttatgacaaatcaaaagacgacaaaactgccgtcttttttattaggcttttaaatcactgactttatcagaatgttctatcgtatcatgcaaagttgctaaagcttctttagactttccaaaagtgaagaattgataacgtttgccagcataagaaaatccaaaaccaaatttagttgtttttacggctgtgatatatttcaattcaattgttttcattcgcactcgggggaaagttgtaaagtgaagctcgtcatcagctatgaagaaacggtgtggccaaatcaaagtgataaagataatatatgaaacaatcgccaaaatagtcaaaaaccagttgccttctttattaaattcataaaaaagtgttcgctcaaagcttaaaatgatgatgccccagagcaaaactaatcgatgattaagtgacactggcagaaaatatcctgttttcattggttcctctcttaatataaagtgctgaccagcctcaaaattagattaactcattttgaagctttctgtcagtaacttatcttatttttattaatctttcacctttggtgaatcttgtcctttttcaacttctggaatttcaaccgaataatctggtaaagttgattttccttgattttgactaagtaaactatttgatctagctgctaaatcttcattttctttcttcaatttcttctcggttgccttgaccgtatagttgtaatctttagggtcaacagctttaaagccttctggcgtatagaacctgaggagattttgattatttaatttatcagatgctttcaagagttccgaaactttttgtttggtttctttaacatattgttcttgctgagcattaagtttttcaatctgcaagccagtttgagtatcataatagcttccattcaaacttggttgagtaatggttggagtaacaaatccaccatttcttagagcaacaaaatcttgacgaccagaagcaaacatatcttgaccaaactgtacatattttttcgtatcaatcccaagtaaatgctcaagcgttggcataacatcaagttgaccaacataagtattgatgatatgaccatttgtttgtccaggaatatctaccataaacggtgttctttgtaacattgtactatcgtaactattgaaagtatcagcattatagccaacataaggcgcaaatgccttattatcactaccagaaattccgtagtggtcaccatataacacaataattgatttatcgtataagccagatttcttcaaataatcataaaattgttgaactgcttggtctaagtaatgagccgtttcaaagtaaccgtcaactaatttattccctgaatcaacagttgcaaagttcggatctttgtcttcatcatccattgtatatgttaagtgatttgtaactgtcaaatacttaacatagaaaggttgttgcatttgttcaagcaatggtacagaatcacggaagagtaatttatctttaattccccaaggactcatatttgatgcggaattatcaaagaaactttggtcaaagaagttttgataacccatttgtttgtatgtattcaatcgattatagaaagcaccaacgttcccatgaaccacagctgaactataaccatcggtttgattcaagatagctggcattgcttggaaagtttgggttgaaccatatttggcaaaaagtgagccagctggtaaaccaaatgttgatgtttccagtagattttcggcatcagaagtttttccttgtccaacctgattgaagaaattactgaatgaataagtcgaatttgaatgatagattgaatttaggaaaggcgtaacaacgtgttcttttccatctgttcctttaattttcaaatcaatcaatgcttgttggaaagattccaagtgaatctcaataacattgcggtttttagcaattccatacattttcaagttcggtgctaaataacgatttgaagcaatgtatttttgaatttcttgcaagctttctttgctggcatctttccgttgcgtatttgctaaattcgtataataaccgtctgttaacatccatgggcctaagccaagatatcgaacaatataagttttatctgattgggccttacgcaaaatcaattggtgtttattaaaatctccaaaccagaaattcaaaccaaacaaagccaagcccattgaaagataagtaaatgctcttttcgcaccaaccggtcgttggtcgaatttcatttttttagcaatcaataaaacaataatgactacaaggtcaatccaataaacccagtccatcaaatgaacaggcaccgagccaaaatcaaaaccatgttggaacattccggccccaccagtcatcgtatcaatcgtgatgaaatcggtgaattctcgataatagagaatattaagatagagcaaaaagtttgcagctatcgttaagaccagtgtcgctaaatagaaaagcgaagttcttctaataaagagtaaaacagcaaaacaaatagctgtaaaaccaattgggttaataatcatcagcaataattctgctggaccaactccgcgaagattaaaaactccgaagtaggcaatcatcgattttacccatacaaaaaatacaataaaactaagcaaaccaacacgtgtgttgaaagcagatagtaattttttcaatttattatccccagaaaatatactcattcttccttaatttaaagaaaaactgcagtcaattcattaatataaaacttattaatgaatacgaaaaacgccaatttcattatttttttaattaataaaattttttaaattcatgtttttgttgcttaaattatacgactttccttatttttaggcaaatcatataccaagccataaattaggcagtccttcaaaaatcaatttatagtgtagcattaatagattaaaactatcttaaatttcaattaatagccgaatcaagtttaactgaaatcatcttagaaaccccagcatcagccattgtaacaccatacattgaacctgctgccgccatagttccacgacggtgtgttacaacaataaattgattactattatcaaagtgattcatgtaatcaccaaaacgcttaacattggcttcatcaagtgccgcttcaacctcatcaagaaccacgaaaggtactgttcgtactcttaagattgcaaaaattaaagctaaagctgtcagcgctttttctccaccactcatcaaatttaaacttgataattttttacctggcggttgtactttaatttcaaccccagcttctaaaaggttgtcgcttgttaattctaaatcagcaagcccaccaacaaacatttgagcaaaggtcgttttgaaactttcacgaatcgcatcaaaacttgttttaaacctaattttaacttcatcattcatgtcatcgattgtactcaataaaagatttttagcttctaataaatcatctttttgacttgaaaggaaagtaaagcgttcattgacttcatcaaattgagcaatggcatccaagttaattggtcctaatgccttgatttgacgttctagatttttgagtttttgctcagcctccgctaaatcatccactatttttgcagtggcttgcgcctcttcaaaactgatttgatgttcactattcaacgtttcttgaagtgtcatcaattgtccttcgatttgttccaattgcatttcataacgcatttttttcgtgttaagttcttgtgtttgctggataaaatcttgattgtgatgttctaaatcttccatttgagctgctaaatcttcacgttcaaattttaaactaaccattcggacattaatttgactcaagcgttcttctacttctgtcagttgttttgagaaattatttctttctgtttcatcaaattggacagggtttaaaagtgctgtcagttgatttttttcttctgtcaaggctgacaagtctgtcagtaaacgtttttcatctgctttggtgaatttcaattcactggccacttctgattgacgaagttgagcctgatttaaagcacttgttttctctgattgcaaggctttatgcgcttgactattcgttttaacttcttcaagttgcttttcaatttcagcttttcgctctgtaatttttgcaagaacttctactttatgttcattttctttagttaattcaagcaaattacctgttgcttcttgatttgctgacagattagttaattgttctagcgcaactttttgttctgttaattgttcaattttcaaattcaaagattgttcaacaaaacgtttttcttccccttgagttttcaaaagttcaatttcttttagcaattcttgacgagcactttgggctttttgaacttctttttctgaaatttttaactgctcttctgataacttaatttgtttttctaaattacttatttcaacagaagtaaaagttgttgaattacgtttcccagctcctcctgcataagaaccgccagggttaatctgtgttccgtcaagcgtaacaatccgaacattataattcattgctcgagcgatagcagttgcattttctccagaatcaacaatcaccgttgttcctaaaagtgagctcatcgccttatgcaaccgactttcgaagcttacaagattgattgctaaatcaacaaatcctgtcatattttgaatacgatttaaaccattaaagtctcgtcctttaatcgttgtcaacggtagaaaagtcgcccgtcctaatcttttttcacgtagaaaagcaattgctcttttagccgcattttcgtcttctgtgactacattttggctcccgccacctagagcaatatcaatggctgttgtatatttagggtcgaaggtcaataaatcagaaacaaccccaatcacgccaccaatttgcgaagcattttgcatcacggcacggacaccagcaaataaattactatgactctcacggatattttgcaaagaagtcaaacgggccttatgttggttaagttcttgcagataatcatacattttattttgggctaaacgttctaattctgcctgttttttctctgcttgatttccttcttcaaatttcgctaaaagggtctcgatttcttttttaacagtatttaaattttcctgagcttcagataaatcttgactgattttttcaaatttagtcaaattttctctgacagactcatcctgttcagattgtctacggctcaaatctgtaatttcagctttatttctaacgatttcatttgagatttgggcttcttcttcaactaattgaacaaattcatcacgtaaccgttccatgaccacttctggtgattcagataaggtcgctaaatctgctgacagctctgtcagtaatttatctaagtcatttttttctgtcagtaaaagttctgatttattttgaacttctgccaaattttgttgagtgatttctaaacgactttttaagttttctaaacgctcttcgcgttccgcagctgatttttctgatgaatctttttgaacatcaaataattcaatttttcttgttaaatctgattttagattagaaaaattaagttggtcagcttgcaatttttcttgctcggcttctactttttgacgttctgtacgtaattgactgacttgctcatcgtaaacttttttacgagttgataaactcgctaattcctgtgccacttgcgccaaatcaagttctgtttgatcatatttggcttttttagattccaactgaccaaccagtacagaaagtgacaagtctgaacgttctgcttctagttcttgaaaacggagtgcagtatctctttgcgattgtaagggcacgagctgactatttaattcaaaaatgatatcttctaaacggtcaagattatcttgggttgaatttaattttgattcagtttcatttcgtcgatttttgtattttaaaacacctgccgcttcttcaaaaatggcacgtctttcttccggtttagaattaaaaacagattcaattcgtccttgggaaataatcgataaagagtcacgaccaagcccagtatctgtaaataaatcatgaatatcacgcaaacgacatttacgaccattcatcaaaaattcggaatcgccatttcgatataaacgtctggtaataacaacttcttcattctcatcttgtccttgcaggtaatgatcagagttgtcaaaatgagcaataacctcagcataattaagagcacgtcttttttcagttccagcaaaaataacatcgggcatttttccaccacgaagtgctttagccgattgctcgcccaaaacccagcgcaatgcttcaacaatatttgatttcccagaaccatttggaccgacaactgcggttatccctttatcaaattcaactttagtcttatcggcaaaagatttgaagccgacaatttccatttttttaagatacatggttttgcccttttattgcattttctgctgctttttgttctgcaacttttttagattttccaagccctcgcccgagttctttaccattgttaaaaaccgcggccacaaaagaacggtcatgagctggcccttcttctttcagaatcttgtagctaatcgttgtttctccaccaatttgtaacacttcttgaagttctgttttatagtcaatcactttaacatagtcatcatttttaacgtgaggaataactacatgttggataaatttacgaacttcatccattccttggtcaataaaaagcgcacctaaaaaagcctcaaaaaggttctctagtgttgtttcgcggtcacgaccgcccattttttcttcaccatgacctaatcgcaagaactcaccaaaaccgcatgagcgtgaaaaattagcaagtgattctgtccgaacaatgctcgagcgcattttggaaagttctccctctaatttctcaggatatgtccgataaagataatcagaaataaccaaagatagggcaacgtctcccaaaaattccaaacgttcattgtttgcaatctttgggagccgttcttcatttgtaaatgaagagtgtgtaaaagctgtttttaataaatcttcatcattgaagactaatccgtaatcattttttaattttttttgaagcttgagcataaaaatctccttcacttaaaacttctcttaatttttagttttatcccttattataccaaaaaaaaccttttttgtatgcctttccctgtggaacgggacttttgcgccataaaaaagagaaaaaacattaaatctgggctattcccccttaattaacgttttttctctcttttatattttaggaataaataaattccctaaagtagccgccatgactgcttttatagtatgcattcgattttcagcttgttcgaaaacgaccgaattctttgaattaaaaacttcatcagtaacctctaattcattaaggttataattttccttaatttctttcatcacttccgtgtttaaatcatgaaaactgggtaaacaatgcataaaaataaagtttttattaataattttttcaacaactttttgattgatttgataggatttcaataatttaattcgcttggctgtttgagcttcctcacccatactgacccaaacatcagtataaacaatatcagcattttcaaggccatttaaatctgttcggatacttattttactgcgacttttcatggcatatttacgtgccagtttttgtatttctaaagcgggttgcaaggactcgggcgaaataattgtgatatttacgcctaaaattgctccagtcaccaatagagaatttgccacattatttcgtccatcaccaacataagcgagggttaaatcttgtaaatggccaaaatgctccttgattgtcataaaatctgccagcatctgtgtcggatgccaatcatcagtcaatccattccaaacgggtctacctgaatccttggcgagaatttccacatcactttgcttaaacccacgaaactcaatgccatcaaacattgaacccaaaactttcgccgtatctgaaatagattcttttttgcccaactgaatatcatttggccctaaaaattcaggatgtgctcccaaatctacagcagctgttgtaaaagctgctcttgttcttgtagaggttttttcaaaaataagggcaatatttttatctaataaatatttatgttgaatatgttctttttttaactttttaagatgaattgcaaaatcaatcagatataacaattcatctttactaaaatctatttcttttaaaaaacttcttccttgaaacattctctctcctcttatttgcttaaattatcaatgatttatcattgtcccttgccctttgtcagtaaataattccaataacaaggcatgcggaacacggccatctaataaaacagcctgacccaatccttcaaacatggcatatttaatggcttcaatctttggaatcattccgtcagtaatttttttctctttgactaacttttctagattggtcagattgatttcatcaataaatgactcctcgtcaggaaaattgccatataatccacgaacatcgcttaataaaataaattgttcagcactcaatgcaccggcaattcgactggctgcggtatcagcattgacattataaatttcaccatcaagaccaatgccggccgaagcaatgacgggaacagcatccgtttgattgatacgctcaatgatttccggatgaatcgctgtaatttctccaacatagcctaaatcttcagaaataggtttggcttctatcaatttaccatcaattcctgaaacgccaatcgcattgccacctaaacgaatgatatcttgaaccaaacttttatttacttttccagctaaagctgtcagtgccaagtgagctgttttcttatctgtcacgcgcaaaccttgaacaaattggcttttttgctcatatttttcaagtaattctccaatcgcaggtccaccgccatgaaccaaaactactttaattcccaccgttttaagtaataaaatatcttttagaatactttctttcactttttcatcaatcatcgcattgccaccatatttaatgacaaccgtttggtcacgatatttcagaaaatatttgagactttcggtcaaagtctgagctgtgttttgtgaatctctcataaaattttctccaatagctctgctcctttttgcagttcttctttcgtcatgacaagcggtgggagtaagcgaatgacatcatgaccagctgacaaggctaagagaccattttcacgcagtaaagcaagaacttctggaatttttttctcgtcagttaattgaattccaatcatcaatcccaaacctctgatggacttaaccgtcgcttttactgacagcttttctgtcagtaattttaagaaaaaaatgcctttgacagtcactttttctaaaaagtcactgtcaatttcttttaaaacttcattagccgaagccatggctaaaggattcccaccaaatgttgagccatgctttcctgctgaaaaataactggcatatttattcttagcgagcatcgcacctgtaggaatcccattcgccaatgcttttgccaaagtaaaaatatccggctcaaaatcaaaatgttcaaaagcaaataattttccagttcgaccaattccagtttgaacttcatcaataatcagtaaaattcctttttgctgacaagtttttagagcttcaacaaaatctggagaaattggtaaaacgccaccctcaccctgaataatttcaaaaataatcgcgccaattttttctttttcaaggatttgctcaagtgctaccacatcattaaaaggactagccacaaaatttggtaataaaggcgaaaatcctgcttggattttttcttgcatggttgcactcatagcgccaaaagtacgaccatgaaagccatctgtaaacgccaaaattttctgatcttttttgatgagatgagttaattttaaagctgcttcattagcttcagttccagaattacaaaaaaaagctttataagaatgattttgacttaacttttcagccacatcttcttgcaaaggattttgataaagatttgaaagatgagacaggctgtctaattgagctttcaccgccacttttcccttttcaaaactatatcctaaattcatgaccccaattccacttgtgaaatctaaatacttatttcccctgtcatcaaataaatattgattttctcctttgattaagctaaatggtaggcgaccataattttcaaataaatttgtcattttttctccttcttaacttgtatataaagcattaatttcgacatatttataagtcaaatcacagccccaagcctgacccaagccacttccagcattcaagtctgcaataatttcaattttatcttcttttaatttctcagaaagaaaagctgcatcaaagtcaactggtgttgaatgataaagcacaagttcatcttggagttttaattcaatatcagaaacttcaaaattagccacctgaccaattgacgaaataatccgcccccagttagggtctgcaccaaaaattgccgttttaactaaacttgaacccacaatttttttggcaataaatcgcgctgctaaatcatttggcgctcctttgacggtcacttcaatcagtttagttgcaccttcaccatcagcggcgatttgtttggctaaggactgacaaacctttgccagcatttctttaaacaaaagatagtctgaacttccttctaaaatttcattatttttagcttggccatttgccatcaacaaaacagtatcgttcgttgaagtatctccatccactgtaatctgattaaatgtcgtttcaataatttctgataatgttttttgtagtaaatcttgagcaatttttgcatccgtcgtaataaaagcaagcatggttgccatatttggatgaatcatccccgatcccttacaaaccccggccatattcacgatttggcccccaatttcagcttcaaagttaattgttttagttttagtatctgttgttaaaatagctttggcaaaatatgctgctgtcccttcatttttggataactttgaaatccctgtggcaattttttccatcggaagctgtactccaatgacccctgttgagcaaaccgccacttcctcagctttgagttcaaatttttcagcaagcaatttttgtgttttcaaagcatttgcataaccctgatcgcctgttactgcattggcaaccgccgaattacaaataatggcccgtgcttgtccatttttgacaatttgacggtcaatcaatactggcgctgcacaaaccttattggttgtaaaaacgccagcaatcgcagctggaacttgacttagtattagccctaaatctaagtttttatattttaattgtgcatgaacagcatctgccaaaaatccctttggacttgcaattgtcccttttatttctttcatttcttcctcttctaaagacttggcataaatttcaagcctaaactttcatcgtagccaaataactgattaaaattttgtactgcttgtccggcagcacctttcataagattgtcaatcaccgaaacaactgacaaaacatttgtcactggattataagctaatccaatatcgcaaaaattagtcccaatcacatctgaaagttggggcatttgtcgtcgaattctgacaaagttttttgtcgcatagacctgttcataagcattttttatcgtttcaaaatcaaaatcagccgcaacttttgcatagctactaacaaaaatccctcgactcacaggaattaaagaagttgaaaattgcaaggcttgaaaatttgaattccaaatcttcaattgttgagcaatttctggaatatgttgatgactattgattttatacatggacatattatcgacaacattcacaaaatggctcgagtcagacagaccttttccggctcccgaaagtcctgacttggcatccacaatgattgagtctaaatcaatcatcttatttttaactaacggataaagtgcaagtagtgtggctgttgcatagcaacctggatttgcgatatagtttgcttttgcttgaccgatgtctgccagattatattgagcacttaataaatattcattttttaaatctgtatttttataccatttattgtatatttttaaatcaactaatcgaaaatctcctgataaatcaatgacaggaaaattattatcaataaacgttaaagctaatttttgactaacacccgctgaggttgcaaagaaaaccgcatcacattcttccataatttcttcttcgttaaattcactgatagtcaagtcagtcaagccttcaagttgcggaaagcgttctgataatttttctccataatgacttgttgcatatatttttgttacttctacttctggatgataatagaaaattcggaacagttctaagccgctataacctctaattccgacaattgctacttttttcatatttacacactttctatgtatttttatacactatactactctattttttatttgtcaagaattttatgtattattatacttttttaaacaaaaaaagagaaagaaattaatttctttctctttgataattcattaatttttagttttcataaattccgatatgctcatgttgatggctaccatcctcaatcatattaagcacagcctcggcataatcagcatatgaaattcgacttttacctgctttattatgttctaaaacatcgccggtaattgtataattatttgtctgtgctccttctgggtcaaaaaattctgcaggagagaagaaggtcacattaagttttgaagcttcataaatcaagcttgcttttgccatctctaaaagagttggatagtaaggtaaatctgttggtatcacatcaagcaagcgtttttcgtgactttcatcaagatagagagagcttgctcccccaacaacaattaaacgactatctatattttcaagaagttttatcatcacatgggctacttttgaataatcttcctaatgaccttccggtgcccgatgcgctaaaacgattgcatcgaatcccgctaaatcttcagaagttaattcaaaaatatctttttcaagaatagtagtcacttcaacttttaatcgtgctttatttctaacaatggcagtcgcttcatgaccgcgcccaaatgctttttgagcgattaaacctcctgccttaccagaagtagcaattacagcgatttttttcataaaaagctctccaatctcttatttattttaattataacaaattaagtaattctgacttctaaaaatggttcaaaaaaaacagcctgagctgcttttcatttatttaacgactcaaatcaactcttttacctaatttatccatgataaacgccccgataaataagctggcaaattcacctagagctaatgtcccccaggtcagcaaaaatggtgttccagcgacaaattttaattcaagagcaatggtgaacatacttatcgaaaagaaaattgcaaaaaagaaaaatgctttatttaactgaccattccaaaagtaatcttttttaaagcggtcaaacaaaaggacaccaagacttaagaatactaaagttgacaaaccaccgacaatcacatctacccaagtgaaagataaaaagtttgaaatcatacaaccaattgtcaccgcaataatatattttttattgaagaaggctgtaaaattcaacatttctgacactcgaaattgaataggtccgtaagaaattgcgctcaaacccggtgtcatcgttagaataacatacagggccgcaacaattgcgattgtaacaatatcataagtttttgattttttcaaaaggttctcctttggcgacaaaattcgcctataatatgcttgagcaaagggatgaaggctcaagggttaactcactattgagcaacgtttttattttagcagattttttgcgaaatgaaaaggattgacaaatatttgctttcatctaattattatttgggcattattttcactaacgaaggaatcattctttgtactcgatagaaattctagcaggagcatcaaaatatcctgccaacaaaaaggcaaaaaactactgacagaaattttttcacagaaaacaagcaattgaacaacttgtcagtaaaaatcaacaagtctgtcagtacttttgtagttaatacagactttcccacaataaataaaagacttaccaacatgctgataagtctttcaatatcttttatttgattgtccagccaccatcaatcgggacaattgctcctgacatataagaggcttgtggacttgctaaaaagagggtcaaatcagccacttcgcgaggactagcccatcgtttagctggtgtctcatcagctacccattgggccatctgaccattattttcagtgaaatcagccgcattcatcggtgtattgatggcacctggagcgatggctgctacttgaattccgtgttgtgcttcatccaaagctaactgttttgtcaacccaacaatggcatgtttactggccgtataagcgacgccacctccaccggcaaccaagccagcaaccgaagccatattaataatgactcctgatttttgagctttcatttttggcaagaatgctgaaatcatcaaatacattgaattgagattcgttgataaaatactttgccaaagtgagaaatcagtttcttccaaagttttataagcatccaaaacacccgctgtattgagtaaaacatcaatacttcccacttcgtcagccaatttttcaactgattgagcatcggaaacatcaagaatttttactgacagattttttgaattaatgacagattcgtcagtaaattcttgtaagtccacagcgacaacctctgcgccttcggctaaaaatacttttgtttgagccaagccaataccactggcagcacctgtaattagcacttttttcccagaaaatttcattttgtagcctatctatctattcaaccaaggcccaatcatcagccaaaacgtcgcaaggcgttggggcccacattgaaaaaccttcaccctctcctgagacattaatcaagaaataaggggtaacttccaacttctcaccagattctaaaacaatcgaatcatagagtttaacataattttcggcaccagaccagccttgtgttctgactacttttttcccagctttaagtaaagctaatgcttcttcaaaagtcattttttcctccatattgtttaaaacatactgaatttattataacaaagttcgagaggtttttgataaatgaaaaccagttttaactatccgatagattcaactaataaatagtcctcaaaaattatactctatttgttccctttaaaattttgtgctataataagttcaacaaagtgcaacacgcgaaaaaaaacggtctgcgctaacagaccgcgtgttcaaacttggttatggtgggactaatcgctaattgcgattagtttttttaatttcaagccagagcctgactagattaattacgaagttcagaacttcgataatcatcccaagtaccactagcatgaaatcctctccataaccaaggaaataccttgtcttcataggcacctcctccatctagaatttgtcagggcgcatgaaatcaagtgaacattaagagctttctctcctgatatactatacgtaaaaaaacgtgaaagataacaaatctttcacattttttattgtctaattaattttacccaatcaatgaaccagcaggaacatcatcatcaacggtcaagacacgcaattttccatcaaattcggctgacaaaatcattccttgtgaaacgtattttttcatcattttacgtggtttcaaattggctacgatttgtaattttttacctactaattcttgttcatttggatagaattgtgcaattcctgacaagatttgacgtggttcagaatcaccagcatccaatttaaatctcaacaatttatcagaaccttcaacaggttctacttcaagcacttcggcaacttttagttcaattttttcaaaatcatcaaatttaatttgtggtaaagttaaattcaattcaacttcttcagggacccactctttttctggcaatacgccaccagccatttgtaatttaatataagcaacctcttcttccacatcaagacgtgggaaaataggttgaccttttgctactacaggatgagtaaatgaatatccaaaagaaagattttcaagtgaaaatgatctttcatccattcccaattgctcaaagattttacctgatgttgcacgcataaatggttgtaaaaggctaccagcaattcgtaaattttctgccaaatgatacaaaacattattcaattttgctttgtcgtcttctgattttgcaaggacccaaggtgctgtttcatcaatatatttatttgttcttgaaatcaatgtccaaacatcagccaaagctacgttgaattcaaatttatccattgctttatggaaatgactgattgtttcttcaaccacttcttccaaacttgcatcaaattcagtcgaaactccagttgcttcgatttttccgtcattatatttgttaatcattgaaacggtacgattcaacaaattccccaaatcattggccaaatcaaaattaatacgtccaacaaagtcttctggagtgaaaattccatcttgtccaaaagaaatcgcacgcatcaaataataacgaaccgcatcaaggccataacgttcaatcaacatctcaggataaacaacatttccttttgatttagacatttttccgtctttcatcaagagccatccatgtccgaaaatctttttaggagcaggtaaacctagagcatgaagcataattggccagtaaatcgtatggaaacgaacaatttctttaccaaccatattaattccaggccagtattttttaaaattactgtcattgtcagaattatagccgagcgctgtaatatagttcaataaagcatcaaaccacacgtagaccacatgcttaggattagaagggacaggaattccccaagtaaaacttgtccgtgtcaaagccaaatcttctagacctggcttgatgaaattattgaccatttcatttttacgaacctcaggttgaataaaatctggatgttcatcataatattgtaaaagccagtcagcatattttcccatgcggaagaaataagtttcttcttcaacccattccacttcatgaccagaaggtgcaatgccaccagtaatatttccagattcatctcggaaaatttcttcaagttgtgtttcagtgaaaaactcttcatcagaaacagaataccaacccgcatattttcccaaataaatatcatcttgttccaataactgttcaaaagccttcgctacggcttcctcatgataagtgtctgtagtacggataaatttatcataagaaatatccaattttttccataattcttgaacatcagccgccattgggtccaagtattctttaggagtcattcccaattcttcggcttttcgttgaattttcattccgtgttcatcaagccctgttaaataaaaagtatcaaagcccatcaaacgtttgtaacgagcaagcacgtcacaagcaatagttgtgtaagaactaccaagatgcaacttacctgatggataataaattggggttgtaatgtaaaaagttttgttttctgtcatattttcctctttccgagcaaatgaggctcgatatttgagaagattctcatctaaatattataccaaaaaacctctaaaatcgcattgtgtgattaagtttgttataattatcatagaaaagttaagaattcctttaagtcacagctctttggaaattcttttaaaaaataaaggaacgattatgaactataaatttatctcatggaatattgactcacttaatgctgcattaactggaacctcagaacgtgctgccctttctcttgctgttgttaaaaatctcgctcaagcacaaccagacgttttagccattcaagaaaccaaacttccttctactggacctaaaaaagctcatttggaagttttggaaaatctgtttaaaggttataaaatcgtctggcgttcatcagtagaacctgctcgaaaaggatattctggaacaatgattctttataaagaaactctaccagaaccagtcatcacttttcctgaaattgatgctcctgaacctatggatgccgaaggtcgaatcatcacccttgaatttcccgacttctttgtcactacggtttatacaccaaatgcgcaagaaggcctgacacgacttgatttacgtggaatttgggatgataactatcgtgactatctcacaagccttgatgctcaaaaacctgtctttgcttgtggagatttcaatgcggcctatacagaaattgacttagccaatccccgtggtaatcacaactcagctggatttacagaccaagaacgtgaaaaatttggtcaacttttagaggctggattcactgatacatttcgtcaactccatggtcaggttgagaaattttatgaagaaggacgtagtatttatacttggtttgcccaacgtgccaaaacttcaaaactaaataattcaggttggagaattgactactggctggtttccaatcgtcttgcccaagcagttaaagtttctgaaccccttgattctggtgaacgtttagaccacgtccccattctcttagaatttgaactctaaaataaaagaaccttaaaggttcttttttattgtcaataaaacaaatagagactataattgaataaaaatagttgaggagaacatgtttatggttaatataaatttagttttagcagagcatcagaccttagaaactgaacgcttgattcttagaaaattacaacttgaggatgccccagaaatgtttaactatgcttctaatcctgaagttgctcgttttactagctttgaaccacatgattctatagaaacaactaaagccacaattgccaagttttttctgcctaacagcctctatcattgggggattgttgaaaaaacttctggtcagctcattggtgaaatttttcttaatcctatcaatgaaaaaacagtcgaactgggttggattttaaatcaagaccattggggaaaaggacttatgccagaagctgctgaatgtcttttggcgctttctttcgataaattagaagttaaagttattcaagctaaacattttacagaaaatgcaaagtctggtcgggtcatggagaagttaggaatgaaaaacttaggaaaggtatattcttactttcctaagtttaaaagtcctcttcttacagactattgggcaattactaaagatgagtatgacttacttcattgacttacgaacgaaaggatttctaataaaaaggtttatttttttagatttttgtggtagtcttaaaatataaaaaaagatgacgaaaggctactaaatgtcccgttctgacgaaatcattcgtattgtgagtgattataaaaaaattgaagtcaatcaactttcacaactccttaatgtttcaaacgttacgattcgaaaagaccttgataaacttgaagagaaaggaattattaatcgccagcacggttttgctttgattaataatacagatgatatcaatttccgtttagctaaaaactatgatttaaagcgaaaaattgctgtcaaagctgctgaaaatattcttgatggggatacagtaatgattgaatctggttctacttgcgctttgcttgctgaagagttagcctttaatcgaaaaaatatcactatcatcactaactctgtttttattgccaattatattcgtaaatccgactcggtaaaggtaattttattaggaggagaatatcaaaataattcacaggtcaacgttggacctctgataaaaaaggtggttgatgaattttacgttgataaattatttatcggtattgatggttttgaccccgtccgcggttttagaagtaatgatctcgctcgtagtgaagccattcatgtcatggctgctgcggctaaagaggttgtcattttaactgatgcttctaaattcaaccaaaatggaacagtcacctgtttttcattccctgaaatttcccaagtttttactgacaagtcaatcaacgcagaaagtcaaaaaattctcgatttgaaaaaaataaaggttactactatctaattaaaaatggacgatgtccatttttttattgacagattttctaaaatatgatatattttcttcataagaaagaattatactttcgtttgaaagttttgctttttttggaatctccaaagatttaaatattattacataaaaaaatgagtctaaccaactcatttttttatattttttcgtaagatgattctttaaaaccaatctgttgaacttgaccattttttactagtaatggacgtttgataagcattccatttgacgaaagaagttctgccatttctttttcagataatgttgctagcttatctttaagatttaagtcgcgataaactaaaccacttgtattgaaaaactttttgatgggaaaatctgcttctttaaaccatttctcaaagtttttttgactcggtggggtttccttcaaatcaatcgcttgataatctattccaagttcatctaactttgctttagcttttctacaagttgaacactttggataccaataaaaatcgtacatcttatcctccttatactttaattttattatagcatattaaaaagggattttttggtccaattttctatgaaaaatctattttttaatgattaattttatagcttgttcgagtttttcttccttgtcagtcacttctttgtccagtaaaagttctttgagattctcagctacgattagaccaatcaggctatctaagctagagcgaacagcggttaattgagtcacaacatcaatacattcctctccagattccatcatcttaagtattcctgtgagttgtcctgtcgctcgtttcaagcgattttccatttttttgtcatattttttcatcagtcatccttttcttgtttcgctccctaatcaagtaattccttggtaactttgctgtataatccaaaggcaccatccaaatttttcactttgtagccctcttgttttagaatacgttctgcattgtaagagcgaagtcctgactggcagctaacaatatattcagtctttttatcgagttcatttagccgctcacgtaagtcatcaagcggaatattttgagaatttttaaatttcccttttgccaactcatttggatttctcacatcaagtaagactttcccttttgctaattcagctgcaagttcatgccactgaatattttctgattgccctaagagaaggtttgttgcggcatagccagccatatttactgggtccttggctgaaccaaaaggaggggcataggtcaattccaattctggtaaatcaaaaacggttagttttgctttgatagccgtagataaaatatcaattcttttatctactccttctttaccaattgcttgcgcaccaaatatttgtccactttctggttcaaaaattaatttcaaaacaatagaagttgcatctggataatatcccgcatgattatttgctgtgacatgaacaattttatgattaatctttaaacctctaagctgaaactcagaaaggcctgtacttgccacttgcaaatcaaaaacacggacaatcgccgttccaagtgaaccgcgatttttaactggtaatccactaatgatatcagctacctgacgcccttgacgattagctggagaagccaatgaaattaaagcatcctgccctaattgatttttgacaacaatggcatcgcctactgcgtaaatatccttaaccgatgtttcataatgttcgtcaacaagaattgcatttcttagtcctaatttgatgcccgcacttttagctagacttgtttctggctgaattcccacagaaagaatcattaaatccgattgcagactttcaccattatctagcaaaatttggtcatttttaaattcgacagctcctctatttgtcattactgaaagattatttttaattaattcttcattgacaaaagctgccatttcgcgatcaatggttggtaaaacatgtggtgctttttcgacgattgtgacacttaaccctcgtttagcaagattttcagccatttctaagccgataaaaccagcaccaataattgtcgcactttgaggagctttggctttcaaataggccattattttatccacatcaggaatatttcgtaagctaaaaacatttgtcacttggtctaaacctttgatttgtggaattaagggtttggcccctggtgaaagaatcagtttatcatagctttcaacatagctttcaccatttgaaactacagtcattttctttccttcactatcaatcgcagtgactttggaattttcgcgcacctctaagttaaaacgtttttttagaacttgagcagattgaacaattaacttttctcgctctgcaatttctccccccacatagtaaggtaagccacaattggcaaatgaaacgtaaggacctttttcaaaaacgataatttctgcattttcgttaagacgtcgcaaacgggttgcagctgacattccacccgcaacaccgccaacaattaatattttttctgtcattttttaatttttcctctccaagctcgcattcctccatttacgtttgttacatcataattagctttgtttaatattttgtaggccatttttgaccgcattcccgactgacaaatcaataaatactttttgtttttggctagaacatgttctcccaatttacttaaagggatatttcgagcacctcttatatgtccattttgaaattcatgagcttctcttacatcaattaattgtgttcctttttttaattcagtacttacttctgctggactgatactttttattttcttaaaaaattcaaacattgttctctctctaaaatctgtcagtaaattctaaggggccattccaagcaatggtaccgtctgaaatatttatagtatcaattccttttgtcgaaagatactgacaggccctagctgaacgagcacctgactgacagatgagataagttccgtcagtaatttctgcatatctttcttctagttgactcaatggaatatttttggcattaggaacatgaccactattatattcaaaatcttctcttacatctacaattactggattttcactttctgtcagtaattctaattcacttatgtcaattgtttgcatttttcacctcttgattatttgatttataataattatatacccccaagggtatataagtcaagtttattatttccaaatgaaaaaacctaagttttaaatcacttaggttttgcttaattttgagaaattcaattatttctcgtttttatgtttgacagagtcaaccgtatcattaaatttttctgcaacatcttcagctaggtcagaagctttgtctttaatattttccaagccttctttagcttttcccataagtccttctgttttacctttagcttctagtttttcatcaccagttactttacctgtggtttctttaacttttccacttactttatcttttgttgcatcaagtttgtcatttaaagccattttaaatcctcctagtaattgcgattttttcttttattatcatgaaagtttcatgataatttgttagaaaaactaaatcagttaaatttgtcaatcattgactgacaaaagcgaatctacgatttcccctcctttgttctcttcttaatctattctcattctaacatccgtagcaaaaaaagtacagaaaactgctcataagactaaaaaaacttggaaaattccaagttttaataatcatagagttctgttgaaagatagcgctcaccattgtcagcacaaagagcgagaacttttttacctttactaagtttttttgccaattcataagctgcccaaattgctgcgccagaagatatacctactaaaaacccttcacttttgccaatttttcgtgcggtatctaaagcatcatcacttgtcacatcaattactccatcataagcttccgtatctaaatttggtgacataaatggaataccaattccttgaatgcggtgtgggccgctctcacctcctgttaaaattggtgattctgccggttcgacaacaaaagttttgattttagaattttgacttttaagatagtgagaaacaccagaaattgtccccccagtgcctgcacaagcaacaaatgcgtccagtccattttcaccaaatgcttcaattatctctggaccagtcgttaattcatgggcttttaaattagctggattttcaaattgcattggcataaaccaaccattttcttcaactaatttttgacctaaatcaatggcagctttgatgccatcagctgctggagtcaaaatcaattctgctccataagcttgaataagctgacgacgctcttttgaataactatcaggcatgataataaccacattatagcctaaagctgcaccagccatggcaagtccaattcctgtgttcccagaggtaggttcaacaatcgttcctcctttttttaagcgaccatctgcttcggcttgccgaatcatttgtaaagcaatccggtctttaactgaacctccaggattaaaatattcaagttttagataaatttctgctccattttctggaccattttttagtttgataattggactatttccaactaattcagtaatattttcaacaatttttaccataattaattcctaaattactgacagctttgtgtcagttcaagtcaaccaaatgagcgcttgaggcgggagatagatgaattgtatgcacttctgtcagtaaattactttcaatttctactgtctaatttttctgtcagttcaacaggaccaatgtgagctgttaaagcgagggagaaaggagtcgtaagctttgcttacaagtctgtcagtaaaattattttttttcaaatgcattttcgatatctgtcagtaaatcttcaattgcttcagcccctactgatagacgaattaggccatccttaatcccaatttcttcacgaagttcttttggaatagaagcatgagtcatcactgctggcacttcaattaaagattcaacgccacctagtgattcagccaacgtaaaatagctcaagttttcaacaaaatctttgacggcattttcatccgttaattcaaatgaaatcatccctccaaaggcagacatttgttttttagcaatttcatgccccgggtggctattaagacccggataataaacttttgagacggctttagaagtttctaaaaactcagcaattttttgagcatttgccgaatgagcctccatccgaagcgcaagtgttttaatacctctttgcactaaccagctgtcttgtggtccaagaactgctccaattgaattttgtaaaaagccaatttcgctggcgagttcttttgaattggttgtgactagtcctgctactacatctgaatgtccacctaaatatttcgttgcggaatgcaaaacaatatcagctcctaaagcaattggttgttgtaaatatggtgtcgcaaaggtattatccaccagtgttaaggcatcatgagctttagcaattgctgaaatttccttaatgtccaaaacttttaataaaggatttgaaggagtttcaaaataaacagctttcgtttcttccttaaaagctgctttcaagtcatcaagattactcaaatcaactaaatcataaataatccctgtctttgtcagcactttatccatcaaacggaaagttccaccataaacatcatcagctaaaatgatatgatctcctgcagaaaaaagcgaaagaaccgcatgaattccagcaagtcctgaactaaatgcaaatccttgaacaccaccttctaaatctgcaattaattcttccaaggcatgacgcgttggatttccagaacgtgaatattcgtattctttaggttgtccaagtccgttttgtttataagttgacgtttgataaatcggaacagatactgctcctgttgtcttgtctgttgaaataccaccatgaattactttcgtttttaaacttgtcattggcccttttctttctattttattttctctaatacaaaaataacatgaaagttaaaaagtcgccataagaatatcctatggcagacttaatattttttatgatagcctgaaatttactgactacttaaaaagttaagaaaatgactaattccgctttctagattagacaaagtttcataagttgcttcttttttaacaagttctgaggcattccccatcgccaccgaataatgaacctgcccaaacatttcaaggtcattcattccatcaccaaaggccactgtatcttttttattcactgcataataatcttgtaaagccgaaatagctgtcgcttttgtgactgatttgggagtcaattcaagattatttagagccgatgaagaaactgacaaattttttgaggctctcaattcatgttttatttctgctaaaacttcaaaattatcctcggaaataatgattccattaataattcgattggaaaaattctgtaaatcatttagactagaaattttgataaattctctttctccttctgaaactaatcttcctttatcttcatttttgaagtaatccggcaaatctttgctataaaaagtttctgataaaccaaagaaaaataaggaaagattttttctctgacaaatttcaaatgcttcaattaaggcttcaagattcaatggattttttattaaattctggtcacaatcataaacgcaaccgtttgaagcgatcacttttacctctggatgcagactttctgcaacaactcttgctgcctcatattttctccctgtagcaagatatacaagcgtcccctggtcaatcacttgatgaatacttcttttatcaaagtctgatattttcatctctgaatccaccaaagttccatcaatatccataaaaatcattcgtggaatcataattctccctaatctttttattactaattttctgtaagacctgtgtctttttgcgccagtttgttagagaagacaacaaatggcatataaactaaaacaccaagcacaataatgataaattgcacaattgaaccacgaatgtcaccagcagttgctaaataaccagaaatcaaaggaggagtcacccaaggaattgaaatataagttggtgaaacaaaatgcagactcgttgcaaaataggcgatcactgtcgataacaaaggaaccagacaaaacggaattgcataaactggattaaacacaattggtaaaccaaacatcattggttcactgatattaaacaaacttgcaacgccacaaatttctgccattgttcgttcatctttacgttttgagaaaataaagagggcaatcacaagacaaatcattgtcccaccgccacccatataaacataggcatcaaggaaaggttgagtaacaatattaggtgctgtatgaccagcttgaattgcatcaatattttgttgcaaacttgtcaataaaacagggccagaaattgctccaaaaacataagcaccatgaattccgagaacaaatacaaaagttgataataaaacatagagtagaattccaggaagcgattggaaaccaccaactaaaggggcttgcaagaatttcacaataagttctggtacagaagaaccactcaaactactgattgtttcttcaacaattgcaaaaatcgttatgactagaattgccggaatcagtttattaaatgaattttcaattgctgacggaacgctttcgggcattttaatctttaatttttgattttgtgagaacttacaaagtaaagtcacacccactagagccgcaataattcctaaaagcattgttgtcgcacttgtgtatgtttgggtcaatgttcctgtggcctgaaaagttttcccacccacactcaaaacactgacagagtttggaattaatgtaatatagcaagcaatggccacaattccttctaaagccccatctgtaccataagtctttgccaaatgataaccaatttggaaagttatcattaagcctaaaatccctaaagtcccattgtagccctgaatacagacatttgaaataaaatctctaccaggaattcctctcaatagacctgttgttttctccaatagtagattattgattaatacaaagattgcggcggtaatcgtaataggaattgtagaagcaaatgcatcacgaatcgctgcaatataacgatttgctgaaatttttccagcaagttgacttaattgttcaaccgataactttttcatattcttcctcttcaagtaattttgatactaaagtaaaccattttccagctaaaccaacccaaacttccttataggttgcattattaaactgaggccaataaggagcatcttcattctcaaaggtctgtactcctacaggcatttcgccaactatttctcctgatgatacggtatacatttcaggaaattgatgtccctcaccaaacatcatggattgtccaaatggattttttcctatcaaccactccatttgctgataggcgatttctgtcagtgatttatctgccaatatttttcctaatatagcagcactttcagccattgacaatactattgcattatttcctctaaatgagaaccaaactggaaatcgcttaatataataattttctgcaatttgctcgcccgccaccaattgctcctgaaactcaatttttgcttctgggcccactagtaaatgttgcttatcaaaagattccttatcttgccactcatttttttcataaataccactagcaatcattggataaggagccgtgaagttcattagatatttcaggtaatcaccataattactgatagcagctagtaattttactgacagacttttgtcagtcactattttttgtgcttctgccaaagcataagcataaagatgttctcttgcctgatgattgaaatgttgaaaaacttttttctcttcatcccggtaaaacatcccttttagtaaacttccgtcaaaaagtgaaatcccctcattttcctgacaatctaacaaatcttcaagcttttgctcaacaaaaagctgataatcaactttgtcagtaatttgataaagtaatgcagccgtccatatcatagtcgctaaataagtacttttagaggttgaataagtatgctcccagctgatgggctcatgtttaaatggagctttttcaaattctgtcagtgcatcttcgtaatctatttctaaaattgaagaaattttttctctcaagtcagcttctgctgataaagctagatatatttttgctaaaatgcctgtaatcagaaaattatcataaggactattatgcacgcgcgctctagcatcatccattgaaccaatttgattatccgtccaacgactgacaccagcacttgtcacacgatagccatttcccagtctagttttaaaaattaaaaataaaatctaaaccccattctccttcttctaaaagtctggcatgtaagactgggtcacttttttttacttttgctgctaattcgaaaattcctaaagttacttctgctgactgaaccagttgctgtgaaaggtctcccgcatcatgccaacctccattgaaaataatttttctgtcattaaattcagaaaaaacatcttgatgacaagtcccatgaatgccagaaacaggacaaccacagcgttcacaaaagacaaaattcaaacttttccataaagaagtttttaataaattttcataatcatcaattttgaatatttttgtttttaaatctccaacttgtagaaaatattgaccttttattttgtaatctgaaaaatctgcaaccgcataagttccaacagtcttatcaaacttttgaaaatgtcctttataaataacttcggaatttttttcatcaatgagaagaaatttttcacctatcaattcactatgagcaatgactgttttagtcgattcctttggatatccaatatgagaataacttaaattattttttaaaatctgccaaccttttacatttgagttttcttgattagtttctaaaaagatcttttcaacaactatatcccagtcagccggtaaatccatgtaagaaccattggcattaaatgtaatttcaagtttacttatggcatctcttgaaagattacttatatccaatcgatactctctggtctgtttattttctaaattgatgacatgatgaccttctcggtcatatttatctggaacttttatttttccatcattagtaaaactaaccgtgattgatggattgataatatttttacaatgactagtcaccactaattttaattgattaaaagtttcccagttctcatttacaaaagttcttttagcaccaatcattccaaatgatgtataatcaccgtcttgtggccaatctgccggataagtttcaaatcgtgccggactttttaaatgaatcaaagaactatctttgacaaaattccctcgacctacttgctcccactctcctaaaatcggaacttgttgaagaatcttttctttttttagactctcactttcaaaactctcttctttattgacagctaagggcttgtggagattatgacttgccaataaatcttgataaaactttttcatatttacctcattattttcctattaatgaatttatttagcttcttttgcaactctcttttgaaaagcatgaaccgcacaaccttttagagcaatcaaggctgggtcaatttctgtttgccgaactccttgcgtcacaaaacgcattgtattagcattgagtttttcaatcactaacttaaaaaacaaatcattgttaatcaatcctccacctaaaaccaccgcctctgggtccgaagttctgaccaaattcataataagttcagcaactcctttagtagcttgttgaacgacttggctggctagtgggtcatttttttgaaaagcatttattatctcttctccacttacacgttcatgatcggtaattttcaattgacttggaaattgttttttcaaacgatggacttctttactcatacctagacctgaagcaaatgtttccacacaatcaattcgaccacagacacatcttacattattatttattccaaccaaactatgaccaatttctccagcattaaaatgtccaccttttagcaattgaccagcagcaattactcgaccagcaattccagttccaatattcaaataaataaaatcctttgtttttttaccaattcccaaattcatttctgcaaggctggcacttgaaacatcattattaatgacgactggcaacttaaattgttgactaattacgtctgctaagggaatttcgttcgcattttctgggtggatttcataccaaattcctttttcggaatcaactcgtcccactaaatcaatgctgatggctatcagttctccttgcaaagtttcattttctaaatatgagccaatcacttcttttatttgttcaagagcttcaacttgagaagccacctttgaaggataaactttactttccaaaatatttccttcttggtccagttctccaatgagaatcttagttccaccaaggtccacccctaagaccgtttcttttttcattatttcccctttattttgactaagcgtaatcgccagccttagttttactcttcatcgccagaccaaaatcagtataaattctctgacctaaattatttcccttcatctcagcaatgtgatgtgccaaaatttgaaaaggaataatcataaaaagccccgctttatactcatcaatttctagctctaatccaagttcacggtcatcatgacttttatttaagctaatcgtataaacttgtccaacatatttttcttcataatctcttaagttaaagagcctttgattcattggcgaattactgtcaatataaaattgttgatgatttgaattaacttcaaaataaggaccgtgcataaaaacttcaatatccattccttgactaggaaggcgaatagtttcagaaaattttgtttgcatttccatcgcagttccaatcaaagcccctgtacataaagaggtgaaacgctgagccttcatcaactcatttgaccatttttcaaaaaagttttctgttttttcaatgatttcagaaatcttatcaatcgcttttgcaaaagtcgtcaattctttttcttcttcttggtcactgattagccctctagctttggcagtttttagagcagtcaacatcaatttaaagaccgttgcgctaaaacctttagtgacatagccaacacgttctattccattttcaatatcaatcacttcatcaaccacttgggcaagctcactttcccttttgctcgttaatccataaatcgtaagctcaggtttcatcttttctatcgcttttagagcatcaatggttgaagtgctttcgccactttgagaaataccgataacgttatcagtttcttcttttaatttttcataataatgaaatttaaatggttcttctattcttaaataaacgtctaagatattttcaatataatattttgcactgtaagctgcattaatacttgaaccagtagccaaaaccaaccaatcattgcccttgataactggacaattatcaggatagttttttagtatgttggataatacctcttgttcttccatgatataggtcatcattgacggtttattctcttccactcgctaaccccttttttaatttttattttcggtaacgtttccataaatttattataattcatcttaaagaggatgtcaaggattttttgtaaacgtttttattttaatgaattgactaatccaataaaataattgataatagagaatagataataaaagtgataaaaagattggtcaataaatgaaaaaaataacgattaaagatattgccaaaatggctggtgtttctgtcagtacagtttccagagcgataaataatgatagtgaagtttccgaaaaaacaaagaaaaaaattgataaaattgtcttagaaactaattatcacccaagtatgttagcacgggggatggtttctaaaaaaaccaatatgctggcaatacttgtttcagatataaccaatccttatttcaatcaactcgttgctgagcttgatagtcagcttattgacaaaggttatactctttctttatttgacactcaaactgcaaatcgtattcaggacaaaaaaaatagactgaccgaggtcagtatttttaagcaaattcaagaaaacaattttgatgcagtcttaattttaggagggttattggatgaaagcaatattaatcctgactatcaagctgatcttaccaatttagccaaagaaatccctcttattctgcttggtcgtgatttaactcatctgtcagacaatattttctctctaaaacgggaccagcgaacacctactcagctccttgtttctcatatgattcaaaaaggttatcagaaattagctttcattggtggctcagtcagcacatggatgactcacgaaagaacagatagttttcgagaaattttagctgaaaatcatttacctattgatgaaaaaagaattattaataataatttttatgctaaagatggatatgaagctgtgactcggttaattaattcaaaagttgattttgatggaattgtggcaattaatgaccgtgtcgctcagggtgcactccgggcgttgaaagatttttcaattagtccacagttaaaaggggtcgcttcttgtgaatatttcccagatagcgactttcacatcccacgaattacttctgttgaccataaaattcctgaacttggcgaaaaagcagttcatttactctttgaagtcttggataatgagtcaattaatagtgagaatctagcttttcccattcctaaattaattattggtgaatcttgttaattgaaaaataaaaaaaacgaaggacatccttcgttttttaatattttctaaatctttcgtagcgttgttctgccaattctgtttctgtcagtaatgacaattcactaagtgattctgtcagttgtctcttgaggttatcaatcagattctcctcagaaataacagcatcaacaagccccatttccaaaagatgtggcgctgtaattttcatcaattcagccgcttcatcacgacgtgaaccatctttccagagaatcgtcgcaaaaccttctggagaaagtactgaataaacagcattttctaaaatatatactttattggcaagtgcaagagctaatgctcctcctgaaccaccttcacctgtgatgaaagcaataatcggaactttaaggtcagacatttccaaaaggtttctagcaattgcttcaccttgtccacgttcttctgcttcaattcctggataagcaccagctgtattgataaacgtaatgactggacgcccaaacttttcagcttgcttcatcagtcttaaggctttacgatagccattcggacttggttgtccaaaattagtagctaaattttcagcaaggttacgtcctttttgaattccaataacggtcacagcttgattattgaagcgagcaattccgccgacaatcgcttcgtcatctgttaactgacggtcgccgtgtaattcaaagaaatcagtgaaaactttgtcaataatatctcttgccgaaattctgtcagccgctcgtgcttcattaataatgtcagcaatatttttttgtgaaacttcacctgtcagtgaatcaattgtttcagacattttccacctccgtatgaagttctaaaagaagtgccaatttttgacgtaattcagtccgcttaacaatcgcatcaacaaaaccatgattcaaaagaaattcagctttttggaaatcatcaggtaaagtttgacggacggtttgttcgatgacacgacgtccagcaaaaccaattaaagattggggttcagctaaaataatatctcccagactggcgaatgaagctgtcactcctccagttgttgggtcagttaaaactgtaatataaaaaagtcctgcatttgaatgacgtttcacagcagccgaagttttggccatttgcatcaatgacataattccttcttgcattcttgcaccacctgatgccgtaaaaacaataatcggcaatttttcggtagttgcatattcaaataagcgtgtcaatttttcaccaacaacagttcccattgaagccatgataaaagtcgaatccataattgccaaagccgtttttttccctttaattgtggccgtcccagtcataactgcctcatcaagaccagtccgtgcttttgttgccgccaatttttcaggataacctggaaaatccaagggatttttgctttcgattccagtgaacatttcaacaaaagaatctttgtcagcaacaattgctaaccgttctttggctgtaattcggaaattgtaatcacaattaggacaaactttattttttcctaaatctttttgataaatcgtatgtttacaagcaggacatttggcaaaaagttcatcaggaacttctggctgctcggcttgcttttcaataatggaacgatttggattaattttaatgtattttttcttttggaaaagagccatctttgcatccttttctcatttttttataaattttactgacagatgaattgtaagccatctgacaattctgtcactaatctattgattaatcttctttttgatattctggtaagaaaacatttcctaagaagcttgtatcataatctcctgccacaacatgtgggtcagaaattaattctagttggaaatcaacatttgtaatgaccccttcaacgtcaaattcaagaagggcgcgttgcattttcatcagtgcttcaaaacgattttcaccatgaacaatgactttagcaatcatactatcataatatggcggaatgctgtaaccactgtacatagcgctatcaacccgcaaaccaactccaccacttggcaagaaaagattagtaatttttcctggacttggtgcaaaattaaatttaggattttcagcattaattcgacattcaatcgcatgtccactaaaagtcacatcttcttgcttgacagacaattcattgccattggctacacgaatctgttcttttacaatatcaacacctgatacaaactctgtgaccggatgttcaacttgaacacgtgtgttcatttccatgaaataaaacttaccagaagattcatcaagtaagaactcaatggttcccgcattctcataagaaacatgctgagctgctttaacagccgcagctgttatttcatttcgtaaagtgtgtccaattgcaactgacggagattcttcaagaactttttgattatttctttgcaatgaacaatcacgttcaccaagatgaatcacatttccttgactatctcctaagatttgaacctcaatatgacgcgctgggaaaatcattcgttcgatgaacatggctccattaccgaaagcagcttgtgcttccgcttgtgctgcctcaaatgctggaacaagttcctcaacattattaaccttacgaattcctttaccaccaccaccagctgatgctttaagcatgattggatagccaatttcttcagcaatttttactgcttcatcagtggtatgaacttcaccctcagaacccggtgttacaggaacaccagctttaatcatttctgcacgagcattgattttatcacccatcatatccataacttttgctgacggaccgataaatttaatattcatttcttcacaaagacgagcaaattttgaattctcagaaaggaatccaaaacctgggtgaatcgcttgtgcgcctgttgccacagcagctgacagaatgttattcatattaagataagactcggtacttctagctgggcccacacaaattgcttcgtcagctaaatgaacatgtaaagcatcgcggtctgcagttgaataaatggcaactgtacccactcctaattcacgagctgcacgaataattcttacagcaatttcgccacgattggcaatcaaaattttattaaacatagatgttctccatatgggaaaataccccgagcttttgctcaatgggtgttttgaaaggaatgataaaaaagaaagtcattcccaacaaaacaattttttgataaataaaaataagtccgaatttaccataagtaaaaaatcttatggttaaaataaatttttgtttcttaatcataaaaaatatgattatttttaaatgaagatgagctatttacctaaggcaggacacaacctgacatcttcgatatcaggtcaccttgaccgtctttaatccatactcgctacatcgctaaagcgattagtcgtaatggttataagcctatctccacttcgtttcgctgtccgttttctctacttgctaaagcaagtgataaaaaggcaagtactaaagcactaacgccctaaggcaaaagtcaaagttcctttagctgccaattttccatcaacagttgcttctgcttcaacaactgcaattggaccacgacgtttgataaatttagcatgtaagaccaattgatctccgggagtgacttgttttttgtacttaacattgtccattcccgcataaaaaacaagttttcctttgttttcaggtttagataattctaaaacaccagccgcttgtgcgagagcttccataatcaaaacccctggcattactggatattgtggaaaatgtccttggaaaaattcttcattaatcgtcacatttttaattgctgtaatttcatcctcagcaatatcaatcacacgatcgactaatagaaatggataacgatgaggcaaagcctccataatttcagttacattaatgtttacttcagtcatttattctcacttttcttttagagattcactgacagaacttgtcagtaaattctctggcacctaaaccagagctgtcagtaacttttacatcaaagataaactgacagagctttgtcagtaatttttttatttgattctcatcaaatcttgaccaaattcaacgacatcttctccagaaaccataatttccgtgataactccatcttttggtgcaggaatttcattcattactttcattgcttcaataataagcaaagtttgaccttttttaactgaatcaccaactttggcaaattcagccttatctggtgaaggtttaagataggccacacccactaatggagaagtaactgcttcaccctcagcttcaacagccgcttcacttgctacgggcacttcggtactttctacaactggcgttgcttgttgagctgtaaatgcagctgcagtaggtgcagtactttgagctccaacaagggcttgaccttcatttttagaaaatgataattcaccatcagcatttttccaagaaaattcacgtaaagtagaaccattgaattggttcatcaaatcttttacttctgaaatgttcatttttatttactctccagtccatttcttgaatgccaatacagcattgtgtccaccgaaaccaaagtcttgcgacaatgcaagattaatatcagcaggtttaccttcaccaagaacaacattaattgtcattccttcatcaagttcagttgttccagcatttactggtgcatattgattcaaaagtgcttgaacagtcgccactgcttcaattgcacctgttgcaccaagtgcatgtccgtgcaatgcttttgtagatgaaacataagctttatcgccaattacattgtgaattgctttgctttcagtttcttcattggcatgtgttgaagttccgtgtgcattaacgtaatcaacatcagctggacttgcaccagcttcttccaaagccaatttaatcgcattttcagcacccactcctgaaggagttgtcatatggaaagcatcatttgtatttccgtatccaacaatctcagccaagatattagcgccacgagcttgtgcatgttcaaggctttccaaaatcaatacaccagaaccttcacccattacaaatccagaacgatttttatcaaatggaatacatgctttttcagggtcagtttctttagtcaaagcagtcaagttagcaaaacctgcaattccaagttcacaaatagccgcttcagcaccaccagcaatcattgcatcagcgtaaccatgtttgatttcacggaaagctgaaccaattgaattagcaccagccgcacaagccgttacttcagcacgcgaaaccccacgagcacctgtacgtaaagcaacgttaccagttgccatattagcaatagcaagtggaacgtagagtggtgctacccctttacgaggtcctttagcgacaattgcttgtgaatttttttgtgattgttcaagtccaccaatcccagaagccatgatacagcccaaacggtcaaaattagtattttcttctgtaataccagacatttccattgcatcaagtgctgcataaaccgcataaagtgagaaagtatccatgcgtcgtgcatcttttttctggaaatatttatcaaatggaaattcttttacttctgctgcaacagaaatccctgttgcttcagcatcaaagtgagtgattggaccaattccagttttaccagctttaagattgttccaaaattcttctgggctatttccaattgcactaactacaccataaccagtgataacaactctatttgtcatatttttatcctcttaattttaaaatttatcaatgaataatttacattgaaactccaccatcaatggtaagtacttgtccagtcatatattcttgttcagccaagaattgagttgctgttgcaatttcttcaggcattccaaaacgtttcattggaatttgccctttcattgcatctttaactttatcagaaagaacttcagtcatatctgattcaataaatcctggagccacagcattgacacgaacatttcgtgccgcaacttctctagcaattgattttgtcaaaccaataagtcctgcttttgaagcggcataatttgcttgcccagcatttcccataagtccaacaactgatgagatattaataattgctccagaacgagctctggtcatcggtttcaatacagcctgtgtcatattgaaagccccagtcaagttgattttaagaacagactcaaaatcttcttctgacattttcaaagataaaccatcacgagtaatccctgcattgtttaccaaaatatctactgaaccaagagtttcaatcgcttctgcaaccattcgttttgcatcttctgattttgaaatatcaccagaaataccaattgctttaaccccataggctgtaaattcagctaataattcttctgaaattgctgaacgaccattaataattagattagaacccgctttagcaaattgaagcgcaattgctttaccaattccacgtgttgaaccagtcacaaagacatttttatttttaatttccattatttaagatatgaacctgcctaagaagttttagcactttagtactaagatttcaaaaggacaaactcaattcctttcttcaattttactgattaatcaaagcttcaaatgaagctaaattttcaacattagcaatttctgcatttttatcaatttttttaatgaaacctgaaagtactctcccaggaccaacttcaataaagcgagtcgcccctagtttttgcattgtttcaacagattcataaaaacgaactggttccatgacttgacgcgtcaaaagtcctttgacttcatcattttccattactttagcactcgtatttgagattaatggtaattcaaaaggtctaaaattaattttatcaagttccaaagccaatttttcagatgctggttttaaaattgctgtatggaaaggtcctgaaacttttaattcaataagtttacgaactccggcttctttaagtaattcaacagcatagtcaaccgcctgaacttcaccaccaataacaatttgtgcgggcgtgttataatttgctggactcacaataccgcctttaaattcggccgctttctggcaaatttcttcaatcaaggctgggtctgtgttcattacagcgaccattttaccagaaccagtcggtgcagcttctgtcatatattgaccacgtttagctacaagcttaactgcttcttgaaaatcaatgattcctgatgctaccaaggcagaatattcaccaagactaagaccagcaacaaggtcaggtttaattccattctcacttaacaaacgtaaaatagcaacagaggttgttaaaattgcaggttgagtgtactttgtttcatttagtttttcttcatcattatcaatcaaagctcgcaaatcatatcctaaagcttgacttgcttcatcaaaagttgctttaactgtttcatattggtcatataagtcacgtgccattccaagcttttgtgccccttgacctgagaataaaaatgctgttttagtcataatatatagtaatcaaccttttgaatcaatgattcaaaatcagtcaatttgaattcctcgtattttcttttataaagttaattattagtattgtaaaatgttttttaccttaaaaaaatgacattcttcaatatgaaaattataggacaagctcagtatatcattactgagccccctatactagaattctattttgaaaatagaactagtccaacgaaaagaaggggcgaaattcgcaaaagaatcaactcctttgctcgcttcacccccatcccgaattatttgttgttttctacgtatttaacgaggtcagcaactgttttcatatctgcttctgtatcaacttcaacgtcgaattcgtcttcgatgtcattgatgatttggaaaaggtcaagtgaatcagcgtcgagctcttcaaatgaagtttcgagtgttacttcttctttttctttaccgagttcgtcaacgataatatcttgtactttttcaaatactgccataattttttctcctttaattgagtgaaaatatttatattatatccgcaaagcggtttataaccattagttagtgaagattttttaaaatcttattgtgagtcaaagttagatgataatgtgttcttatatagacaacttaagaaaaacttgctaaactttggactcttataaattaataattgctgtaccccaagtgaggccaccgccaaatcctgtcaagacgacttttgtttgaccgtccaaactaaatataccattttttacggattctgacaacaatatagggatacttgctgccgatgtgttaccatattcttgcatattttgaaggaacttttggcgcgttacaccaagctttttagccattttatcaaggattcttgaatttgcttgatgaaggagataataatctacttcttcagcagacaaattagctttttctaaagttgcctggatatttttaggaacatcacgtacggcaaaatcaaaaattgctcgcccttccatactcaagtttgaactttcgtatgaaacagaggcaaatggagtttggatgtcagcataactagaaagtaaactgttcccacgacttccatctgtttgcattttttcagcaataatcagaggttgactcgcgccagcttcaataagcacaccagcagctccatctccgaaaagaacagcagttgatcggtctgaccaatcaattacttttgaaaagacttctgcgccaatgacaagccctcgttgatatgctcctgaggaaattaatttttccgctgttgatagagcaaagacaaagcctgaacaagccgcagtcaaatcgtaagcaaaagcattaactgctcctacttgagcttgaactcgtgctgcggttgaaggcatcaatgagtccggagttaccgtagcaacaatgatgaagtcaatcgtttctgggcttaaatttgaatcgctaatcaactgcttagcaactttagctgctaagtctgaggtgttctctccagttgaaatatggcgatttttaatccctgtccgactgtaaatccattcatcatttgtatccattattttggataagtcatcattagataccacattttcaggcacatagtgtgccacttgcgtaattttcgcaaaagtcattatttcatattctccaaagaatcgtgtaaggttgcaagttcaccagccaatttattttcagtagttccataaacgctatcaaatagattatctgtaatcgtatggaaaaattcacggtgagttgcacaaagctcatcacccttcgatgtcagtataatgtgagtcactcgtctatccgctgtagaacgcttgcgttcgatatatcccttatcttctaatcgattgagggtaattgtaattgttgacaaggccaatttttgatttttggcaatatctgtcgcacggcaagttcctagcgtatgaaccagtgtcaaaatttgtaattcttttactgttacatctgaataagctgagtcctttaaaaattgctcctctaatatcataaaatcatgaaagagttgaatcagccattcatttaccttatcaaaatctgttttcatctgtcatcctcttcattatttagatgtgagtccgactttagacattacgaaaaaaaagaaatcgcaatcaataaaatcccttatgaaattttattattacatttagataggggataaactgatgcaaaaaaacatcatcaacttaccccctgatttattattctattttttctttctcgcaagatgaactcaatttgtttttatattgcaaatggttttctgtatcaaattatattattttttagaatgatttgcaagtaataatttttagaaaacgtcatcattgctcaatttttataaaaaatattagtttctgtcagcaaaatttgccttcccaaactactgacagaaataatttcaacaaaaaaagttactgacagaaaatttaaagttttcatcagtaacttttgaattcattaggcaggattgctggcaataatttctaattgaccagacaaattccatttttcaatgttgcttggtaagatgaaatgagctcctttttcaactggatattcattcccatcaactattaattttccttgaccatcaagtacagaaactaaagtgtaatctgcaactttggtaaattcatggtcaccatgaatttgccatttataaacatcaaagaaatctgatttcacaagagttgtaatttctgcatcagcaaatttttcagttttaacttgattttcaggaactttgtcgcccggaatattcaatacatcaattgattgttgaatatgtaattcacgtagatttccttggtcatctttacggtcaaaatcataaacacggtaagttgtatcagaagattgttgtgtttcaagaataacaattccagcaccaattgcgtgcattgttcctgacggaacatggaagaaatctcctgttttcacttttaccttacgtaacaaatgatcccaatcaccagatttaatcatttctgctaattcttcacgtgatttagcattatgtccatagataatctcagcgcctggttcagctgaaataatgtaccaacattcagtttttccaagttcaccttcatgtttttgtccatattcatcatctggatgaacttgcacagaaagccagtcattggcatctaaaattttagttagtaagggaaaaacttcttttttactatcaccaaacaattcgcggtgacttgcgtataattggtcaagtttttgacctttaaattcgccattagcaattgttgacacaccatgtggatgagcagaaatagcccaatattcaccaactttgtctgatggcaaatcatagccaaactctttcaaatggtcgccgccccagattttttcttgcaaaactgagttcaaaaacaatggttctttcataatttcctccaaatgagcagattttattcgctttcatttcacaatgtctattatatcacaaaatttatctagaacaattctgtcagtatttttatgacaaaaaaagttactgacagaactgtcagaatgtattcaacctaaagaatacactcaatttttttgtcagtaacttttttaattaatattctgatttattgttaagcccacgaagaagctcatcaatttttgaaccatattcaacagattcatcttttgcaaaagttaaatctggaattttgaaaatggtcatgcgttttgccaattcacttttgaatagtccggttgcttttttcaaagcagttgcggctttttcattatcagaggcaagatttgacaagagactataataaacagtcgcttgactcaaatcaccagtcaattgaacatcagtgatatttacatcttgaacacgtggatcacgtactttatttcgtaaaatatcattgatttcgcgttgaatttctacagcgacacggtcgctacgaaaagaatttcccattttctcctcctattttttcgtttaaaatgtagataaatgatttttaaatcacttttccactcccacatttaaaatgagtaaaagctcccagaaacaataaacttaaataaaattcatcatttttaaccagtcgccctcaccttttatttaattgagttcaccttcttagaagtctgtgaaaatagacaaaatagaacctacactacgcgtagaaccacattttctatctacgctgtccattctcgctaaactgctaaaccagttagtcgaagtagcaattatcataacttctggacagtcgagctcacctcttattatttacgttcgatttcaaccattttgtaaacttcaaatgtatcatcaatttcaacatcgttgaagtcttcaaccatcaaaccaccttcttgagcatttccgacttctttaacgtcatctttgaaatgtttaagactggcaatagctccatcatgaatcacgacaccttcacgaatgacacggacagaagcatcacgggcaactttaccacgaataaccataaatccggcaattgtaccaactttagaaacgttgaatgtttcgcgaacaattgcttcaccaatgatttcttctttgaactcaggatcaagcattccacgcattgctgtttcaacttcttcaattactttataaatgatgctgtgcaaacgaatatcaacttcttcttgagccgcttgttcacgtgcaagaccagttggacgaacattgaaaccaatgataatcgcatttgatgctgctgcaagtgaaatatcagactctgaaattgccccaacagctgaatggacgatatctactttcacaccttcaacttcaattttttgaagtgaagcagcaagcgcttctgcagaaccttgaacatccgctttgatgataatgttaacagatttagtttgaccttctttaagagtatcaaagagattgtccaagttaacacggcgtgtattttgacgtttgatcaattgagcacgtttagcacgttcttccccagccgcacgagctgctttttcatcttcaaatactgcgaagtgatcaccagcttgtggtacgtcagaaagaccagttaattcaattggagttgacggaccagcttctttaatccgacgtccgaggtcatttgtcattgtacgaacacgaccatatgtgtttccgacaacaattggatcttgaacatgaagtgttccttgttgtaccaagagagttgcaattgcccctttaccttggtcaagacgtgcttcaacaacagtaccaatggcacgaacagttgggtcagccttaagttcttgcacttctgccacaagaagaactgtatctaacaattcatcaagattttggttaaatttagccgaaatttcaacgaattctgaaccattttctggatcccaagcgactgggaatacaccatgttcagtaagttcttgtgttacacgttgtggatttgcacctggtttatcaattttgttgattgcaacaataattggcaccccagcagctttagagtggttgattgcttcaattgtttgtggcattacgccatcatcagcagcaactacaaggattgtaatatctgtgacagaagcaccacgagcacgcatagaagtgaaggcttcgtgacctggtgtatcaaggaaagtaattttcttaccattcgctttgatttggtaagcaccaatatgttgagtgataccacctgcttctccctcagtcacacgagattcgcggaaacggtcaagcaaggttgttttaccatggtcaacgtgtcccataattgttacaacggctggacgttcaaccatgttttcttctttaagatatccatcttcaacaaacaaacgttcaatatctgatttgtcttcttcaacttttttgactggtgttacaccataatccatgagaatcaactcaattgtatcttcatcaagtgattggttttgattgaccattgttcccatcatgaagagttttttgataatttcagctggttcgcgtttgattgatttagcaatatcttgaacattcattcctacttcatattcaagactttctggtaattcatggaatttacgttgagttgctggaacacttgaagattggttgttttggtgacgaccacgaccacctttttgattccagtttgagttacgcgcattacgaacttgattacgattatcatttacgcgaagtggaccacctttacggttaccatcttttgtattatcgcggttattatcagattttttacggtcacggtcacgacggtttgttttaccagaagtagctggtgcaaatgaatctgttgctggtgcgctacctgatgaagcgaatttgtcacgtttttgaccttgattttgtccttgaccagatgaacggttcttatcataatggtttccaccttgaccattcccattttggttaggacggcgattatcattacgattatttcggtcattacgatttttgtcgaattttttcttttcaggacgagctgccgcttgttcttttttgatatcttcggcacgtttaataactttgatttgaattcttggtttttgagtcaatgattttttcttttcttcagtaacaactggttcttttttatcagcaacattttctggttttacttcagcttttgacgttgctgtgttatcttttgtttctactttttcaacttttggctcagatttagcttcaacttttggttcagcttttttaactggttcactagctttaggtttttctgtaaccacaggatgttcagttgatgcaacttctacttttgctgctttttcagcttcttctttagctttaattcttgctaaaattgctgggtcctcaacaactgcttttccagcaaatgtgcgtggatggtcttccttgtttttctttgctgactcagcagcttttggttgactttttttaacaggtttttcagcaactttagcagtttggtcagtgcctgtttttgcactttgaatgattttttctgcttgttctgctgttacagaacttgaatgtgatttcacttcaaaaccgagagtttgtgctgccgaaacaagttcagcatttgttaatccagtttccttagcaatttggtttatacgttttttatcagacaatctttgtcctccttatatcatcaattgttcatgaggctctccattttctttgcaaatccatcgtccacaagtgcaataaccttgcgattttgtcctatggcgtgcgataattctatttctgtaaagagtgttgagacagcaatctcataataatttgatttatcagtaattcttttactcaaattttctgcggcatcattggcaagaaaaactaatgtagctttactgctttgaattgatttaatcaccaattcttcaccactaataatttttccagctcgttttgcaatccctagtaaatttgaaatttgttgttttttatccatctttagtcgtagtccggcgctaaatcagcggaataggttgcagattcaagttctcgtcgagcaacaaggtgttcaacataagtgattaactcatcatagaactcatcagcaattttagtttgaaaagctcggtcaaaaacacgttttttcttagcttctcttgcttctttattcaaaatagcaatataagctccgcgtccatgtgctttaccagaagggtcaattgaaatttctccctctttattataagcaatccgtaacaaatcctttttgggaaattgttcattcgagactaaagattttctcattggagtttttttctgtttcatcgaaaatcctcaaaatttctgttgaaaaaatgactgacagccaattttttgaccactagaatatcagccattttaatgacagacctataaaaaagaaattatcagcacctttgtgcttttcctaatcttttattttctgtcagtaaattttcaagcttttaaaatttattcttcactttcgctaacttcaggtgtttcaacaacttcttcaactacaaaagtttcgtcaacttcagttgttggaatttcttccccatcttcacccacgaattcataatcatccatattgaattcatcagccgctttaatatcaattttactgtttgtaacgtgtgcagcaagacgaacattttgaccacgtttaccaatggcaagtgacaattggtcgcgcgcaacaactgctaaacttgaaccatcagcagtaatcaaaacttgttcaatacgagcaggttttaaagcattagcaacaagtgttgctttatcttctgaccattcaatgatatccattttttcacccgcaagttcgcgaatgattccttggatacgtgaacctttagccccaaccattgtaccaattgcatcaacattttcatcatgactttgaacgatgactttagcacggtctccagcatcacgagcaattgatttgatttcaacagttccatcaaaaacttcaggaatttctttttcaaacatacgtttaagcatatcaggcgcagtacgtgaaatgaagacacgagttccttttggagtcaagacaacatcagtaacataaacttttacacggtctcccacatggaagttttcctgtggaatttggtctttcttagtcaaaagagcatcaacacggccaagatttacataaacggcacgagcatcaactttttcaacagttccttggatgatttcatctttgtaacggctatattcgttataaataattgtgcgttcttcttcacgcattttttgcatgataacttgtttagcagctccagcagcagtacgagcaaaatcttttggtttttcttcaaacataattttgtcgccaatttcatagtgaggatttaattcatgcgcatcctcaagtgaaatttcaagacggctatcgaaaacttcatccacgacttcacgagtcgaataaacattgaagtttcctttcttttcatcaaagataactttaacattttgtgcttgaccatattgacgcttgtaagctgctgtgatagcttgctcaattgcttcaataacaatctcagatttgattcctttttgctcttctaacattgcaaaggcgttcagcatttctttgctcatttttttctctctttctttttataagaaaatttcatttttaatataagctaagttcgactaccttgaatcaaggaagttttacattttcgcctaactcaaggaaatcgaactcagcttctaattattgactctctttagaaaaatcaataaatcctgtcatatctttaaaatttaaccatcgtttgtgcttttgcaacagcagataaaggaatttcaatatttttatgacgggtcttatccaagacatctaccactaaagtttctccatcaaagcttaccaaatcaccagtaatttctttttcattattgattttttgataaagtttaacgaaaatatactcaccaactgcacccgcaaaatgctcatctttacgcaaaggacgttcagctcctggacttgcaacctctagtagataaccttctgttggaaacgggtctggactaatggtatcaagcaaaggtgaaatgatttcactcaactcagccgtctcatcaatttcgattccgccttctttatccaccagaattgaaagcatcatatctccaccaaatttttcccattcaactgcaaacagttcaaaaggttgaggaatatgaggtctaatgaaatcttctacaattttaacaacatcattcataggcaattctcctttcataaaatacaaagttaaagtcaacttctattttaaaaacacaagagaaggagcgcccttacgaacgctcctttctaatagtttatttatatttattataacacgtttcaagtaaaagtcaagcacacattttaaattttttattaagccattttcattagtctaaagccagtttatccttgaaaaagcctatctcgaagagtacaataaaaattgttgtaaaaattatccgtaattaacttagggagttaacaaatatgaaaatttacctgcaattattaatcatttttggcttttcttttattggaaatgtcatttcaaacgtctttcgtttaccagttccaggctctattctaggaatgatactacttttcctcgcattacaattcaaaattcttgaatttcgtcatgttgatgaagccggaagctttcttatcaataatatgaccattttatttttgccagccggtgttggaattatggccaaatggaatttgattagccacttttgggcacaaatcctcttgattgttgttggagcactcattataaatatgctcatcttaggaaaattagttgaatggattaaagttaaatttgaaggcgattatgtcgctttaaaaccagatactaccgtcacttcttccactgaagaccaataatttggagcatataaaatcatgaatattatcactaccgaccctctctttggctttgtccttaccgttcttgtctttatgattggagtacgaattaatgaaaactttcgtaaaccttggacaaacccacttctttttgcgactgtcgtaataatcctaattctctcactagctcatatcccttataaaaactattatatcgggggttcaattatcaatgaccttattggacctagtaccgttgctcttggcattccactctataaaactttccacttgatgaaacatcacgcgcgctcaattgttacctcaattgctattgcggctctagtcaactgtatttttaccgccctttgtgctaagtttttcagccttagtaaactcgcttctctttcaattttccctaaatcagtaaccactgcaatggctatgggaatttcagataaaatgcatggtgttgaacaaattaccgttgttgtcgttgttgctacaggaatccttacaagcgtgctaggtggccctcttttaaaactctttagaattactgacccagttgctcaagggattgccctcggaggaactggacatgctgtcggaaccggaacagcgattgaacttggaaaaacccaaggtgcaatggcagctcttagtatcggagtgactggtattatgtatgtgatatttgctccaatcattgccaaaatcattcttggctattaaaaaactcctatataaataaaaaaggttgaacacttattgtccaaccttttttatttagctaaatttaatcattttatttaacttcttcttctttttttctgcgtttttttaagcagataataatcagaaataaaacaaaaccataagaagttaataaaagagaactagctacaccagtttttggtaataatccaaaaactttttttgatgaatcatccttacttttaggggctttaggaacttcaattggtttaggagcaggctcaggtttgtttggaggtccggttttttccttatcaacactagatttaggataaatataaacctcatttaatcctgaaactggagccttgattaccaaaggtaaagctgctttcagcaaacctttctgagggttagtttgttcttcaatcaaataataaccatcagccacagataaactagctactccattcgagtcagtcgccaaatcagcaacctcttttaaaactgtataacttgatggcggtggatttgttgccttaagttctgaaccatccccagtaggtgaaatttcataaactaaataatgaattccagaaagaactgacagttcgtttcctaaattatccaaggggaggttattaatctgtagtccatcatttgtcgtctgattctcactaaagcctgtcgctccagggcttagcccatattttacaataattaagcgactatcagcaaaagctttttgactgacaagtcccaaaaacaaaagcaaagtgactattaagagccccattaacttgctactttttgtcaattatccctccccctttctttaatttattaatattcaagcattttatatattttatatatcccaatgcttcttctgttttcaaaacatactgcattattttcttatcactagtaaaaacaggacctatgacaagcgcatgtttttcatccccataaccttgtttctcattaatataattttgccagttttccgttttatctttaaatatccagcgggacaactttttaattctttttaatcgataaacatttaagaaaagctctactgagttcagcttttctttttgagcaaattcatctaaccactgaaacgctagtttcttagaatcagttaaataaaaaccttcaccaaaatctcctaccaattgtccatcagaaagaacaggtttttcaatttttctagcagcaacatgatataagttccgctttctcccaaagagtaaccataaaagatagactaatcccagaaacattaagaaagcagacccaaacatcacccaaaaattataaccaaactgattgcgttgaatatcttcttgtggcgtaacctttgataatgctgttctttcaccagtaactagtaatcttttgttattaatacctgttggataacaagtgactaaagtcaccaaatctcgtcctttttcaatactcaaagatgaaacttgattgggagcaacgatgcgaatatcattaatcttgtattttagagtgagattcaaaacatgaagataaaagatatcaccatttttgagtttatctagattagtaaataaagtatcattcactcgcccagaatgagcaggtaagacagcatgactattgattccttcaattggcaaagaggattgaggcacatgtccaacccctagtcccaaaattttttcagaatctccatgatagattggaatatcattgactttaatctgaggaatcgtgatgaaacccatcattcccgtagtatcaatttttaagacattgttatagttaggaattggcttattccaagcaatatgctgacttgcatcatagatatattcattgtaaagttgcgcgttataaagctgtgcttgactaagcaattcctttactttagcacttcctatatttgaaagattttcatcgtatttctgaacggatttgatattttgctgtcctgccaaatagttaacaacaatcgggtagaacaacaatccaatagcaattatcccaagaataatactcagtaaatttcggaaactgaagccctttttacgggaggtttttgattttctcttcgccatcatcccctcctaatctacaatatcaatttggctagtttaccacttccattaaagataaagttttttatttcacaacttcttcttcgttatctttacgacgtttaatagcaaaagcaatcacccctgaaacagttgcaatagcaatgattcccgctaaaccttgtccacctgtaaatggtaatgcaaatggtttattattggtaattgtagtatcagtagcagctggtgctgtgcttgcggtgacggcaccagtcagggtagctgctgtagtaacactaggaagttgataacctgttggagcggcaacttcgacaagatagtaattcgtagtgttactgccatctgtgttattatcaaccaagtttaagccgttaaaggttgcaatcccatctttacccgtagtgaatgtgactggtgcagttgcacttgtagttgcatttcctgaagtatccccagtgacaaaagccgctttacttgaagttagatttgttactgttccacctgaggctgagttattaaaataagctgcattcgcttcaacaaaatcttgggcatcctctttattatcagcacgtacaacagtaaaagttgctcctgccaaagctacattagttgaagcatctgttttagtcatttcaagaccacccacattaagtgttgatttaactgctgtcgtcgttgaaagatctgctccataagcgttagtgattgtcgtagtggctgaatctgtcgcactaccaatggcgcttttaaccgttgatggaatgataatatttaaagcaccatctgcgttaccaagcaaacttgctgcgtgttgttggccagccgtggtcaaagtaaccacgatttttccattgccatcgtttgtgattgtatagtcagttgtcggagtcaaagtacccacttttgttccacttccatttgtaacatttacaatcaccgtacttgctgttactgtcgagctgtttaccagattattaggcaattggtcggtaacaatatatgtacctgtgactcctgtagccccgtttccgttgtttgtttgtgaagaatcaaaaactgtattcacattccaattcactgtatttccagctgccgcagttgttgtattttgattatcagacccatttgtccatgttccattagccaaattttcattaccagcgttattgtctgtatttgtgagcgtttggtcagaatttcccgttgcatttggattagcaatttgatttggtgtttgaccattgaaattatcatccgcatttgttgtcgcactcgttcctaaacctgctgaacttgacatatctagttttggataaacgttaacaatacccgcttggctatcttcgtggctgacttggacgataaaatctccaacagttgtaatcccattgactgttgtcacttgatgaaacagataataacgatcggtcaaaccagtgaaatcagcaagaccagatgcatctgtagtgactggagctacagaagttgtatctgtaaatgaaggatcagtcacaccagtcggaacacccgtccctacatattttgttgctgaaaaagtcacatttgccattgtgcttggagttgaaccttcaagagttgtttgttggctaccatcatttttggtgcttccagtatttcctgcttgtcctcctgtttgattattagcaatcccactatcattaacaggattgccatcggaatctacaagtccgttattttgcgtcggattttgattcccagctgctgattgagcataaatagccacttcaccattggatacttggtcggtgacacttgttgttttggcattaacatttaatagtccactaaaaccagcaagtgtactaagggcaagaagattaatacttgccagtgcaatttttttattaagtgaattaagtttcatttgtttttctccatttttatttgattaatttactatttttaaagctaatcctactttgttctcaagttttaaaaattgattaagtagaattttctcctattttattattcaacatgatttcccctttcgctgtaactgtgccagatgagcacgattttttgtgtgaaatagtttttgatatggtcgcgttctccgattttgttggaaagtctttgatttatttctcttagtctttcgtaatgccactgaattatcaacttttaaaagagtctcttcttctgactttttacgttttctaagaaagactcctcccattccagtaagagcagctaagctcactaccccagcaattccttcgccacctgtaaagggtaaactgaaaggttccgcaacattaattgtatctgatacagtcgccgtgcccccaccagtataactataagtcacactgatagtataaattccttgatgaagttttccctgagcaattgtcacatttccttgattatcaagttcaaagctttttaatccttcaatgatttcctgttccagaacttgggctttttgtgccacttcaactcgaggaataatctcaccttttatatcaatttttatcttatttttaaaaagtgaaacagcgatttttgagtttttgaggtaatcattttcttttattttttcacctacaaaaccttcaatggcagacttctttaaagttaaatctccattatttgaagtgagttgtacatccatataggttcgaggataaaaaaggattacaatcaaggcgagaattaatatgactgttaaaatgatgttcccccaaaacaaatagtctgccatatatttgcctatgaagggaatgtcactagaggtcgttgacatccaattatattctatgaaattataataatcccaagtcattggtagaacaagcgtgagtaaaaggaaatcaaggataatgagtattattttctttccagttgccaaagttcctcctttctagattctaagatctactaattcattttagataggacaaaagatacaacagcaaccacaatcactgcaccaacaatggatgggattagcgccataccagctagcgaaggtccccaagttccaagtaaagcttgacctacaaaagatccaactaaccctgctaagatattagcaatccagcccattgaacttcccttatttgtaatcgcaccagcgattaaaccgattaatgcaccaacaattaatgaccaaatcatatgtcacctctttctttagaatacattttatgatttaaccctaatctaacacaattagaaagcgcattcaaatgatatgacttattttataatttattaatactatatttaccttcaactatctcagaaagactattaaagaactgaataatatcctttacttaaccccaatttttattatatctctcattttttgagcacgataatattatatgctaccatcaaatctcatgttttaaaaatcattttttaatatctaaatttgcatcaaagatttgctcctggtatgataaaacttatacaatagaggtaaagcttattggaaaaacaataataaacatattatttcacaattgagtatacttacgttaaactttgtactatacacagttaacggttagatattcgattaactttgaaaacctgcaaaagtttatattgacataatattcataaacttaaacaatcagaaaggaaaatagaacaagaaaatgattgaacaagaaaaacatacgcttaatgatggacatttgattcctaaaatagggttaggaacatttcagattcgtggatatgaaggggtggagcaaattttaacggctatacaaagtggttatcgtttacttgatacctcaactaattatgatagcgaaggagcagttggagaagcaattcgtcgttctggcatccctcgatcaaatttttttgtgacaactaagctacctggtaaatatcatcattttgaagatgctttgaagatgattgaagagtctttattacgaacgggattgagctattttgatctttacttgatccactggccactaccaaagcaagataattatgttgaagcttggaaagcactaattgcagcaaaaaaacggggtcttgtaagatcaattggggtatctaattttgaggaagaccatctcgacaaaataattcaagaaactggtgttataccagcaattaatcaaaatgaaattcacccttactggcctcaagaaaagctattgaaaattaataaaaagtatggcattttaactgaggcatggagccctttaggccgaggtagtaaagagcttgaggaaagcctgattcaaaacatagctcaaaaatatgataaggatactggtcaaatcattctaagatggcaaattgaaagaggtattatacctattgttaaagcatcttctccagaacaccaaagaaaaaatatagatatttttgatttttcactttcttctgaagagattaataaaatcacagccttaaaacgagaagatggcagggtagataatcaagatcctaatgagtatgaagaatttgtgtaattatattactctgctcttgaataattaatttcaattgaatatatgaagaattacttcaaaaaaaccactaaaattttcaagtggtttttttagtttctataatgaattatttaaaggaatccaccaatattcccatattcgaaataaaaaaatatatgacatgcataactaaataatatatcccccttacagaacatttataatgtcaacatcaaacatctctatggaacggacttagataactaccaataccaaattgtataatctaacaacagaaatcaagtacaagtaggaaactcttaaacatgctggacagactttccatcatcatcaagaattatatttgaataaaattttttcccaattgattatgtgactttgattatagaaaattttttcttatggctcatttatttttaatagaaagagttagaactctgtctaactctttttttgtatattatttcagtttatttacttgcaaattgaataactatattaaagagaagggcacctaagctaccgccaatgattggacctaaaacaggtatccatgcgtaagaccagtctgaatctcctttacctttgataggtaagatggcatgcatgatgcgaggtcctaagtcacgtgcgggatttagagagtaacctgtcgttgcaccaagtgataaaccaatggctgtgataatggcacctactaaaaggggtgagacacccgaagtttgcgtaatagcgtattgaccgaaggcaagaattcctgtcgtcaatactgcagtaccaacaatttcactaatcaaatttgggcctgtctgacgaagagccggacctgtagaaaacgtgcccaagatatctgctggattttttgtttcagcatagtgagggtaaaacattaggtagaggataatgctggcgaccattgcaccaagcatttgtgcaataatataaggaagaaccaaactccagctaaagctcccaatcattgccattgcaattgttactgctggattcaaatgggctggcgacataaatccagaaatgtaaacccccatcattactgcaaatccccaaccgagagtgatagcaacccaacccgctcctgttgctttcgttttgttcaagacaacgcctgaaacgaccccgttaccaagaagtattaagataaatgttcctaaaaattcaccaagtagctgtaccatttctgagtacatattgaccccttatttctatttttttatttgtttcaattatcttcgaactatttttatttcttcaagtctgataagtcagattcacgaagcgctttttccaaagctttttcttgttctgctttttcttctactgaccaaccgagaaagtccgcaatgacattgacaacatgaactttgattgtatctacactttcacgcataaataaaatatggttagtacgacgaagcaagtagtctaccggtgtcaagatcatttcatcctcaagcgcatagcgcagacgggctgattctgctaaagataatccttcataaggtctcatttcagaagcataggcaaatacttggagtgcgttcatgccataaaagtctgctatgtatttcgactcctcttctgtaagacctgcagcaacaccgattttcatgttttcagcaacgacttcttcaaccttagttggatcaaattcaccaccagagatctggtattttttagagtcgattggttcatatttcaaatcaaagtcctcaacaagcagctggcagataagctccatagcacctgctgccattttacggtagtcagtgattttcccaccagctaaagtaatcaaaccatcactctcacgttcaagtgaactcccacgagaaactgaagatggcgcgtcccctttttctgaaagacttgattccatattattcaataaatgctctacttcggctttagttgctgttttatttttatagcgaagcacggcctctacgacagcgttaaagctagtttcagaaactgcaccgttatcacctccgttatagtctgaacccgaattcccacctagcaatggacgcaatccagcccatgaagcttcaatgtcattaatcgtgatatttgctccaggataacggaaattgatgacatctaaaaggtagtccacatcttcttgagtaaccttgggatcggtaaagtccccatgataatccgtatctgtcgtaccaaaatatgttttattttcacgtggaatagcaaaaaccatacgtttatcatgttttcctgtatcaaaatatgttggttgaggcacaggtaatttggcagcatcaacaacgagatggactccttttgtcggacgcatttttggcacaatcggacgagtgaagttcaagtaacgtatcttatctacccaaggaccacttgtgttaatcacaagtttagattttacttcaatgacttcatctgtcaataagtcacgcgcccgaacaccagagatttgtccatcagtatagataaaatcaatcactttcatcttgctgatggcttttgcgccgtcttcaacagcttttttaatattgtcaatcaccaaacgtgaatcattgttacggtagtcaagataaacccctgcaccttgcaaacccttttttttgatcagtggctcacggcgtagcacttcttctggtgagatggtatagttggcatatggagaaccttcatcaatacctgccaaccgatcatacaaatccatggcgattttcacagaaaacatatcaaaagtcgttttgccttcatcattgtaaataggaagtaacatcgggtctggcttaggaatatgtggcgcaatactttgaacaacagcacgttctgaaacagtgtcggaaacgacttcgacatcaaagttttttagataacggatacccccatgcacgagtttcgttgagcgtgacgatgttccttctgaaaagtcctgcatttcaagcacagcaactttcataccagtggctgccgcttgtaaagtcagtccagcaccagtaataccacctccgataatgagtaaatccatttcttcattctgaacttttgtgattgcttcttgtcttgtttttttagaaaaaaccatttctattctcctttatgttactgtctgattgattattatttgaaagcacgtgttgcattcacagcttttttccaaccggcatagagttcttctctacgttcttcttgcatctgcgtttggaaaattttgccaggctcataagattctttgagttcttctagatctttccaaaaaccaactgcaagacctgcaaggaaggctgcaccgagcgctgtcgtttccagatctcccgcacgttgaatagggatattcaagatatcagcttggaactgcatcaggtattcattatttgctgcgccaccatctactttgagtacagacatatcgattcctgtatcttctttcatagtgctgactacatcacggacttgataagctatgccttgtaaggtcgcttttacaatatcttcttttgtcgttccacgtgtcaatccaaacattgcaccacgcgcttcttggtcccaatatggtgcgccaaggccgacaaaagctggaaccacataaacttcatcttgattcatagactggagtgcaacttcttcagaatcactggcacgttccaacatctttaaaccatcacgtaaccattggattgatgaacctgcaacaaagatacttccttctaaggcataataaacttttccattaataccatagccaattgttgtgagcatgttatttttggaaatatgtggtttctcacctgtattcataacgataaatgaacctgtaccataagtatttttaatcatccctggttcaaaggccatttgaccaaataatgcagcttgctggtcaccagccatacctgagattggtacttcagatccaaagaaatggaagcctttagtcacaccataaacttctgagtttgatttaacctctggaagcattgaagctgggatattcagaattttcaggatttcttcgtcccattttaactcatgaatgttgtagagcatagtacggctggcattagagtaatctgtataatgtacatcgccatctgtcaacttccataaaagccatgtatcaattgttccaaagagcagctcacctcgttcagcccgctcttgtgctccttcaacatggtcaagaatccaacgaatttttgtagctgaaaagtatgagtcgacaataagtcctgtctttttgtggaatagttcatcatgtcctccatctttaagaccgtttgcaatatcggcagattgacgtgattgccaaacgatggcatggtagattggtatacctgtttttttatcccagataatggttgtttcacgttggttagtaataccaatagcagcaacctgcacaggcttaataccagattcgataaatgctcctgcgataacagattgaacagagttccaaatttcgttggcatcatgttccacccaaccttctttaggaaagtactgtgtaaattctttttgggaacttccgatgtgtttaccctgtttatcaaatataatagctcttgagcttgttgtaccttggtcaattgccataatgtaagaagtttctgtcatgttgtttctcctttgtaaacgctttctataatttatattatagcattttaaaacgaatagaaactttcattttttatcaaattcaaaaaaaaattggcagtcgaaaataaacaacagattcgagagggagtctctaccccaatttaattttaaccttatttgagttgctattcttaattcttcatctattctgtaataaattcagtgagaaaatgctaaataatgggaccgcagtaatatcttcataaatgtaaaataatattcacgtgaaaacataaaaaaagaggagagcacccctctttcgtgttttattcttaattcaaaattgcttttttttgaaatttttctttttttaagttttcaatacgcgacaataactcttcaaaatcataatcactggaaaactcggaaagtatatagacaaactttcgactgtcatttcttttacttgagataagtagatcataactctggctttcttgataatgctctaattttatcttttcaacagatctgaggtgatttttcagatagtgttccatcgggatttgataggcaggtgtatcagacaaatcataagccaccgtcaattgttgagcagataagagctccagcagcattagggcattgcgataaccaaagatgagttctggtaaatcttgctctttgggaatataacttaaagcaatatctttgaggttatccagtaaatcttgaaaactcttatcaacccagttttgtttatgcagcatcaaatcttcttgaattttggtaaagaggctaccttggaaaaaggtgaatttattgtttacttgagctaactgataactgatggctttctcctcttcgaaacctaaacgatgaggacgatagtggtttaacattcgctctcttaatgaaatattcaagaggacagttggaatttttttactgcggtaaatatcaaaacggtaataactttctttatctagaatgaaaaaagattggagaaaactgtagaaaaaaattgtctcacagttatccttactctgattatcataaatatgttgataaaaaagagaatccaatagttgatagagatgatcatcttggtatattttcttcatttccaaagatttagtaatttggatatctgtaagtttccgccttctttctgtgattgccaaccaccgataaagtttatctttgctactttcggaaaaatttacttttaatgtttcttcaagttgctgtacaaattcaacctgaaacttagtgacttgcagcaaatctggtcgaaatttagggtgaagcgaatcaaataacagatagtaaaaatagcgaatttgactttcttctccgatcaatttattatttttgatttgaatatcaaattccaataaaagtttattgagttctttgattttgcgaaacaaagtagattcactgagtagcaagagttctgctaattcaaaaatcatgtaatttttttgttctaaaaataagagaatcaggcgatatttgatactatcttggattaaaaaactgatgacttcatctaaggtttgtgattccgacatgtttagaacgagtttattgttctgacgaataacttccatgggttccccaatcatccgtcctatataagatatatcctccaaataactctgaaccgaaggtcgagagaggtttacccaatcacacagttcctgcgcagttagcttatcatgtttgaggaacaactgacgtaaaatcttaacctgtatttgttcttttttttcaagtaaaacttcaatattcacagctgttcctctttttctaaattaatattttttgtaggagttttcatattctcattctattttatcactccactatattttgttattaaaaattgctcagtatgaacatagtaaattggacactaaaaagaatatgaccaaaagccttattcttcttttaaacttgtatattttgcgactaaactataaaagtgattagataaacttagattataatctgtttatcaaacactaaacatgttttatattaattcacgataatatataaactaatataaccaaatcccttttagtaaatataccaatgaatcaataaaaaaataaataccaatacctaatataaataatgatattattattctagtgacattacttaatttttttcttcggttatttttatctaaataactacttgctattttaatcaatttttcatagatattaaatattaatgatactactaaagtatataaaggaatctgtcctaacaacatccaaattgttaaacataatattgttaatagtatattcccctcttttgcacttagtgccacctccgcccaaaaagtcggatctgacatagcccaaaacccaaaaataaaacctgcaagtggcatacttctctttgcaaatttcataaatttcgattctttctgatcatctactctttctttattttctttcagtaaggtagatcttataaaccaagctacacatacaatggatatcaaaaaaccggtaaatacataagccatatttggaatatgattcattatatctataaaataattcaagcttatactagtaccgtatgaaaatattaatccgaaaacgaccgtggaaagtagagccattaaagaaaataaatatacttgttttttctttgttccatttgctagtgcagccattataagcactgctcccactggatcaaatccaccgaatcctaacaaaattgatgatagtattaatttcatcgatcattacccccatgtatcaatttctctagcaacaatcttttaaatttttgtaaattcattaggcatccattacttgttacagactgattttattattatcaatgaaataataaagacactccaacatcataagcttttgtccaacacaagcatattccagcaaatagaattgataattaccagtaatcaactgagttctaataaagagggtaatgatcctacgactgtttgatggaacataatcgtttatcgttgctatgaaccatgcgaatcaactttattggtaatatatttagttactttagaaaaaagcctcaataggctttttattgtttctgtaattgtaaaacttgagcattatttatctctttaaaaagtttattacttgtttctttagaaattacatcagtttttacctggttcaatacaaattgatattcaagttgaaaagcctctatgagtaattcgtttggaataattgtatcttcttgaatttcgttacgaatacggtaatgtctattttccaaaatatgttttacttcttcaatatcactaaagtcagttatcttattttctgatcgctctttttcaagagaacttaatttttcgattgtttgttgatataaactgctttctagtcggcttatatcagttcttattgtcgcaaattcttgcatttctactgaatctactcttctgccacgtcgtcttttggagaataatcgtcttattttcttaccagttgaatgtttactactgttttctagataaattctaaaatagtcaataactttagatgaaaattgtgcttttatagttgttgtatcaagtaatgtttcctgccaacttattatctcgtccattaatttactactcttggtatggtcaggaatttgtaatcccttttgtgattgtagttgtttggtaagactactacgaactttactatcctcgatttcttctaccatatgaagaatcgcataatcaaccatatcgttacgaacctgattgatattatcagaactttcatctccaagtgccggtaataattttggcagaatcagtgttggtacaataagacttaaaagaataacaatagcggccattgtaataataatttccctgttctcgttgctcaaaatactagtattcaaaggtaaagagaaagccattgctaatgtcattgttccatgggctcctgacaaagcaaaaattgttgaatcactgttacgctcttctttaacatcagagaaaaagtgttcgattgatttatttctttttctattagtccaaaattttcttataaatagcataagcaaataaactaaaacgcttatcaaaaatagtacaattgattctttccaaccaagtgacttaaaaatgtcccaaattccaaatagacttacacccaagagaataaaaacaaagttattcagaatatcacttaaaatctcccagattgtattattcgttaattgaacatttgttgaagtcagtttgagcatatctccttcaaagttatgaatcaacccagcagcaacaacagctaggacaccggaagttccaaaatgttctgctaacaaataaataaagaagggggtcagaattgaaataggaattatggtagcttctggccgagttgctctgagattgattgccgtcctaattcgtaccagtagagcaccgataactaaaccaattataattccaccaattgagacaaatataaagcgaccaagtccttcccaaatactgaaatgcccactctctaaaacagataatcctaagctcagtaaaactaaccctgttgcatcattaaataaagattcaaattcaactgcttcattaaccccttcgggcattttctttccggaaattattgactttacagcaactgcatctgttggcgttacaattgctgcaaaacagatagctaaaggaaaaatccaactacccattatattattcgtaagcactgctaccaaaagtacagttaccactgctaaagtaattgatagaaaaaatattcctctaaaatttttacgtactttttttaatgaagttttacttccctcataaaacattaatggagcaatgattaacatcataaaaaactctggctccaattcaaaattttgaaattctggtaggaaactcaaaataaggcccacaccaatcaagataaaagtttctgaaatttgtggaaaaaactctttgattatatttgctccgataacaccattcatcatcacagcaataaaactaatagctgacataaaacaccatttcctaatttttatactcttacagtataacatgttcaagattgggtttccaagactagtattaaaaattatgaaatatacaagacgatttgtcattttcatagtatataaaaatattgaattagttatttatatttataatataatgataaaaagacatctattttgacgtctttttatttatttatttattttgatttggtcatgattttgctaaacattttaaccatccagtaaactatctcgatattcaatatttagtaattctttttcaggaaataaaaatctatctaaccagttttggctttcaaaaaaattgattttatcatgttctagcggatgatagtctttttccaaaaaattagataagttctctattgagtcctctcctaaaataaaaatattatcaggatgataaaataggtaatgcttgatggctttatttgttgtaactaattttttcttaaagaaaatagcctccattgttctcaaggtcaaacctgtctggttttcttgcataatttcaagaataccattactattaattaagaactctaaaaattttggatagggtaaatatcctttatttttaaaacctttttctccattaatgatataaagtaatattgaaatatctaaactggcacatttatctaaaataacatgtgcaagttgagttcttcctttatcatttcctccaaaaaacaaatcataatctggtatttgaagaggtaaatttatacaaggagtataaaaagtagaattatgatagagcccatatttttttgcttcaatagggtcaaaactatagtaggaatcaattactcctatttctctagaggtgtgcagcaaatcaatatatttttgagtcaaatgattccaaaaaaatagaatcatctttgcctcggtaaaatcctttataatattaggatagttagctttaaaaccagaatctaaaaatataataagctgataacgggcaagccggtgctttcccacatcactttttataaaatggactaatcggcgtcctgaaattacatcaatattatttaaggaatcgaaaaaataaagatgtgcatttttagctactaagagtattttgctgtaagaaatttctttcatgttctaactcctttcaattcagtataaattcattgtatgattaaatttcagaatattcaaaaatatcgtcttacaaaaaatacattcaccaatgatgatagtattatatttttgaatattctaattaattctaaaacattctgctgtctttcagattcctttttgtgtatactaattattaatagcgctagtttttagaaaagaattgtatcaatttgaaaaaggagaaatgattttatgaaaacaatccttcaagcttttgaatggtatttaccctcagattctcagcactggaataatataaaagagaatattcctgacttaggaaagttaggattttcaggattgtggttacctccagcttccaaggcagcttctggagttgaagatgttggttatgggacctatgatttattcgacttaggggaatttgatcaaaaagggacaattcctacaaaatatgggactaaagatgaatatcttgatttaattaatacactacaccacaacaatattaaagtgtatgcggatatcgtttttaatcacatgatgggtgctgatgaaacagaaactattgaagctgatattaaagcagaagataatcatcttcataacatcgaaaataataaaactgttgaagtttggaccaaatttacatttccaggaagacaaggaaaatacgacaattatatatggacctggcacaactttacgggaattgattatgacgaaaggaaaaatcaagaagaaattcttgaatttgaaggacatgaatgggatgaaaatgtagattcagagaataataattttgattatttaatgggggctgatcttgattttagtgtttccgaaacagtagaacaacttgaaaaatggggacattggttttcagaaatgacaaaaattgatggttttcgattagatgcaattaaacatattgatttcaaatattttgataaatggcttgaacagagagcaaagcaattagataaaaaactttttattgttggagagtactggtctgatgatcttggcaaattagagtattatcttgaacaatctggtgataaaatacaattatttgatgtaccactacattttaatatgaaagaagcctcttcaaccaatggagaatttgatatgcgtactctttttgatcacacactcactgccagccaaccagaactctcggtcacttttgttgataaccatgatactcaagaaggacaggctcttcaatcttggattccagcttggtttaaagagcacgcttatagcttaattttacttcgcaaaaaaggaactcctactgtcttttggggagatttatatggaataccctcacgtaatgttaatcctgtaggtgataacttgagaactatgatagcattgcgtaaggactctgagtttttaagggaaaatgattattttgatcatcctgatattattggatggacaaatattttaaaaatagataataaggaatatggattatcatgtattttaactaataaaaatggtggctcaaaatatatgataattgataaggcgtatgcaggtaaagtttatatagatttatttggaagacatgaaatacctattacgctggatcaaaatggtggagctgaattttacgtcaatgatggaagtgtttcggtttgggtagataaggaaattgtttcaaaaattgatcaaataaactttcaaaactaactattttatcaaataggataaaaaaagtacctctataaggtacttttttatttgaactattagtcaatcaatgaggtatgtttgatttcttcaatattttttgttccagcaagttgcatagtgatacttagttctttgtttaagtgttcaaaaacagattgaacacctttggctccccctaaattcaaaccataaagaactggacgacctaccgcaacaacatctgctccttgtgctaaagctttgaagacatgttccccacgtctaactccactatcaaaaataacaggaactcgatgattaactcttttagcgatgaggggcaagacatcaattgaagcaggtcctccatctaattgtcgtcccccatgatttgaaacccagataccgtctgccccggcgttaatggcgtcatctgcatcaataggagattgaacccccttaacaattacaggaagattagttatttttttaattttttgaatatcttctaaaacaagtccttgttttgctgctgcataaatttcgctgattcctttgccagttccatcactttccgaaaaagctgctaaatttggcattggtaaaggaaattggaaatgattgacaatatcttcttctcgatagccacctagtgttgaatcagcggttaaaataattgctttaaccccggcatctacagctttttttaaaagaaattcattaaatttatcatctttactcatatacagttggaaaaattgtggagcaccaggtgcagcttttgcagcatcttccactgatgtacttccataagtactaattgaaaagattgagccaacttcagccatcgcttttgctgttgcaacttctccttctgcatgagcaaggccttgtgcggcaactggtgcttggataattggtgtttttaattttataccaaagagtgaggtacttaaatctgcagaatcaactcctcttaatactcgaggcataatttgttttttgttaaatgctgatgtattttcattcagtgtccactcatcttcagagccaccacggatatacccaaaggcacctttatttcccgcagcctccatactttgtttcactttaccttcaagtgatttaacatttacaatttctaacgctttgttttcagtactagttttataagtcatcttagttctcctatttttcgtaaagtttacatctgtagatgataaatacattatacatcttattttaaaaaaatacacaaatgaaagatttattttttaataaactaaaacttatataaaaagataaattaaaaaagtagcaaaactactcttttatattatttatactaaaagatggtgtgataatgaaagcttcctattaatcttccttcctcctcttttcattttacaatcacgaattataaatttcattaataagttcttctgttttatcccaacccaaacatgggtcagtgattgattttccaaatacttctggtttgtcttgacgaccgtattcaagatatgattcaatcataaatcctctgacatatttatgaatttgttcatcccaattacgattgactaatgtttgacgaacaattcttatttgttccatatacttcttcccatagttatcatgattagtatcaataacaataaatggattttttaagcccattttttcgtatatttcgatactttcaagaagattatctgtatagtaatttggatggtttttaccattttcatcttgtcccccacgaaggatggcatgagctaatggatttcctgatgtttctacttcagcatttccaaatagaaaatcttgagattgttgggccgcatacattccattaaacataacttttaaattccctgatgtcgggtttttcatccctgttggggcatctattcctgaggcaacaaagcgatgttgttgattttcaactgagcgagcgccaaccgcatagtaacttactaagtcatcaactaatggtagattttctgggtatagcatctcatctgctgtagtcagaccagtctcagtaattactttatagtgaaggtcgcgaaccatttttatcccattgataaggtctgtgtgtccatctgcatcaggttcatgaatgagacctttatagccatctccgtttgtccgtggttttgcagtgtaaacacgcatcacaataaaaattttatcttctacttctttttgaagttttgacaatctgtgagcatattctaaaactgcagcttcattatctgatgagcaggggccaatgactaagagaattctatcatcttcacccttaattatcgcttcaagttccttatcacgtttttctttcttttctcgctgcacatcatttaaatgatttagctcttttacatctttaatgttaattttgttactgagttctttaaaagtcatcttttaccttttttctatcgttttttaataaaaatacttaataatattttacttgcaataaatttttctattttactttttatgtgcctcctttataataaaaaaagacgtcccaggggacgtcttctttatcccctagatgattaacgaacatcaaagaggacccacattttattagccaaaaactaatgtggatcattcataaagaaaaaataaaattttttaaagttgttaatcattttggaacctcgatatttaatattattagttagtataattaaaattttttgatttgtcaattatttatctattttttcttaattttatttcaaaatttctttttacataaattttattatgtatcatacggtaaataaagaggatattgaagcatggatggagtgtgctgtatttgcattattcatcgtatagaggtgaattccagcaacatcctctgttactaaatcaacgatttgatcgatggcataagcaattccagcatcccttaaagcgatagggttatgttcatatttttcgagtattctaatgaatttttctggtaatggcgtattacaattttttaatagacgaagaatttgatttcgattgattactggcattattccagcgaatattggagtatttatctcagcaattgcgcatcgttcttgaaaatcatagaaactatcattatcaaaaaatagttgtgtgattaatctgtcacaaccagcatctactttttctttcaaataatgaaaatcactcactcgatttactgattcgggatgaatatcggggtagcaagcacctaaaacttcaaaactatcatcataatctttgataaacttaaccaaatcacttgcaaatctaaaatcatctttcatcggttcgtcgctgatatcacctcttaatgcaagaatttttttgatatgtttatcttttaaccgttccaaaatttcgatcacttgagctttatctaaataagcggcaggtaaatgagcaaccgctggaatatctagtgtattgtttacataatcagcaaactttatagttgtatctccaatattatcataattattgttactacaagttacactgataaaatctggcgagagagttcttaggctatccaaggtctttaccaagttggtacttccaatttgagttgtaggtggaaaaacttcaaaagaaagaattttggaattacttgtcatattcaaccttttcctttcttaacttcttagttgcttcaactaagtgtcttaaactaggaatcgtttcggcattaccacgtgttttaagaccacaatcaggatttacccaaacttgttcaattggtaattttcccaatattttttttaattgattttgtatttcttttacgctaggtattcttggagaatgaatatcataaactccaggaccaaccaaagtttgaaaatggtgagcttttaatgcatcgataattgatagctcacttctacttgcttcaaaagaaattacatcagcatccatcgcgtcaatggatggaattatatcttcaaattcagaataacacatatgcgtatgaatttgcgtttccggttttactttagagtgaactaaacgaaatgcaggaattgcccaatctagatattctttataccaatcacttttacgcagaggtaacttttctctcaaagctgcctcatcaatttgaataatcttaatgccagctttttctaagtcaagcacttcttcttgaacagctaatgccaattgtaaagtacttgcttttaacgaaatatcttctcgcggaaaagaccaatttagaatcgttacaggacctgtcagcattccttttactggtttagatgtttgagattgagcataagctgaccaacggacggtcatagcttccggtctagtgacatcagcccacacgattggaggtttgacacaacgtgtcccataagattgaacccatgctttttgagtaaaaacataaccttctaacttttctccaaaatactctaccatgtcatttcgttcaaattcaccatggactaaaacgtctaatccaatatcttcttggagtttaagacattcttttattttttcttctaagaatgtgtcataatctgcttgacttaattctcctcgcttattttgtagccgaacttttctcacttctgccgtttgaggaaatgaaccgattgttgtgcttggtaaaagtggtaaattaagcgattgagattgacttgctcgtctttcgactagtgacggttgtctagtaaagtctttttctgttaatttatcaagtttttgcttaagtagagaattttcacgaactctttcattttcaaaaagttcgacattcttcttcaaaaaagaagtgtttttattaaaataaatatcggaaatttcatcaatttcatttaatttttctgtggcaaatgaaaagtgtttaaggatttcttttgataatttagtttcgtttttaactgttactggaacgtgttgtaaagagcagcttgtattaattacgatatctgctacttcatctaaagcggttagtagctcaagtgtcttttgataattattacgccaaatattttttccatttactaatcctgcaaaaagtattttctctttgggaaaaccgtatttttgaataagagctaaagaatctcttccttctataaaatcaagaccaataccatcaaaatcaagctttattatttctttatagctatcacgaacatctccaaaatatgtttgaagaagtatcttaaggttgtttttattcttaagtagtccttcataaatactcacaaataaatttttttcttcttcagtttggtctaaaacaagtgctggttcttcaatctgtaaccattctactcctagttgattaagttcttttagtagtgtttgaaaagctacaataacatcagataatactgtatctttcgtggctcctgacttgtaatctgctaaaactaaaaatgtatatgggccaataattgttggtctggtttcaaagccagctgattttgcttccttatattcatttaataattttgaaaaatttgctttaatagtcgtatctttgttaatttctggaactaaataatgatagtttgtattaaaccattttttcatcggtcttgcttttacgtcattttgttcatcttggaaaccacgcgctaatgcaaataaggtatctagttcacttaattctaaatttttataagactctggaattgcaccaagagcaattgataggtctaaggtttggtcatagaaagaaaagtcattggaaattggtgagtcaattccagcttctttttgacttttccaattttccaaccgaatttttttggctactgtttgtaattcttcttctgtaatttctttacgaaaatatttttcaagagcaaattttaattcacggtttgagccgatacgtgggaaagcaataattgattttttcatagtcatagtctccaatttttaataggtctatcttatcaaatttaataaaactttaataatacatttttagtatgatgacctatagtttaaaactataggtcaatcagaaaataataaaagtccaagtaaatttcttggactttttgtatttcattatcttctttgcattaagtgaattttatcctgtaaaaatggtggaataacaattgagctttctcgatcttctttaataattattgatttatcttctaatatatcgattactttaataagatgtggaagagaaatttctaattttttgaaaaagttttttccttcttcttctattgcagtaacatggtaggtttgctcaacttgtgtctcgtcaagagtcagttccacttcatttttcagccaaaatgattctgtaggaatttctgagccgtgagggtcagctgctggatagcccatcaggacatacagagattcaatcaaccttggtgatgaagcatgttctaaattttcagcttcatcgtggacttcctccattgtatacccaaccttttcaaaaagaaaagtttcccaaactcgatgactttttaaaataaatcgtgcttcgtgctttcctaattctgtaagtgataccccgtaatagggtttatgaataacaagttcttttttggctaatcgtttaatcatttcagtggcgcttggtgatgatactgataatttttgagcaatggcattaatactaacagatccattattttcactttttaggctatatatagcctttagatagtcttgttcattttttgatgttttcattttttttaccttacttttcttgacttaattatagcatagactataccaaagtaaaataaaagtgggataaattatcaccacttttattttttatttaaagtaattcaccgtattttgcaacaaatatttttttaaatatagtgacaagcatcatatacatcactacagttaaaattagccatgggaaaaagttaattggtaaagccattaaaccaattgaatgtccaaagcttgtgaatggaatgattgtgagtccaatgattcccatgaaagttaagattgttagtggagccgaagcacgactttgtagaaatggaattttaggagtacgaatcatatggataaccaaggtttgagtccacattgattcaacaaaccaaccagtatggaagagcgcgataaatccaatataagctgcacttccaggaacaagagagctaaatggtccaaatgttgctggacaaatcacaaagaacattagaagataagttgtaatatcgaatacggaacttgttggtccaatccataacatgaatttacttacagaacttgcatcccattttcttggaacaactaaatattcttcatcgacattatcccaaggaatagcggtacaagagaaatcatagattaaattaagtaagagaatatgaatagatagcattgggataaatggtaaaaatgcactagcgattagaactgagaacatattaccaaagttagaacttgctgtcatttttatatacttaatcatgttagcataggtttttcttccttcaataattcctttttcaagaaccattaaatctttttctaacaaaattacatcagctgactctttggcaatatctacagcactatctactgaaattccaacgtcagatgatttcattgctgctgcgtcattaataccatctcccatatagccgacactatttcctgaatttctaagtgttgttactattctggctttttgttgaggtgataacttagcaaaaacagaagcttccttggcaacctttgccagttcattatcatctaattggtcgatatcagaacctaaaatagttttatcaactggaagtcctacttgtttgcaaactgaacgagtaactttatcgttatcaccagtcaagattttaactgatactccatatttattgagtgctttgattgcttttgctgtagattctttaggtggatcaagaaaggcaagataacccattaacaccatttcagactcatcttgaaccgaaaatgtatctactggtgaaggatttgttttttgagcgactaaaatcacgcgcattccttcttcgttaagttcatcaacttttttcagaatgtatgctctgagttcaggagttaaatgaacaacatttcccttatcttcgactaaagtacagatgtctaacatttcttcagctgcacctttagtaatcatttgcggttttgaagtcgctccattagtattgctttttactacaacactcatccgacgtctttcaaaatcaaaaggaatttcatcaacttttgtatatttactacttagaccacccagttcaggatttttatcttgcttggcttcagctccttcgataattgccaaatccattaaattctttaaaccagtttggtagtaactattcaaaaatccatgtcttaatactcgaatattttcttgcccatgaatatctaaatgacgcattaatactactttatcttgtgttaatgttccagttttatcagtacagagaatattcattgaacctagattttgaatagagtttaggttcttgatgattgttttttcttttgacattgtgactgcaccttttgctaggcaagttgtcacaatcattggtaacatttctggtgttaaaccaacagcaactgctaaagcaaatagtgcggcttccatccaatcacctttagtgaaaccattgatcaacaagacaaatggaaccataactaacataaagcgaataaggacccatgaaactgagttaacgcctttttcaaaagttgtttgagttgagtcttcggttacactttttgccatttcaccaaaaatggtcgtatcaccagtagcaattacaattccataagcactaccagaaatgacatttgaacccatgaaggctaggtttactgattctgtgattgaatcatctttttcatcagtagctaaatctagtttttctactggttcgctttcaccagttaaagaggcttggctgataaacaagtcttttgcttgaataatcctaagatctgctggaaccatgtctccagctgatagatggataatatcgcctacgagaacttcttcaataggaatctcttgacttcctgattctaatctatgaacgtttgtcgtcgttgtaatcatttttaagagattctcagcagcatttccacttcttgtctcttgaacgaaacgcagaattcctgagattaaaaccattgtagtaatgataatgagtccttgtggatttttctcaccaggagctgctaagataatatccgtaaaagctgaaactaatgctaagacaaacaatataatggtaaaaggattgatgaacgcttgataaagccgtttaataagtgaagtttttttaccacgcgtaatcgtattatctccatattgttcacgagagatttctacttgttcttcacttaatcctttatttgatgttttaaatttttgaaatagctcctcttttgtagaagtttttgcaaattctaatcttgcatttatttcattgttatctacaaatgttgtagctctttttgtgttttcgagtgtttttctaatttttttcattggtctgtacctcatattctataatatttttgtgtgtacagtcccaaacgttaggcactttaaagaaggtgataaaaacggaaaattgctcttatcacgttaattatctgcggcctatcaggctcgggactattaatggtctgggattccatttccgtttttcacctccttttttaaatacaaaaaaccttgcctacaaaacttgaacgcaggcaagggaataattccaaaaaaagatatcactattatagagcgaatcagttacaagctatcgttcaagctttagctccgcagggcgatgttgttgcactatttcacgccttgtttttcgacgtgaactgttggccctctcatcgtgtctccacgactctgcggcagcaacccgtatccctgcggtagcctcacctaccgacggctatgcttatggcataaccaaaataattataactgttctttctatttttgtcaatctttttttattatttaatttatgatagactctgttgcaccattcattgcccaatcttttgataaaaataacgaattatcaatatgatagttgaccttacttggtgtcttcatgaatttttcaatcgctttgtctgtagctagccaacctttagtaccaaagtggacagtatcaccagaggcataaggtgtgttatacatatctgttaagtcagcaatttgataaaatccttggctgcgcaattgtgttttaattttagagctgaagttttcgagtgttgcttttgacactccagtgtaagatgaccatgagccatttactggttgaataacaaataaaacatcattattatttttggcaaacacatttaaaagctgttgaaaatcctgatactctggactttctaaataggtaacatgctttttaaaattttcaagatgtttgtatttagattttattttcctatcccaaacttggttattgatttggaaaggattgttatttgaactatcttttccttggtcaactgccaatttttctaagttttcagaggttggatcattgggtaattctttagcaaacttattaatttttggtgtaagtccaagaggttgtgctgtgaattgtgaaacacttgagaagagtaaatcttcttttcgccaaaattgaagattggtcgccacagtcattttttgtagagtggtcagtggttttttatctgctagacgttctagagaattataaatcgtctcttcagatttaagcgatctaaatcttaataaatgttttgcaagttgggtggtggtatttgctttagggtctgcttcttttaaccaaccgtaaatctcacctttggatacaaagtttttcaattcactttcaacaattccttgttttgaaaaccattgtggactaatgacaaaaacaattttacgattttttaactcatttgccacagagttcatatagaaaaagtgggttaaagtagtcgttcctggttgtcctactaagaatggcgtaaaaccagaattgtattttttgaaataggcacttgggtgaaaagaatccacatgttccatttctgatgaaccaagaactggtaaaaactcggggtctgaataggcttgttttttaattgaatagcctgtaaagcttggagtatttaggggtgattgagcaaatttaacaagttggtcttttgagtatttcattccaacatttattgggagaaatatcagtaagccaacaagggctaaagctgcaattaatgggccaatggctctaaaaattttaattttcatcctttttttcctgaacgcgtgctgctattttatttgctgtattccaatcttcacggtccatttctgatggtggaagactgatatcaaaagcgccttctaattcaacaatgagcatgatggctctcattgaatcaagaattccttcttcaaataaatccatgtctaagtattcacggaattcgtctgtgcctgatacggtttcgataatatcaaaaatttgttctttcatttttgtttctcctaatgtttttttatgatatgcctaaccacttttagaagttaggaagtgggaaatgtggatctatgcagtgcataatgatgtgatttggtattcctgagaaaataaggaaactgataaatactagattaaatgtaatgaaaatacttatagcacttgtccatttattatctggaattttccagtttttacgtttcttcagacgtttccatgcgtcatacccaatcattaacatagcgtggtagaaaccataaaggatgtaataccaagttaaaccatgccagaatcccatgagtaacatatttgcgaggtaaccaatatttgagatggttaccatatttttcgaccattttttaaccatgaatgttttcactaatctcatgaatacaaagtcacggaaccaaaagctcaaggtcatgtgccatctttgccaaaaatcatgaatattttttgctaagaagggtttgttaaagttatgtgggaggtcatatcccattaaattgctgacaccaatggcaaagagcgagtagccagcaaaatcaaagaatagatagagtccgtaagcatacattgatgatgaaacattcaagaagcttgggtgtatcgttgcagagattgcaatgccatgtagccaatattggtcaatcaagtatccgatgatgaatttataaaggaaaccttggaaaattctaaagactcctttatttaataaatcaaggtatttctcagtgacaactggcgcttttagttctttaacaaaacgtcggaagcggtcaattggtcctgatgaaatcgttggatagaaatagagaaaatatagaaattctttaagaggaacggctttaataagtccgtctcgtatttccataatcatggctactgtcttaaaactgatgtaagagattcctaagaatccaagaattgaacctggtccaggtcctggattgaacagaggatgcactttgacaatcactaatggcaaaatagagagcagaatgatgaggtagaaaacgaaactctgattcttgttttgttttactcgataccactcatagaattttacaatgatagtctggaagactccgaagccgattaatgcccaaattgtcactgttcctgaaaatgtcagccaaagaaaagcgatggtcaataggacttgataccacatgagttttttacccagaagctgggcaataacgataggaattaaagcaagtcctaaaatcacgaagtaaaagggtgttgaatagggttgcactagttgtcacctcgctctttttgggcgagtaccttgcggtcaactttgccattttgattcaatgggaactttttaagataaacaaacttagttggcatcatgtaatccataattgtttttgaaagttcagctttgagttcttttgtgaaggcgcgttcggctgcacggtcttcaaattttttttctgtttctaaataagcgattaatgcggtgactttatgctggtcattcgttttcggtaagactactgctttttcaatctcttttaagttttgaatattggcttcaatatcttgaagttcaatacggaatccgttaaatttaacttgaaaatcaattcgtccttggtaacgaagcattccgtcagcggaaattgaaccggcatctcctgtatgataagcgggttttccgtcgactgtgaaaaaggcttgctcagttttttctggattttcaaaataacctttggctaccgaatcaccaacaatgatgatttccttatccataatttttaagtcaacacctggtttggcaaaaccaattgggacacgatcattttctgtcagtaattctttcgtaattttcactgacgaaatggctcctgttgcttctgttggaccataggtattatatatatttgctgacggaaaagctgtcagtaatttttctgctgttttctttgttaattcttcaccgcagaaaataaattgaactaattgagggtgttctttctcagtgaacgaagggtccaataagcaaatatcaacaaatgatggtgttgaaatccaagtattaatgaccgttttgttcaaacgctcaaagagtaatttgaagttggttgtttcgtcacgtgagagtgaaattaatgttccgccagttgtaagacttggatacaagctgaaaattgataaatcaaagctgtaaagggcttgtgacaagatctgattattttcaattttcataaaatcattgttcatccaattggtgaaagtcacaagattatcatgactgacttcaacaccttttggtactcctgttgttccagaagtataaataatataattgctgtcatttccagaaacagctttcgaaaaatcaagtgctggaagtttgtcagtcaaaatctggtcagtaagttcaagagaaattctgtcagtaaaaagtgcttcaaaatctgctgacagctcaactgttgtgagtaccgccgctggttttgctgctgatttaatcatttctgtccgctcaaatggtgtgtgagcatcaacaggaatataagcgtgaccagttaaatttgtcgcaagcatggctgctaaagtgataaaatcgtttttaccgaaaatcaagattgggcgctgattcaaattgctttcattgatttgttctgagatatgtgaaaccgcggcaaataattgacggtaagtaaatttctgctcacgctcggcaagtacgataaggtctggttcattttttgcaatttcaaaaatttgttctaataatttcataattaattccttcaataattctctctaaaattcgttatagataaagtgcgctccgccagtatgactgtaggaataaagatagagcagaattaaaataattataaagtaaaatactgttttagccaaaaatagacgaatttcttttttcttgtccattggaactccttttaaatataaatcaataagaggttttagaatactcagttaatctcatatcatttatgactctgattataacatttattaaagaaaaaaaacttacatttgtgtaagtttaatttatataataaaaagaaaacggaatcattttgttttgttgtatttttaagggtacaacatctttttcatctaatattttgcttaattttttgaaccatatttttgtaatttttggattctgtcagcaaagaaattaccgcaactccacccagaccaatttttgaaagctctgtcagtgaattttcagtaattccaccaattccaacagttggtaattgattatactcaagcatttttcttaaatggtcaatcccaattggttctgctgcgtcggacttgctatttgttggataaattggaccaattcccaaatagtcagccccactcttttgagcgctttctaattccatatcattactgacagaaagtcctacccacatttcttggccaatcagctcgcgaattttactgacagaatcatcgtcttgtccgacatgaatcccgtcagctgacaattcacatgccaattcaacatcatcattcacaataaaagaaacaaccgctttctgagctacttcttgtagtctttttgctacttctaatcgttgatttttatttttataaattgtacccttatcacgaaattgataaaccgttactccactttttatgattacagaaattttatcgactgcatcatcaattgaaagttttggaaaatcttgtgggccagcaataaaatacgccctcaggtctaaaattttatttttcattaattgtcacccaatggtttaacggtccatgaccgtgaccaacattaattgtttgtgaaatagcttcagtaataaacaatttagcttttggcatcacttcttttaaatcttctcctaaagctaaatgagctgtaatataagaagaaagtgtatctccggttccgtgtgttctttctgtcagtaatcttttagagtcataagtactaacagaaccatctgtcatcaataaataatctctgaccagttctccattgccatgtccccctttaatcagcacatttttagcacctaacttttgaatatcatgaagggcttttaaaatttccttttcgtcagtaattttatagccacacataacctctgcctcttccaaattgggagtgaccaattctgctaaaggtaacaattcattttttatcaaatcaatggcttctcttgtcaaaagaattgccccgcctttagccaccattaccggatcaaccagcaaatgcttcggtttatattttttcaagccttgaattaccgcttcaacttgagcagtatcaaaaagtgcccccgttttagctgccgaaatttccaaatcagaaaatacagagtcaaattgagccaaaataaaagctttatttgtcggtaaaatttcttgtaccccataggtattttgcgctgtcaaccctgtcacaatcgttgccgaatatactttttgattatgaaaagttttcaggtcagcattaataccagccccaccagaagaatcaattccagcgattgtcacaacttgagaaacatcaatcatttctttttctcccttatataacctcttgcgtcgcttgataaattttatcaagaagacgattcacaaaatttcctggtagattttctacttgctcagtagcttgcacaccagattcaccgaagaattctgtcgcttcatgagccgccttaaataaatcatcagatacagccgcaaaagttccaacaattgctgacagcatgtccccacagccaacattaattttaaaaagtggactatcagtttcaacaaataattcctcaaacccattagaaataacatcaacttttccagtttgaataatgactgcccctgttttttgagcagcaactcgcgcgtgctcaacttctaaatttgactcaagtgcatcaattcctttgttcaagctttctttatcagcaaaccaagcaatttccgctgaattcccacgaatgatatcaaatttcacctcttgtattaatcttttgacaaaatttgctctaaaagggacattgacagcaactgggtccaaaattaaaggtttgtgcttttgatttgctaactgacaaatagtcaaaaaaagcggataatccttttctgaaatggttccaatattaaccactacagcatctgcaatttcaactaaagtttcactttctgaaatttccgcagtcattaatggtgaaccaccagcaaaactaatcgcatccgcaactctttgtggagttacaaaattcgctaaatttaagataagtggttgtttttcttgaatcttttctaaaattgacatcaaaaaactcctttattaacacaaggagggctctagtatgataagaaagtaagctaaaagattttcataaagaaaatacaattaaaactcggacacattcttacgcaggtcttaacctgttcaagtctgatggtctttctcaaccggtaattttagttttaccagtacccattgtgtgattgatttatttttaaaactacaactactttaacatatataaactaaaaaaactaatttcgcagatctacaaaagaaaaaacctagccaaaaaggcaggtttttcttattttttatgctcatcaatatgagggtcaacactttcttcttgccgattagtttttacccaatcatttttagagttgaaatatcgaatggctgactgcggataaatttgagttaaaataagtagaaatttcgtcagattaacagtatctttcactacatcccacacccttgttttttcttgagattttcctttgttataaagaatagcccatacaaaattcacaaagataatataaattgacatcacgataaaaagcaaaacaacaattttaagtgattgagtaatccctgataggatagcagaattaacaatcataatcagtgtataaattacaataatatattcaattcccattagccaaggtttcagtaaggtcatcaataattcaaacttctgtttattctgcaatttttttgaccgaatcgtcggcaaaatatattttgaagattgaatatttccctgtgcccaccgcactcgttgtttaaccaaagcctcattatcattgataatccctgtttgttcaatgtaaatatcatcgaattgagcatttttaacttcaatatctgacagaaagagacgagttgataaatcaaaatcttcaacaagtgaatctgtccaagggtcttcattcaatgcctgaagagtacttaatttacagaactgtccatttccaccaaaagcaactgtattggtcaaagtccgaaacatctgtgtcgcattgataatttcagaaaattccaagtcttgtgaagcatctttaagcaaattggtaacacgaaccttggattgcaaaccagtaagctttgcatcatgattgaaagccatatttactttttcaaaataattgttatcaagttttgtatcggcatcaattatcgcaataagaacatcctccggagcaattccagcttcttgaatttgctcactaatttgataataagcccaattcaaagccgtcccttttcctttttgcgcattaggtttaatacgtcttagaacattcaatcgagaatcttgaatttcagaaattttttctaagctccgatcatcacttgcatcatcaataacagttactaccaaattctcataattatttttcaaaatacttttcaaagtcgtttgaataaccaattcttcattcaaacacggaatcaaaacgtaaatatgaaattgtttttttattttctcatctttgaaatctaatgccgttatcttttgtcttttattatatgaataccacaaaataacggcttctaccgtaaagtaaagaaatacgaaaactgaaaaaataaagaaaatataattgatacggtcaaaaatatcaaaaaccaaatagctttgtttccaataatgatatcttacaatatataaatagaggaaaggcaagcttgaaccaatatatagtaagatcttcgttcttggtctgataaattttttcaaacctgtatagattgtcaaaagcataatcacaacaacttcaaaaatttgtagcgcaaaataactattgaaaattttgttattaaaatgaataaaattagttggtggattaagaaggaaaagataagcataaactcctagaacaaccagtattaatacataaattggttttaatgacagtatctttttctttgatttttctcctttatatccaataactaaagcaaaagcaataattggtaggacgaattgagaaaatacagtcaattcttctatccaatgtgccaaaaagacattataattaagctcaatgctattaaagaaaccttcttgtgcaaaattaaaggtaatatttacttgagttcctgaataaacgattaatgcaacgatgtagacaactaagagcacataaaccgtatatttgataatctttcctaattgtttggcatcaatcccactaaatttacaaaaactcaaatacatgattggcataaatggtacgatcagatacctgatatccatattactgacaatcgagaaatcaaacccctcatgttcaaccaagaatttaataatgaattgaatcgttataattggcaatgtaacgaaccacaaagaagcaatcaatgttgccaatttataaattaacctcttctttgttgaaacataataagctaaagcacaacaaagtaaaatgaagatagcaattaaaaatcggaaggaaaataactgtggaacagcatgttccccacctatgaggtaagtcaaggagacgattaagcgattggaaccatacatctggaaaccaaagacaccgagaatactcaaatttctaactgaattcggaattttttcgctatccgtaatgataaaaaatgagctaagcatcaaaggagccacaaaaaaagaatggtaaagaatttttctctagaagtaaaatttgataagcggaaaataaactcaaaattaaaaaggaagataaaaatgagacagacagactggaaagactttaaattaatttttttatttttcatttagaatattaataatctgtaaggaagtcgttccatcaccataaggattcttacttcctgacatcctttcatatttagtcttgtctgtcagtaaagtccgagtctcattaacaatattttcttttgaagtcccaacaagctttaaagtaccagccagtacaccttcgggtctttcagttgtatcacgtaaaacaagtactggaattcctaagaaagccgcttcttcttgaattccaccagagtcagttaaaatcaattcggcatgacgcatcacattatgaaagttaattgtatccagcgggtcaatgattttaatattactatgttccagtaatttttgcgctttttcacgaatgattggattcatatgaattggataaatgattttatgtgtttctttaaattcatcagcaatctctgcaattccatcaaaaatttcttctaaatcactcaaattttcacgacggtgagctgtcactaaaatcattttcttgtcagcttgccatgataaagcttcatttgtataatcatcctttaaagtatactgaaacatatctatagcactgtttccaactacaaaaacctgattttttggctttccttcttttaaaagattttctttcgtcatttccgttggtgtaaaatgataatcagccatcaaaccaacaatttgacgattcatttcttcaggaaatggtgaaaatttattgtaagttcgcaaacctgcttcaatatgtgccaactttatctgattaaaataagcaaccaaacttccagacaaagtagctgcagtatcaccatgaactaagatgatatctggttgttcctttttaataattgggtcaagaccgctgattgatcctgccacaatttctgataaaccagaatatttttccatgatttttaaatcgtaatcaacttccacagaaaattcatctaaaagttcattgagcatttctttgtgctgccctgtgttaatcagtacaattggattcccttgccttttcgcctcctggattactggataaactttaataaattctggcctagtcccaaatataaaaagtaactttttcatctctacctcaccatctatttttaaaaatatactttttgcttcatctagaattattcctgttgtagtttatttcctattttacatctattctaatagatattggtttcaagagcaaatatattgcatagaataggattaaatttggaatttattagcctattaatctattaataaaatacataaattaattaattttgtaattattacctgacaattattgattatatctgacaaaataaattttcattagcactttattaatcttttgtagatagtcattgtcaaaaaaaagagataaattctccttctttaaaatatattcaattgaaattttgtgaattttgatttatttttaagtctgaaaagacaagatattctttaatctctaaacaattattgaaattaacagtaagctcttcacattaaagatacacaaatcattatcgtttataataaaaatattataaaataagattataattataaatcaagcttttactttttaatttttgaatgatgagaaaggagtctcctatgaatccaaacaagcaatcaacaacttttaactattattttaacatcactgataaaatgaaaaactttattaaaaatagtggcactagtccatctgtcaagtttgaaaatagacaagattatcagcctatttttgataataagcgacaagtcggattgacaatcagttcagacgctagtcaaacagaacatgaaattgctgatttttcgctcactctgcctggttaccactttgaaggttggaaaattgttcgcgatagtcattatgtgatcccgcataatatctcccgcgagcaagctgcactctacgctggtgaaaattctgccttgcacaaaacaggaataagccccgatttcctttggactgtaggtgattatcttcaaaatgttggtaaagaatatgatttatatgcccagtggactcctttagaatacgaaattcgctattcttctcgtacaataaacaaggtcgaactctcttggacccacccctcagatgtacgaacagttgaaaaaaatttcattccctatctaaaacccgagttgcgtggctacgagtttgccggttggacaagcatcgtcgattcaactgaacaaacaatttttgaaccatatacgattattcctgctggtattgggccagttaaactaattgctctatttgaagaagtattttgaaaatttgagactcagagatagcaaaaaaaatactaccaagaaaagacttggtagtatttttaatagaaaatcgataatattcaattttctttttaaacaagaataaaattcttatttaagtgtgattgaagcaccagctgcttcaagtttttctttgatttcgttagcttctgattcagaaagaccttctttaatcattgttggtgcaccatcaacgagttctttagcttctttaagtccaagaccagtgattccacgtacttctttgattactgcaacttttttgtcgccagctgctgtcaattcaacgtcgaatgaatctttagctgctgctgcatcaccagcacctgctgctgctgcaactggagctgctgctgttacgtcaaatttttcttcgattgcttttacaagttcagaaagttcaaggattgttgcgttttcaagttcagcaacgatgttttcaatgttcaatgccattttaatattctcctattaattttttagtttgttgcgtaaatccgccgatataagtaatgttgcttataattaagcagctgattcttctttttctgcaacagctttgactgcaagagccacgttgcggacaggtgcttgaagcactgaaagaagcatagaaagaagtccatcgcggcttggaagagacgcaatagcttggatttcttctttagaagaaactttaccttcgataacaccagctttgatttcaagattttcagcatcttttgcaaagtcagccaaaacttttgctggtgctacaacatcttcattagaaaatgctactgctgatgggccagtgaatgcttctgacaaaccttcaagaccagctttttcagctgcacgacgcaaaactgaatttttaacgactttgaattcaacgcctgcttcacgaagttgtttacgaagttgagtatcttgatcaactgacaaaccacgtgaatctgcaacaacgatagatgctgcttcagtcattttttgtgcgtaaacatcaaccaattctgctttcttagcaattgttgcttcatttactttgtaatcgctcatttttttacctccattttattttggttgtagaaataaaaaatctctacacacaaaagacatagagagttcaattatcattttgatatttgtcctcggtaggaagtttatgactttcgtcccctactgtcttcggtcagttcttttagaaccgtaaataagtatatcaaagtttttctgaaattgcaagactaaacttattcttttttcttttttattttagttcatgcaatgttcttttggttttttgaaagatgaaaaaatttgacattaacaatctttttttccttttttattttctctttgctatcattttctatcaatttctgtgaaagccataaaactaattcataagcaattgcaaaaattgatccaattcccagtattggtaaaatttctcttatccaattcatttttaagccctcattttaatctataatctgtgattcttcaatttcttcaaaattatcaactactggtccaataattcggaaattatcttcctgtcctagataaaaatccttgtattgtggatccggattgagtgaatgaatcctaaattgtccatcttcttcttcaaatacttgtttaatatacaaacgttcttcgcccaaatctccttcagcaatggcgtaaatatccccactgcgaccaaaacccgtgtgtaagaatgttgcaatagaaaaattagggaattcaggttccatcgattccccttttactctggctgcaccatcatatcgcccaagagtttcagacgtgtaagctttgtagtggcctcctgtattgctttgagattgaccaaaacctgccgataattcttcatcttcaacaatggcgtaatctaaagaagaacgtctgtaagttttcaaattaataatctctgttttattttgttcaatgagaaaatccgtaaaattaataactgattcttgttgttctcctgtcagtgaacgataattatcgattaattgtttttctgcattattatcagtttctttgattaattcttgaataggtaaatcatagatatctgctagtttttctagtaattctaacgttgggttggttgatttttgttcccaaagtacataagcattttgcttcattcctagcttttctgctaattgactttgtgtcaattttgcattttttcttaatttttttaagttctgaccaaaattcataaactctcccttcccgattctttatcaatctttcttatattatatcgcttatttcattttttgtcaatattttttatcagaaaaactgataaatgaaaaaccgctgctatcagtggtttttcatagttctttttgtaacgtttgtattcgatacatgtctgcataataaccattaagtgctaaaagttggtcatgatttcctcgctcaataatttctcccttgttcaagactaaaatctggtcagcatctttaatcgttgataatcggtgagcaatggccattgtcgttcgattttgtcgcatatttgtcagaccttcttgaataagcgcttcagtttcagtatcaatattggctgttgcttcatctaataagagaattttgggattacgtacaattgtccgagcaaagttaattaattgacgttcaccggccgagaaggcagctccaccttcaattactttggtttcgtaaccattttccaaatctttgatgaatttgtcggcttgaacaaatcgagccgcttctttggctgcttgatcagtaatctgtggattcatcattttgatattgtcagtaactgacgcaacaaacataaaggaatcttgcaatactaaaccaacttttttccgaagttcttcttttgaataacttctaatgtcctgatcatcaatcaaaacttgaccttctgtgaattcatagaagcgcataaagacattgataatactcgattttcccgaacctgtatgacctacaaaagcaagcgtttctccagggttcacaatgaatgagatgtttttcaaaacttgatgttctccgtcatatgaaaaactgacattgcgaaattcaatttttccttcttgaatgattggaaaattgctgacagattttctgtcattaaatttttcatcaacatttttactgacagaagttgaaattccttgttgtggcgcaaattctttttcttccatgattgtcttaatgcgactagaggccaccaatccatttgaaaagtttgataaagaatccatcaatcctgaaataggattaaagtaaatttgtacattactgatgaaagcataaattaaaccagcctcaaccactgcatgtagacttcgattagaatacatcaacaagacaacaactattgagagggccatcaaaaaattaactaaagggctcaacaaaatcccattaatctgaatcactcgttttcgataaccataatattcatcatttgttttttcaaattcatttcctagtctgctctcttggcgaaattgttgaataattctcatcccagaaatgtattcatttaatttcgtattcaattctgaacgcttagcaagcatggcttgataaacttttgtactcactttttgataaatcaatactgccaaaatcaataggggaagaatcaacaacatcacaagcgcaatttggtggtcaataataaacaaagcaatgaaggcaatgataatagaaagcaaacttgttaatgcattaaacaaagtctgccagaaatcaaataaatcagtgtcatttgtgattctggtgattaaccaacccgtcggtttttggtcaaaatagcgcatgcctagctgatgaatttttcgataaactttcttacgaatgtattgattaacaaaaatcgaaccattttgcagataattccatttgaaaaagaaagcaattgaattgattattgctaaaatcaaataaagacctgcaaaatagaagataatctggtcagtcgctttcataggtgtcaaataggaatccataaaaacagacaaaacaaaaggcataagtgaagccagagaagttgtcatcacactaaaaacaaaagcccaaataaaatactttttgaaaggtaataagaatttgaaaataaatttaaaaacttgccaactttctctgacagacattttgtcagtagatttctccattttcttctccttcccgatttactgacgaacctgtcagtaaattttcatctttatcagtcgctgccaaatgactttcaatctgttgcatttgccacatttgagcataccaacctccagatttaatcaaagcttcatgcaagccacgctcaatcacttttccttcatctagcacgataatttcattagcttccattactgatgacaaccggtgactgacaaccagcgttgaactttcataacgtaaggccttcagatttgacaaaattaactgttcagtcttggcatcaacagctgacagcgcatcatctaaaatcaatattttaggctgaataagtagcgcccgcgcaatagataacctttgcttttgtccaccagaaagtgaaacgccacgctcgccgaccaaagtatcataaccttcaggaaaagcaataatatcctcatgaattccagctgttttggcagcaatttcaacttcttcttgactcgctgacatcttagcaaagcgaatattatctctgacagacatcgaaaatagaaaatgttcttgcggaacataaccaatcgctggcaaatattcatctaattgataatccataatatcatggtcagcaaaagtaatatgtcctttgtaatggtcaaactctctcattaaaagtttaataatcgttgattttcctgcacctgttcgtccgaccaaacctaaaacatgaccttcttttaaattaaattgaactttctccaaattgcgcccttcattctcatttggataagtaaaactttcaatatcaaaaaggagttgaccttcttttggcattttcaaagtaccttcagaaatttttgattccgctttttgagctaataatttttctactcgactgtatgaagctcttccacgttcaataacattaaaaagaacaccaatagcaaacatcggccagaccaaatttccgatataagtcataaaagcaaccaactgaccaatcgttaaaacatggtgaacaacatagtagcctcctaaaagaatggttaaagtataagataaaccaacaattaaagtgattaaaggatcgtacattgagtcaatccaattgaccctgataaaggctttatcaatattatctaacttaacttggaaatcagccatatcttgttcttcttcaccaaaagatttgattgctttcattcctgtaatcgattcttgaactttatcattcatttcagagaaggtttcttgggcatgttcaaaactcacatgaattttatcccctaaaactttagatactagcgcgagtaaaggcaaaggaaggacagcaataattgtcaaacgccagtcgataaataagagcatagcaatgattgtcatcccgcccgtcattaaagaatctgcccaagtcaaaacaccaagtccagcaacactctgtatcgcttgtaggtcatttgtcgcatgagccatcaaatcgccagtccgatttctctgataaaaaagggtatccattcttaaaaaatgcctaaaaagccgactacggattattttttccagtttaaaggcttcaccccaaatatttgtagaccaaagaaaacgaaagccatattcaatgagtgcagtaatcaataaaataccagaaaaactcaaaattaagggtaaagtcaggttacgcttaacaatatggtcaataatttttccgataattaaaggcgggatcaagtgagttaaagaaacaataaaaagggctaatagaccaacgccataaccttttctctctgccttaaaaaaccaccataaatctttaaaaattttcatacagtctattccattttattttataatattctaaatattagtataccataaaaaaagcgtttaaaacaccttatttggttgattatttacttaattttttaataaataaaaggattttatattctacaaaatcctttacaataactctatataaaattaaagaccataccaactaatttgttcgtatctccacccaattttgacaagcgagtctcgttctgcactactcgaagtataaaaatgactaatttgttttcctttagcattaggattaaataaacgataaattgccgtatgttttgcggggtccgagtaaaaagcgatttgttcataacgccaacccgctttaacaagcgaatctttttcataagaggacaaagtataaaaatgttcacctgaattagggttatagagccgatagaccgcattgccagttgccggttgttgagaattaacaccctcataattccagcctacttttgttaaactaatcacctcgttcaaatttttagtataaagatgttcaccattatttggattgtaaacacgataaagggccgtcgctttcaatgctggcacgttattttgaatccaattgatattacttgcagtgagttggacgccgtagttgggatattgtgaagcgagagaggaaggaactttgctgttatccccatttggatttgggttcagatactgcgcctcggcaacattaataccaacaatatttttacttgtattaaaaacagggcttccactttgaccaggatacatactgatgttggaatagctaaatagaggattaccaatttgagaaacatttcctgacattccccacatttgtttaggcttgtcccccggaaaacctatcaaagaaatcgcttgattttttgaaagaaccgagctcatccccatccagcctgttgataatcctatatttttcgaaaggttaagaattcctaaatcgtctgcacctaaaggataatttatcgttccaagtctatcttttgccaaccaatctggattagcaacttcactcgttacagctgttgccgcattagaattataatttccatttgcaaaagcttgataaattgtagcagatttaatatggccaccttccgtcgcattatatatcatgtgtcctgctgttaatacagcattcggtgcaatgataactccactccccctatagcgaactccatttcctccaattgtttcaatatagactattgtgttataaggaaattgattggctgttgaaatcagtttgcgttggtcaggctggtagacattacttgccgtagccccaccagatggaataaatggcaccgtatccgcaaaagtactagaagaaattaaaagcaaagttgaagcaagcgtgatatgaagtttctttattttcattattctttttcccttcatcttaaacagccttagctggtccagtttgtaaaggctcaggtgatgtaaatgaaaaagcctctccttcatcgtgccaaccaatttttttcaaatagtctctttcatcccagttagaagtatagaaatgttgaccactatttggattataaagtctctcaaccgtcgtttcttggttccacggtatgaccgtagcatcataaaatacaattccctcattcacccatccataatttttgagttgaactacttcattcgtatttattgtgtagagatgttgaccgctatttttactgtacaaacgataaacaggaattttatcataattttgaccgttcatcgtatagtatgaagttccaaggactccctcataaccccagcccaaatggacaagattatttttctcggtaagtcccattgtataaacatgctcacctgaatttggattataaaggcgataaactgggccattaaagtttgccgtaacagcttttgccggtgttgcttctttgattgataaacccagtccaagtaaaagcgccccaaataagagtccggttttgaaaagttttttatgtgtaatatgtgtgttcataacaaacacctccttatcgttaatagctaaaacagtaatagaaatacatttgtaatcttttggttaattcgttattttgagaaaattattttctcaccatgagtatagcgctttagtttgaattaagcaagaactattttttagttatttttatccttatatataaaaatgtaatcaaacagaaatattattcagggcttttgtttatatcttcaatgctaaaaatatatcataaaattagcaaataaaaaaaccgctaggaaagtcctagcgagtgtctattcgagagtgaaatacttaattatttaaattaagcattataaaattttacgactttgtttttcttgaacactgcaacaatcaatccaaataccagagcaaagatgatgtactgcaaaacattaaaaggtaaaactactgtcaaaagataagttggattcaaagtaactgatagagaacccatattaaaaagatgagttgctccaacaaaaatcttatcaacatcgaagccagcagctaaacgatagagagggagtgcgtagaaaacattcaataccatcatcacaagaactgatgcgatggctgctaaaactacaccaactgtatagtttttgattgagaattttttctttgtaaagaaccaaacaattgccatgaagattcccaaagcaatgaagttcatcggcacaccaatccaagttgatggaccttgattaaataggagataccataagatagagcgaataaagaggataataaatccatcacccaatcccaaagtaaagactccaataagtactggaatgattgagagttcaactttcataaaatcaattccaggcaatagcggaaactgcaaaatcggcaataataagattgttgataatgcagcaagcatggcaattaataccatccgacgtgttttagacataaaaaaacctccaaatatgagaaaataattcttcaaatttcgaggaagttgatagacatttttggtttggctaaaaacagtaatccaaccgaagttgattacactacaaaaattgttcatcttcttccatccagactttactgtcgctagcagattctcactgcttcaatcgccgtagcgaatcgcggagtcataaggtcaaagccctatttaccgccggtcccgaattacacggtgccctgaagataattttattatagcacaaaaatagtttgcttatcaagaataagatttgcttaagaaataaaaaaacaactctttatcagaattgtcttttataataatcagttaatttccttgggctgcattaatcaattgagaaacttcttttttactcaaacgacgaaattgtcctgttggaagtccatccaatgtaagagttccatattgaatacgactcaatttttgtactggaagtcctgcagccgcaaacatttttttaacttgatgattttgtccttcatggatagttaaactaacaatcgaatgattttttgttttctcttgtttgataatctcataacgggcgggactaacttttttaccttcaatagtcatacctaaagttaaaggacgcaagttttctttgttcgcttggccttctaccttagcaacatagaccttatcaacgccatgacgtgggtgagtcattatattcgtaaactcaccgtcgtttgtaagcaaaagcaaaccgcttgtgtcccagtccaaacgtcccacaggataaatacgttctttaacttgaggcattaaatccattaccgtttgacgtcctttgtcatcgctaactgaagaaatatagcctcttggtttatttagaagataataaacgggttcttcattataaactgctactccattaacttcaacgatatctccagttgaaacttgataacccaagtttgtcattggaacattatttaccgttacttttcccgctaaaattagttcttctgctttacgtctgcttgccacacctgcatgggccaaatatttattgattctcattttcttcactttcgttaaataaggtttgttcttctgcgataaatcttgactcatctatttcaggtaattcatctaaatgattaatcccaatatagtctaagaaaaattcagttgttgcataaagactcggacgtcctggtgcttcaacttgtccgaccttttcaaccaaatcaaaagcacgaagtgttgagagaacacctgaggaattcactccgcggagctgatcgatttcgagtcgagttaaaggttgcttataagcaataattgataaaacttcaagagctgattttgacaacgattgattaagaggagttttggcatagtttttaagaatttctgcaaactcttcttttgtagccatacgatatttacctgcagtttcaataatcgttaaagcagattcttcatcagaatgatatttttcttttaagtaatcaatttgttgctgacaagcttgtttagacatttctgtcaatgctgacaattctgccaaggttaaaccagcttcgccagatacaaaaagtaagagttcacaacttgctgtcttattcactagtttattttctttctaaaataatttctccaaaaagctctccttgagaaaaagaaatctgttgatttttgattaattctaaaagagccataaaagtggtgacgagttcatctttattagtagagctaaaaaacaaatctgaaaatttacatattttttgttctgtaaatctagtacttaactctaaaatcttatcagcgattgtaaatttctcagctgctatttttgtattctcgtcttgaaaatgttgtctttgcaactcaagaattttagtaaaagctagaaataaatctaaagcagatttatcctgcaaaagtacagtttcatcagtgataatttctgtcttagcttttgaataaaaatgactacgttcctgatgaagttcatctaaatcttgtgacaacattttatatttccgatattcatcaatttgagccaataaatcatactcaagttgttctgtatcttcaataaaagtttcggtaactgtcggtaaaagtcttcttgatttaattaacatcagttgacttgccattaacatgtactctccagctacttccaattcaagttctttcatggtttgaatatagataagatattgctcaataactggtaccaatggaacttcaaaaatatccatttcatactgacttaccaaatgcaataaaaggtcgagaggaccctcgaagtttttaatttttatattgatttctttaatcatattttacataataaaaatagtgtaaattcctatctataatatttttcaagcgttgtaatagttgttaaaccaagtagagttgccagttcataaattgactttcctgttttaacctgatgcaagatatactgttctctaatttctttggaagaatagttcgtaaattttttcaattcagtataaagaaattgacgagattttgcgaataattcatcagcattattaatggctttaactcttatggcaaatttttctctaattggtaaaactcgttttattccggctttttcaatcgtgagatatttaaagttccaattaaaattttcccatttcaatttttgtatctcagcaaaatttaaaccaaattctaaaattaataaggctaaaaattgtcctggacaggtcaaaggaccatagaactcaggaaattccttaatcattggatgataactttgagcagtctgtgattttttttgaacgacttgtttaattttaaagtactggtcaactttttgtctttgatacaggaaaagcaaatattgatttgcactcgaaatcttccttcgctgtgctgctggcgaaagattactaatttgaattttgtaaagttctaagttttctgttgtgagtgacttatcttcaaagaaagcctgcaaagaaactaaatcataatggtaatttgaacgagtattctctgaaaaatttctgcttgctaaatactcgtcaatctcgtttggtaatttcataatattttgtaaagtcgtgagcaaaggcactaaaggcctttaatatttcttgcctaacaacaatccccataaattcctgtcttttgactactgggagaaatggctccttaattaatttgtgcatcatttcttccaaggttactgatggtccaactgtttgaacatctttattaactatttccgaaattgatgtattatgtaatttttcaaaaaagaaattctgttccatttcaaattcaacgatttctgttaaacccaaaacaccaacgtattcttttttttcatttaaaactggaactcgtgaatacttatactgactaagcatcagtttggcatgagcaatattatgctcagcataaagtacagcaacatttgaggcaggaatcataaaggtttcactttgattcaagataaaatcctcaatctttttatcaatcatgcaaattactccttaaagagctttgtagacttagagtctgaactgtagttccgggataggttcatgttgcagatttcgataagaaactttgaactcttctccttcaatctcaattatagcatacattttgatatcatacttccctctaggttgtgcaactgaacctggatttacataaagtatattattaattttttgtgctactggttgatggatatgtccaaaaagcgcgatatctgcgttcttttcctcagcaaaataagaataacggtctaatcctaaaccaacataaaaaagatgaccatgtgtaattaataccttttttccttcaacttcttgagtaagaaaatcatgatatccactatcataatcacagttcccagcaacaacagttattccttgccaaatttcatcagaactaggaagttcagaatctccacaatgaaagatagccgttgcttcattcaaatactttgattttatggattcaaccacatcgcggtcataatgtgaatcagacattactacaaacataagcatccctcttttacataattatatttatgttaatttatttaaacttatttgtcaagccactcaggaagttcagccatcaattttctcaaggcttgtccgcgatgagagacttgatttttttctttttctgataattccgcggctgttctaaaggcatcaaccatgaaaataggatcatagccaaaaccattttctcctttaggagcgagagcaatataaccatcccaatctgcttccacaactaaactctcacggtcaggttttgccgccacaagcgtagtatgaaaatgtgcgcttctacgttctggagtaattgccgttggagcgagttcatgcaaaagttttgcgatatttttctcatcagtaggatccggagctgagaaacgatgcgaccaaatgccaggcaaaccaccaagaacatcaacacaaagtcctgaatcatcgccaatgactacttgcccagtaatttcagcgatttgttctgcttttaaacgagcattttcttcaaaggttgttccagtttcttcaatttcaggaagttctggataatctgttaaatctttgatttcataaccgaaatcagcaaataatttcttaaattcttttgtttttcctgaatttcttgttgcgattataagtgttttttccatttatttttccttattgaaattctctatttcagtatgttcaatctgaagttgtccgatgtttaaccatttttctgcaatttctcgaaatgaattaacgcccgcagtagtaaagaaacgatgctctagtggttgacgttcttgtccatttattgaaaaatagttgagcaaaacagagatatctcgtacagcttctgctccagaatcaatcaaacgtacctcttttcccattgtttcttggattaaggaacgtaagagaggatagtgagtacatccgagaattaaggtgtctacttttccaattagtggaacaagactttctgatacaacttttctagcaatttcagattccatctcatttgattcaacgattgaaacaaattttggacatgctaggctatatacttctactgctgatgatttacgagcaattgttttatgatattcatctgaacgaatcgaagcttgagtggcaattacaccaattttgtttgtttttgttttttgaatcgctgagcttgctccgggtaggatgacaccaatcaccggtatatctagtttttcttttacaatttctaaggccatcgctgttgctgtattacaggccattacaatcattttcacatcttttgatagtaaaaaattaaccatatcccaagtgaacgtaataatttgttcacgactacgcggaccataaggagctcttcttgtatctcctatgtagacaatttcttcatttgggagttgtctaaggagttcgcgagcaacagtcagtccaccaacaccagaatctaagaggccgattggtcgattgtccatttttcttctcctttttaaatatctaattcaaattctttcttatccaaaatttgtattttttaatataatggatactttatttatgatgataaaagcaaacgctgagagagtttagaacttatgttctactgcttcgctcagcgtatataatagcttattttttgtttgtgtctgattgctttgcagcagcacgaatttggcgaagaacttgttggacttgaacttcacttggtttacgtcccatagatcccatcataagacgaacagcgtcttcattaaggggtgggttatccataagtaatttttttgtttggcgttgtgagaaccatgttcccaagaaaaaacctgccaaaaggcatacaaccataagcaaaatagctaagattaaattcattttgaatctcctaattttggcgaaacgctttcgccattgatgacatcttattatatcaaattttagtccttttgtcagcactttatattactgacagaaaggataaatgaggcaaaagttactgactgagctgtcagtaactttttatttctcaaattgtaaaatcaaaaccatctaatgttgcaaaataatcagctggcttctctgctcgacgaattaaacgagtctttccatcttcttgaagcaaaacttcggaacttcttaatttagcattatattgataacccattgagaatccatgcgcaccagtatcatgaatcactaataaatctcctatttctatttgaggaaaggctcttccttttgcaaatttatcattattctcacacaaagaacctgtaatatcataaatttcagcagcttcatcattttcttttccagcaactgtgatatggtgataagcatcataaaaggctggacgcatcaagttaaccgctgatgcatcaactccaacgtattttcgataagtttctttaaggtgcaaaacttttgtaatcaaatgaccgtgtggagctagcataaaacgtcccaattcggtataaatttttagattttctattccgttagcgctcaaaacttcttcataagcttcgtgaacaccttgaccgattttggaaatatcatttgcctcctcatcaggacgatagtttacaccaattccacctgataagttaatgaaatcaagggtcattcccgtttcttctcgaatttctaaagcaagcttaaagagcttgcgagcaagttctgggtaataatcatttgtcactgtatttgaagccaaaaaactatgcattccaaattttttcacccctaatttttgcaaatctttaattccttggatgagttgggcttttgtcattccgaatttagattcttctggattatccataatttttgttcccatagcaaaaactccaccgggattgtatctcaaactcattgtttccggaaaaacaaaatctgtcagatttttcaaaaattcgatgtcttcataggcatcaagattgattgtcgcacccaattgattagcaaattgaaattcttcagctggagtatcatttgatgaagacatcatctcagagccgtcaaaaccacatttttcggaaagtaacaattcaacgtaagaggcgcaatcaacgccacacccctcctcatgaagaatttttaaaatagctggtgtgggtgtcgctttcacagcaaaaaattctttaaatcctttattccaagcaaaggctttgtgaaggtcacgcgctttttgacgaattcctttttcatcataaagatgaaatggtgttggaaattcctttgtgatttgttctaattgttcttttgttacaaatggtgtcttcatctctcacctcatttttagattatttataagtatagcatatcatcaaaagcttggacacaaaaaagttcctgccatttttactgacagaaactttttttactgacagaatgataaattatgctgtagcgacttttattaattgttcatcaacaatttcggctgtttttcttccttcacggattgcccaaataaccaaagatggacctcgtctagcatctccagcgactagaactttgtcattatttgttcgataatcatcataaatttcttgaacaccaaatttatccagtaagcctgtgtcagtgccaacaaatcccatagcaagtaaaactaaatccgcttcaattacttgttcagtcccttctaccgccttgaagtcaggtccaactttggctacttttaaaccagtaagttgaccttcagcatttgtttgaaaagctgttgcagtcatttgataggttgtcaaatcagtatttcccacaaattctgcttctttttgcccataacctgctctcaaggtcattggccactcaggccaagggttgttatctaaacgatcagtgggtaaacttggtgtgatttctaattgagaaaccgatgctgctcctaaacgaactgccgttccgatacaatcgttccctgtatctccaccaccaatgactactactttttttccttttaatgattgactaatattatcttcgccctcttcaaggacagttttagtcgtttctgtcagaaaatcaatggcaaatcgaattccaactgcttcacggcctgaaatatttaaatcacgtggaattcctgcaccgatcgccaaaataattctatcaaaatttactgacaggtcttcgtaactgattgtctttccaatctcagtattggtgacaaaagtcacaccaagttctgtcattaaatcaatccgtttttgaacgacttttttatccaatttcatatttggaatgccgtacatcaataagccgcccaaacgatctgatttttcaaaaacagtaacgctatgtcccaattgattaagacgccaagcagctgacagaccggcaggtccagaaccaataatcgctattttataacctgtcggttccgccgctttgccaatttcagccacccaaccttcatcatttcctaaatcacccaagaaacgttcattatctttaatggttactcctgcaccgtttaaggcctcggcacaagatttttcacaaggagcaggacagactctgccagtaaattctggaaaaggattggttaaaatcaaacgttcataggcttttctttgtaaaccacgataaatcaaatcattccactctgggatatgattatcatttggacagcctgagacagctcgtttgcccccataaaatatcccttgatgacaaaaaggaacatcacaatgcatacaacgtgccgcttgtttttgtcgttcttcagtagataagggaacttgcaattcagcaaaatcctttatccgctccgctaattcacggtaaggattatcatttcttggataatttaaaaatccatttggatcagccattagctcacctccgttacttttttaaaggttgtcatcgtaagtgcttcgcctgacaaacctgttttagccaaatcttcttcaatatttttaatatgatgatattctcttggataaactttgacaaatttttcgcgttctgtttgccaatgttctaaaataaattttgcttttgctgaatcagtataattcaaatgtttcttcaataattcttctaaaacttcatcacctgaagtttcatctaaagcataaagctctaccatttcccgattcactttattttcaaaattgccagcgacatcataaacataagcgataccaccagacatcccagctgcaaaattacgacctgttgtgccaaggacaacagcgataccaccagtcatgtattcacaaccatggtcacccgttccttccacaacaaaatgtgctcctgaatttcggacaccacaacgctcacctgcacgacctcggaaataagcttcgccaccgatagccccaaagagcgaaacattccccacaatagaagtattttcaatatcataagcggcatctagaggtggttttacaatcaaacggccccctgacaatgattttccaatataatcattggcttcgccaatcaaagtaacctccataccagcggttgcgtaagagccaaaggactggccagcaactccttcgtattcatagcaaacagaagcatcttttagaccaaaattaccataacgttcagcaatccaacctgccattcgcgcggtcgttgttcgattaatatttttaatcgtgccatgaaccgttgcctgagaaccattattaagtgtagcctccgtgaattggtctaattctttccaagcacgaggattagcaaaaggatcactatgccttgttgcaatcggtaaggcatgaccaagcatacggctaaagtccaaacctcgcattttagctggtaaatcttctttagcttgcaagagctcggcatgacctaccaattcattgattgttctaaaaccaagttcggctaaaagttctcgaacttcctcagccataaattccattaaacgtacaatgtgctctggttttccagcaaaatttgctcttaatctaggattttgtgtggcaatacctaccggacaagtatttaaatgacaatttcttgtcatgatacatccaatcgcaaccaaagctaaactaccaaatgaatattcttcagcacctagcattgcagcaatcgcaatatctcgacctgtgactactttaccatcagtttccaaaatcattcggtcacgtaaattgttcaaactaagtgtttgatgtgcttctgccagtcccatttcccaagggagacctgcatctcttgttgagtttctaggacttgctccagttccaccatcataaccagaaataacaactttatcagctccggctttaacacaccctgtagcaattgttccaacaccagtcgatgaaaccaacttaacattgatttttgcataaggattgatttttttcaagtcaaaaataagttgcgacaaatcttcaatggaataaatatcatgatgaggcggcggtgaaattaaacttaccccaggagttgagtttcgaacttctgccacccaaggaaaagcttttttacctggcaattgcccaccttcacctggcttagcaccttgcgaaattttaatttgaatctcttcggcagacattaaataagcagctgacacaccaaatcgtccagaggcgacttgtttaattttagaattattgattgtgccataacgttttgcattttcaccaccttcacccgaattggattttgcaccaatagagttcatggcttgagcaatacattcgtgagcctcttgtgacaatgagccaaatgacatggccccaattttgaaacgtttaacaatttcacgagctggttctacttcgctcatctgaatggacttccgatcagatttgattttccaagtgtgacgtaagcttgtcggcgtttttagagcaatatcatttagatactgactatattttttatatttttcaaaatcattttgacggacagcattttgaatttggtaaatcatttgtgggtcatagatatgatgttctccttcatccgcccggtattggaaagaaccgcctgtttccaataaatcctgtgcccgatgtccataagctttctcatatcgtaaacgatattcgtcctcgatttgggcaagagaaagtccaccaattcttgtactcgtacctgtgaagtacttatcaacgacttctttagataaaccaattgcttcaaaaagttgagcccctttataaccgacaattgttgaaattcccatccggctcatgaccttaacaatacctttttctgccgcatgacggaaattttcaagttgttcaggggctcccataccccagtctgaaagggttgcgtatgcaccataaggatgaattcctgaaacgccatagcctacaagcgctgcaaattgatgaacttcgcacacctcagctgtatctacaataattgcaaatttagacgcattatgacgtcctaacatataatgataaagtcctgacaaagcaagtaaaataggcattggtactttattttcagcaaagtcacggtcagaaagcacgataatagttgttccttgattaatcaaactttctgccttataaaagagtttgttcaatgcattttctaaaagatcatccttatcatatagggtggaaataacttctgtatgataatgttcttccttcaatgctaagattttttcaaagtcagccgttgaaaggactggactgtctaattttaacttacgaacattttcacctgtgattttttctggattcccatcttctcccaaataggtttctgttccaatgacaatttgttccctaatcgcatcaattggcggattggtcacttgagcaaattgttgtttgaagaaattatagagtgattgagcttggtcagataaaactgccaaaggagcatcaaagcccattgaaattgtaggttcattggctgattctgccattggtaaaagtactgtccgaatgacttcgtcagtataaccaaataatttccatagggtattcatttttgctgacggaattggatttgttttttcactttctgtcagtgctgacagtttcttcaaaccagctgacagaaatttttggtagggatatttattagcataataactcttaacttcttcattacgaataatttttccttcgtcagtattgactaacaacatgttaccaggtccaagaactgatttttcaataatttcatcggctgggatatcaaccacaccagattcgcttgacagaatgataaaattatcctttgtcacaagataacgacttggtcttaaaccattccgatcaagtcttgccccaacggtttttccgtcagtaaatactaaagctgccggtccatcccaaggtgcaatatgagcagttgaatattcgtaaaaagcttttaattctggacttaagccagtttgttctccccaagcctcaggaatcatggtcagtaaactttctggaagttctcgaccatttcgatagaaatactccatacaattttctaatttggctgaatcagaattttcttcattgtacatttcaatatcgttgactttcatccagttttcagctccacgaagcgtgttaatttcgccattatgtgctagaaaacgaaaaggttgagcccgattccaagagggaaaagtattggtagaaaaacggctatgtgttagtgcaatatgacttttgaaatcttcatcagacaaatcaggataaaagagttttacttgatacgcgtgaagcattcccttataaacaaccgtctgactagataatgaacaaatatataattcctcttcgtcaaaacgtttctcaagatttcgtctgataataaataaatcattttcaaaattagaaatttcgctgacagctttttcagatgatttattctcaataaaaacttgaacaaaagacggcataattccttgagccgttgctccacatgcttcaaaattaaaaggaactgtgcgcgtgaataagacttcatatccttgagccttaacagctgccttaatcgcttctaattcttgatgttttttattttccttacgcgataagaaaaattgccctacggcataatcaccaagttttggtagttctacatcatgttcttttgcaattttacgaaagaattcatcaggcaaagcaagtaaaatacctgccccatctccggtttctggttcagcacccgttccaccacgatgattcatccttgttaacatggtcagcgctctctcaactaaaaggtgactagctttaccgtcaatttgggcaatgaagcccattccacaagcatccgattcaaaatcaggctgccaaagtgtcgttttcatggcttgtttagcttttttattcataacacaacctcttttattttacaatttggttcttttattctactaaaatttttatgaaatatcaatatattctgacaattatatataaatgtaatttttagtagctttatcaaaactataaaaacccttacaattgacaaaaagaaactaaaatcataagataaaagaatgaataaggaacaattaaagacactaattaattcaggaaaaacatacgatgacgccgatttagacttgtctgaatatcgtgaccatgccctttttgaaagccgccgttataatcaaaaaattaataacaatgagggttatcatccagaaatcttagagaatctttttgaacatttaggtaaaaatccttatattgaatctaattttcgctgtgaatttggcttcaatataagaattggcggtaatgtcctcattaatcatgatatgattattttagactgtaaccaggtcacgattggcaataatgtttactttggaccccgttgtggtttatttgctgccaatcattcggaagatccaagtttaagaactgctggtggggtctattcaaagccgattacggtcgggaatcaagtctggttgggggcaaatgtcagccttcttcctggtgtaagcattggtgacaatagtattattggtgcaggaagcgtcgttaccaaagatattccagaaaatgtgattgctgctggtaatccttgccaagtgattcgtccaattcgaacagaggatcaagaatggattaaaaaagataaattatttatttcaaaataaaaaagctaaagagtattctttagctttttaaaattattcaactttaactatccagccttctggtgcttcaacatcaccaaactgaatgccaaccaactcatcatataaacgtttaaccgttggtcctacttctgtttctgaatggaaaatataagaatcttctccatcgtcgatacgaccaattggagagataattgctgctgtcccacaagctcctgcttcaacaaatttacctaaatctttggcataaacttcaccctcaatcgctttgagccccaaacgatgttcagctaaataaagaagagaatatttagtaattgaaggtaagatagatggactcaatggtgtgataaattcattatcagctgtaattccaaagaaattcgctgccccaacttcttcaattttagtatgtgtgcttgggtcaagataaatcgcatctgcatagcctgaagctttggcaccaacttctgcttgtaaagaagctgcgtaatttcctccaactttggcaccacctgtaccaagtggagccgccctatcataatctcttgaaattacaaattttgaaggagccaatccgcctttaaaataagaaccaactggcatagcaaaaacggtgaaaatatattcatcagcaggttttaccccaataacatcaccaaccccaatcaaaagtggacggagatagagcgttgcacccgtcccgtaaggaggcacaaaatcttcgttggctttcaccacttgtttaactgcatcaataaacatttcagttggaacttctgccatgcaaagtctacgcgccgtattttgcaaacgagcagcattttggtcaggacggaaaagttggattgaaccatcctttgttcgataggcttttaatccttcaaaaccttgttgaccataatgcaaagcaggtgatgattcactaatatgaagttgattatctcctgttagttctccagcactccattttccgtctttaaaacgagcgatataacgaaaaggtaagttccgatagctgaatcctaaattttcccagtctaaattaattgccataacatcctccaaatttttttgttataatagattatattattttctgtaacataaaacaagaaaatattcatgaaattcagtaaaagttcaaacaattttttcaaatatagtcaatttctctataaatgaatttataaaattactgaacaaaggagcaaaaatgaacttattaaaaacaaactgggaagactttggtttatttttattagataaagcaattacaattttattaattagtattcttttttttattctctatcaagccggctctcgtatcgttaaacgcttatttaaaaattatagtgagcaaaaatggacagatacttcgagaatcttaaccctctctcgactgacaaccagtgccatccattatcttacagtttttctttatatctatactgttctaggagtcatcggaattcctgttgcaaatatccttgctggtgctggtattctcggagttgctctaggttttgctgggcgagatttagtcgctgatattatcaatggcttctttataatcgttgaacatcaaatcaacgttggagatactgtggcttttgctggccttgacattgaaggggtagtaaaaactgttggaattcgttcaattacagtaattggcgctgatggcgcaacgacttttattcctaatcgaaatattgctgccctcaaaaactactcatacaaagaaagaactgttaatcttgatgtgccagtaacaagtgaaaatctgattgaaagaaaaaatcagattatggaagttaatgcaaattatcctcaacttaaatatttaggaattatcaacattgaagacaaactcttcttaagaacaaatttaacagccccattatctaagattactcctttaaaaatggagattttagataaatattatgaaaaataatcactgacagacttatgactaaatagaaaaaacaaaatttatcatcaaaataaaagcgatatagttaatctatatcgcttttattttttcctaagatgaatatcaatttttttagtgagtaaagccatatgttttattttcaggttcctcatggtatagaatatgagccttatttaaagcctcaattgcttcttgcatatcttgaacatagttaaatgccatattcatcccaaaatctgctcgaatcactaaacgttgaatgatttcattttccaaatttttgggaagtggataagcaggcacttgccatcccttcattaataaacggtctgccaaatcataaagattccaaccccgatttgaatcttcttttaatttatagcagacaattggcaattgtgacccatcgttcataatttcaaacattccagttttttcaatttcttttgctaaaaacatggctactttatgcgttctctcatgaatagctttatatccatcaaatccataacgtacaaaattataatattgaccaattaattgagaggcactgtgagaaaaattaatggccatcgttggtagttctcctccaagataacttactttaaaaattaattcttctggtaaatattttttgtcacgccacaaaacccaacctacgccaggataaactaaaccatatttatgacctgaggtattgattgaaatgacatttttcaaacggaaatcccactcaagttctggctcaacaaagggagcataaagtcctcctgaagcagcatctacgtgaatataaactttgtaatctgtctgtttattatattcttcaatcaaattatccaaagctttgatatcatcataacgaccagtataagtaatccccataataccaactaccccaatcgtatattcatcaacataatccatcactttatccaaattgattgacatatgttctctatccattggcacttctcgcatttcaatatcccaataaacacagaatttttcccagcaaacttgataaccagatgaaataactaagtttggctttttcgcattaatgtctaatcccaatttttctgctcgcttgcgccaagaaaacttcatggccattccaccaagcatacaagcttctgaagaaccaattgttgaagtccccataaatttttctttttcactcgcattccaaaggtcagcgatcatgttgacacaacggttttcaatttcagttgttcttggatattccgatttatcaatcgcatttttttccaaggtctgactcattagcttgactgcttcaggttccatataagtttgacagaatgtggctaaatttaaacgagcattcccttcatctaacatttcatcttgaactaattgataggccactcgaggctcaattgattgttgagctaatttatatttaggcaaatccacttgttcactttctgaaccaaaaattggttccaagaactctgcttcatcgcgattttcttttccgtataacataggtacatcctccaattttttaatgttttaagatatgttcttcttttttaataatatgatgctcaccacgagctgctggataaatcgcggggttcacatctcttgctttaaagtgccttggttcttcaatagtatcatgtccccttttatcatgcaattcataaacaataaatggcaagatagcagtcacaacaaaacttataagaagtatcatttggtaagtatgagtctcatttttcgcaattgatgctggaagaacaaaggaaataaatagagcaaaaattgataataaaaatccaattcccgcaatgattgtttttccaactcttttacctggaacattataagtgcgctttaaattttgttttttatagattaaaacaaagtaaccaataaagaataagagataacctaccaaataaatcactactgtcagtgaaatggcaactaagaaagataaattatttcctcctcctccaaaagttaatacagcgccccaaagtgtaacaatgattccttgaatcataactaaaggaacagggacttcatgcgtatttgttttacgtaaaaattttggtaataagcctctttgtgctgctgcaaacatccctctagaaggaccaacaacccatgaactcacttctcccataaccccaaaggcaatcattagtgcaattactttaactaaccatcccaaatgatgattaaaatgtaagattaacgtttgaaaagtttgaattacccctgcacttaatgataagtctttttgaggaataaccgctgctacagaaaatccacctatggcatctaaagaaatagctaatattactaataaaatcattgctaagggataatttctctttggattttcaagttcattaatgtgcgaagctgaagcttctacccccatataagcaagaataaaagaaacaaaaactactaaagttgatacttgtgaaaaatctgggacaaaagcatgcttattaattggtatctctataggattacctccgataaaatatgccgcagctaatacaaacaagataatcgatggaatcactatcccaactacgaaaccagcttttaccaatttagcagttctttgtgtcccacctaactgagaaaatgtcaatccccaaaaaatgatgagtaaaccaataaatttaatcaatggatctgtattaagtgcctgaaaatttaacacataagagagggcccctaaaatgaaatagatcatagtgacaaagccaactgtaatttggaaccactgaaaaaatatggctgcaaaaccaaagcgctcccctaaagtttggctcacccaactaaaaattccaccattttcccaaccttcaaccgtcgccatttctgctgcacagagcgctacgggcaaaaaccagagtagtcctccgagaagtaaaaagaacaccaaatgtaattttgacgtggcaaaagttggatactcatagacagtcaaaaccattgaagcggttaatgcaaaaaaaccgaataatgataattttttttgattcatcatacctccttatatttatgattgaattttttaaaagacatgttatatagcctcatacaactcatcttcattttctagtatatgctccagaataaaaaaaatctcttttaaactgttgctttaaagcaacagctcaaaagagactaaattgactttttcaaatacttttccatttttttctgatagaattcttttatcttccttcctccaaattcttccaaagtttcaagcgcataatttattttttcttctcccacttctgcattttcaaaattaaaaataatgatacctctggcaagatgtcttaatacttcagaatataaatcaacacctacagttcgatattttttagtcatttctaaaatattttcggcttttgttctttctccattagccgcgtatatcgcaacgcttttataggctatttgcaatagtctccttctatattttaagactctacagtaattttcacatcttttgtcaaagttaaagagcaacaattccaattgattgacattgagataatcagatacaaaatagaataaagttagttcaaaatatccccactcttcaatattacaaagataagtttcaatttccttaacttctgtctgactaatagtcccaagcttcgttttaacggtaatcatcagtaaatgattccccgtttctttaacttcagaatataactcttttattttatctcgattttgactaaattcagctttttccaattctaatataaaaaattcttggaaattcggcatataattatttactatcaattcgtactcagctaatggaacttgcatttcttctaacatcaaatctatgcgctcaaaactcatcatacactttccatgttcaaatctagatatatttgaacggtctatccctagtttactaaagtatgataatcctaaattcttttggtttcgtaactttttaaaacaatctccatattttttatacattctcaacctccccaaactattatttttattgttttttcaagatttataacagttcattagttatactctttaatcagtatgtcaatgtagctgttttttatgtatttaagaaattacgcaattgagattataacttatttaggacttaatcgtcaaatttataccagttcatacaaaagtatatcttacataatttataataaaaaacatttatattactttatatttctcttaggctattaaagaaaacagtttaaaagcttatactgggctcatcatctgctctgttagaatttttatataagacttttgttaaaataattattattaaaaaatattggaaattataacagatgtaactataccaatttaaaatattttattaataactaattctataaaaaactccttttagttattatgtcatttaggttaatataaaattagttttttattaaaaaaggaatagcctaaataattactgacagacctgtcagcaaaaaaacgtgaacagataacgttcacgttttacatatttttactgacagaatctacgatttaaaattgaccatagttttaatcggctcataggacttgcgatgaattcttgtgataccatactttgttagagcttcaagatgttttgctgttccataacctgcattatgttcaaaatcatactcaggaaattcacgagcaagctctttcatcatttcatcacgagttactttagcaacaattgaagccgccgcaatcgaggctgagcgagcatccccgtgaataatttttgtctgtgcaataggtagatccaaaaccatagcatcaattaagagatgctcaggtttaacagataattttgatactgcttgaatcattgcaatttttgttgcttcataaatatttacttcatcaattttttccgcatcaacaatcccaatccctattgctaaagctttttcttgaatttcggatagaatagcatgatgttttgattttggcacttttttactatcatttaaaccccgaattttacaatttttaggtaaaatgactgctgcagtcactacaggaccagcaagcggtccacgaccaacttcatcaatacctgcaattaattgaatttcttgaccataaagttctttctcaaattccaacatttgttccaaacgagcctcttctgctaactctgctaaaatttgtttttttctacttttaagtgctgcttgaaccccagcccgttcatcagctccatattctatgaattcttttgctgacaagtctgtcagtttggctaaggccgctttaatttctttaatggtttgtcccattttactcaccaactctcaaaaattactgacagcttttctgtcagtaattttacataatattatttatgttataagcgcttaaaatctatcaatataattataagctcatagtccatcaactccaacttcatccaaacagaacaagcccagttttccatcacggacatctttgacaaacatattatagaaacgatcataatcatcacggaaaccaaatcttgcggtcaactccatgattaagtctggaatttcaagctccaaatcttcttctgtcattcgatatcgtttcattgtgactgttcgataattcttcaaaaaataatttaatccaaaaattgttacctcatccataggcaataaatcatccttaattgccccagtcaaagctaattttaaaccaacaagttgatcttcaaattttggccaaagaatacctggtgtgtccaataattctaattctttattagttcgaatccattgttgacccttagtcacccctggacggttcccagtcactgcaacttttttacctgctaagcgattcatcagagttgacttccctgcattcggaattccgataatcattgttcgcaaagtagtatgagcaataccgcgctccttatcatgagcgaccttatctgccatcaattttttagcagcaacagttaatctttttgctgtatattcttctttagaattaatggctaaagttataaaaccttgttcatcaaaatattcaatccattgtgctactgcattagaatcagctaaatcagctttatttaaagcaataattcttggtttatccccaataatttgccctaacatcggattacgtgaagaaatagggagacgagcatcaaccaattcaatcacaaaatcaacatattttaaattttcttgcacctgacgacgtgctttggacatatgcccaggaaaccattgtatcaccatattaatactcctcaaatcaactgtaatctctacagcttttatatatttctaatttcacattcagataagaatcaagacttagctgactttttattctacaaaaagaatacaaatttgaattctaatttttgccctcttttaaacccaaaaaaatataaaaatggacaaagattaccttatccattttagcatttttcaactttttttgtaatcctcaattttcaggattcagattttccgatttttaataaatcaagacccaaagttaattctcttaagacctttttaaaaacctctacagagaaagagggagatgttgtcaaagttaagaaagtttctccccgatcagtaattgtgtagtctgtatcataaaaaccattctttttatagaattttaaacgttttactctctgttcataattatctgcactcggatcaagtctctcaatgttcaaagtaatatttttacctgaaaatttttcttttaaagtttctaaaatcgctgaaccataacctttagactgaacctgattattaactgctaaatataaaacaaaagtcatatcttcatgactcacaaggtaagaaacaccacaaaattcatcattttgatagtaagcccagaaatgtacatttttcttcaaggcccaaagttttagcagccaaattggatattgttcttctttaggaaaagaatttttaactaaatctatgacttgacgatattccggtaaagttttagatacattttttatttctaaattcattatttctcctctactttaagggtaatatatcgattatatccaaaaagatttagagttcataatgaagtccttttactattagtataaaatatctaatctagtcttataagccaattatttaatgtttgaaagattgcttcttgctgttgaagattagaaattgacgcctttttatctcctttttgaaaaccatagctcccaaatccactatggtttccaccttctatcgtaatatacttcgtttgttgtggaagatattgtttcgacttttgatatgatgaccagtttaggaccccatcttgagaaccaactatagataatattcctccattaaaattagttagacttccttttttatcaggataactagctaaaaagaaaactccttttaatgatgaatcagatattcttttttctgcaaaccgacttgcaattaccccacctaatgaatggccaccgaccacataattattgattttattcgctttaataattgaggaagctttatctggattaaacactgctaaatttaaaggttcttttattagataaaccgtatatcctgctttagaaagtttatttgcccaaatactataactcttattatctactagagccccctgataaaagataatgcttgttttattaggatttcctttaaatacaagggtatcattctgaacttcagctttttgtgaaatttttaaagcttcagaagtgggatgatagctattcgtcttaaggtaaaaaaatataaacgtagcaattatcagtattaccactcccgaaaaacttaaaattttctttaacttactttttttcattcttacttcattctccatattgatattataattattataacatgacaacaaaaactaaaacgattatatatttataataataagataaataaacattttgcattaacttgcatttttagcatattttcgattaaacaattgcaacttattgcttaatttcgtgtgctgtgttatgatagttaaaaaggagagagaatgttattagaagaaagactatcccaaattagccaaatcattgataaagaaggcagtgccacaattgattttctagctcaaaaacttgaagtttcaaaagatacaattaggagagatttaataaagttagaatccagaaaaaaattgcatcgagttcatggtggagcaattccaatcggcaaagaggctgagattttgaattatgaagaacgctcaaatatttccagcagtttaaagaaaaaaatagcaagtaaaataaaaaatctcataaaaaatcatagcactcttatttttgattcatcaacaaccgtcgaagctgctataaaacaacttgataacttctctatctcaaccatcacaaactccctcaccaatgcaatattactttcgaagtatgagaaggcaactgtacaacttcttcccggaaaattaaacaagaatcaactattcttgtacggcgcggaaaccgttgaaaaactctctcaatatcaagttgattttacaattttaggcgttttcgctctttctaataatggtttatttattcatactgaagaggaaggcctcgtcaaaagaaaaatgattcaacaaggaaagcaagtcatagccttagcagatcataccaaacttaataaagaaggattctttaaaatttgtgatttaaaagaaatagactatctcatcaccgatgaaaaaattgaaggtgaattgatgaataatttaaatgataataatgtgaaagtggtgactataaatgaataaagaaattgtttacgaaaaaataaacgaaccaaagctctttaataatgttccaccggttacactaacggacaaaacattaaaggaccgaaaagaaaagcttttatcaataatggctaaagaacaatacgatgcattaattatctatgcagacaaagaacatggcagcaattttgaatactttactggatttattccacgttttgaggaaggattactcattattgataaaaatgataaagccacgcttgttttgggtaatgagaatttaaaaatgtctaaacactcaagaattgaagctaaccttattcattaccctcaattttctttgccaaatcaacccatggataacgaaaaaagtctaactcagatttttaaggagttagaactttataaaaacaaaaaaattggcttgattggctggaagatgtttacaacacaaaatgaagagccttcagaattatttgatcttccctactttatcgtagacgcagtaaagaattcactctcaacagatacaattttaactaacgctgctcaactcctcagtggtccaaaaggaattcggacgataaacaatgcaaacgaactcgcgcattatgaatatggagctaatcttgcctctcgttgcattctaaatgccatgaatcagcttaaaataggaataaaagaaagtgaaattggcgcaatactgtctgatgaagggcaagcccattctgtaattacaattgcagcttctggagaaagatttaaaaaagccaacttctatcccagttataaagaaataaattttggagaaccaatttcaatgacaacaggtttcaaaggaggcttgtctagtcgaactggttttttagtcaatgaagaaaaagatttgccagataatcaaaaacattatattactgatcttgtcattccttattataaaggagtcgtttcttggctagaaaatatttccatcgggatgttgggaaatgatttctataaaatgattgatgaaaatttgccaaaagcaaaatataattggcatttaaatccagggcactatgtcgctgatgaagaatggatggcctctcctttctataaaaattcaaaagtgaaaattgctagtggaatgatttttcaaattgatattattccatctgtagaaggtttagcaggcgtaagtgctgaagaatgcgtagctgttgctgatcagtcacttaaaaatgagcttaaaaatgaatatcccgaactatggcaaagaattataacacgaagaaactacctcataaatgaattaaacatcaatttaagtccagatgtgcttcctttatcaaatacagtgggatacctaagacctttcctcttagaaaagtcgaaagccttgaaagtcaaataaagttaatacttataaaaaagaagaattctattcggcagaattcttcttttattttcacataaaactatctttcaccttttgagcaaaaaaagaattgactaattctatttttagaattagtacaacatatttgggaaggcattaaagtaatcaaaaacattgatgaacttataacgataagaaaatcaataattatattttgtttcagatgaattataaaacctagaatcacaattagcaccaataaacagaatatcaaaattatgccacttgctcttaacccgacatcacgccatcttctaacagtcatcgtaataactgggacaagtaaaaacaaatagatgattccaataataaagattggtatattaagaaatgtactctccattatttcttgaacatttcctccacctgaaatattcattaaagaaccaaaaattaagtaagataaaatgactgttggaatgatcgaaagtattaataaacttaatatgacataccaaaaatccagccgactcgttttacctttaaaattaaaatattctctaaaaaattttttataggcattgactaaaacaacttctccaaccattgcccctccttttttatcaatattaattaaaaaagagctaagaaaacaaagctcttataaaataattattataattaatctacttttctaaatcgaataaatagcacaagtgaaccaaatataagcaagaaagaaccaaacaaagtaagttttttcattccttgttctttatcacctgtttcaggtagattcttttctttagaagttacaactgattctttatctttaacagtcttagaccctttcgttgtttcattctccctagagtctggatttacattatttttatcactagaatctggaataacttcttctggtttattaggattagcatttttctcataaacgtaagtcactgtttgagggctatcagtatattgaccagaagcattaccaattatatttttgaaagtataaccggttagtgctttcttttctgtatgataagtttcaccaatattccctgtctgaataacatcaccgaaaagtgatttatcatctgtatctatatacttgaccgtcacttgaccaagtatcttagcatttttctgataaatataagttactgtttgaggactatccgtaaatttaccggttgcatcaccatccactttaattaaagagtatccttggaaacttagttcttttgaattataggttgctcctacataaccatttaaaacctctgacggtgctagttcttgacctttttcatcttgatacttaactgtgactggggccccatcatcaacgacatcaaattgatgtaaataagtacctgaggatattgcataaaacgtatagccatcgggaactgcatacgttcctgctgggttatttaaacgagcattatactcaaaagattttattccttgatattcttcagaactaactgaattgatagtgattccattgtcatctatttgcaaacgactggctggaagttgagttccattaaaatcaaaataagtattactggcagagtttgaagttgaaaaaggtggaatataaccatcaaaattcgtcattcgattaggcatcattgaaaatggaatataaacactttgctcatcttcattatatttcaagctcgatcttgtcaccgtagttggaggatcatttcttccagtattttgaccaaatgctgccaagtcagacattattggaaaatctttaatgacagtaaaatctgtgatcccacaaaattgaacactaagactctttaggtttggaagaacttttaatggctcaatggttgtaatattcatattactatccatataaagtcttactaaagcttttaaattaacaatttttgctaatacagaattatccacgctagttccaccaattgacaaatttgtcaaaccctgacttgctgtaagatttggaaagttatcactggttaatgaactagtttgtagggtaacaaatgtcagtttggttaatgattctaatggtgtaaaatctgtgattttgttattgacgttaatataaattgatgaaagattggttgcatgttcaagtccaactaggctataaatatctactgaatttaaagttaaattcgttaatttatccatatctgtctgagtcagttcagcagtcgttgcaagccctaaagttgataaaattgtttgttttaaatttgggtctggcacagagattgtggcacttactgctgcttttggttcagcaaccgttgttgaggcaactacttcctctttttgcgccaatttttttgaatcagaagtcagactttcagaaggcgctaagctagtagtagaagaactttctggtaaggaaatcgttgaattattttggttttgatcattagtagaggattccaccgtttgactttcagatgtagtttcagaagcatctttttgacttgttggtgctgtttgttcagattctgtttctgtttcagttgccgagacacttaagggtgttaaggccaatggtaaagacaaacaaaacagcataagataaagactactcttatgtttccatttatttaaatgtatctttttcataataactccttgtgtaatgtttaagttacagcttatcacacaagcgttttcatgttaatgcatttcaaaactgttaaaacatatatatttcaatactattttagactattcattacatttagtacttctgccgtcattaactttatctattgttcactttacccttttattcttaatggtaaacaaattaattaatttattgcaatttctaatttgtagtaaaaaaaagtttctcagtttgctctgaaaaacttttttacgatttaacaacatttaattatcattatattacacgctactaatgtgcaattatttcttgagcaatctcaaagcccgtcaactttttcggataataagttggccaattttctaattcagataaaactttttcttggctctctccaccatggaaaatatgaaaatgacttgtctttacggggctaatattatgatcactaaattgaacatatttaaattcaccagctttgggatcatttgattcaaataaatagcgaacccctcggtttcctttactatagtttagaattttgaagcctttatattgatatgtatacctctcttttaccccatttttaacgaaactcatcgttttatcatctattaaaatttggtcaacatccgttttataaccctttgtgtaataatccttatagtcagcagctgacatatctttattaatctttgatttaagctcaaacacttggtctaatgttccattttccaagagaggatagactgattgccaatttccactataatcacttaaggaacggtttttcacatcaccatcagaaaaatagccattggcaaccgtttttccttctttacttttctcttctgcttgaatgtcttttccctcagtatctgttgttttcttcagggctattaaattttgttccataactttgatataattcccgccttctgaaagttctttcttcgtcaaactttctaatggattaagcacctcaacgtttacttttgcttctttggcgagtgttttggcaaatttatcattagcatttttttcaaaataaatatactgaatactattagcttcaacatatttttttaattcccccaatcttttagctgaaggctctttgtcaggatttaaacctgcaatagacacttgattaaggccatagtccaatgctaaatagcggaaagccgcatgttgagtcacaaaatttttctgcttaacctcttttagttcttcactgtatttttgatcaagtttacttaattttttaacatatttttcagcattttcactgaaaagattagcttgtttaggatagagtttctttaattgagcttcaattgtctttacttctttaatcgccatctttggtgaaagccaagtatgtgggtcatactcatgatgatgatcactttcattttctgagtgctcatgctcatcatcagaacctggaagtaaaacaatttctcttgttccttcgataattttgggcgatttttctcccaaagtatttttcaactttcctacccaagtttccatattatcattatgataaacaaaaagatctgattgattaattttcaacatatcttttgctgaaggctcataatcatgaggctctgtacctgctggtactaatagtgatacttctccagcctcacccacaacattctttgtgaattcataaacgggataaaaagtggtaacaactgataattttgaactggcatttttttcattttcttttgaatttgtattctggcaagcagctaaaaatattaaagccactaatcctaaacatacactaataatctgttttttcttatacttgattaagttcactcttaaaatcctcctaaaaataatcatctttactcatttactctagagataaataccaaaccggttagtagttgattaaccggttaactttatagtcaaaaaaatatttaatttcctattaaatttcacttttcaaaaaacacctccttatatagttaaccagttaagtatatctaaagttttataatttgtcaactggttaagtaatttaagtttactaaaaaacgacttaattacaaagtctttttagattattcatttaatttcttcattgacatgaaagcacctttttcaaattttcattgataacagaggtatcttcaggatgttgattgactaattcattagatttaaagtttgcggcagattcaggtgattgaactgcctgtttgatatgcggatcacttatcgaattaatgtaatctaattcatccagccacgccttttttaattgaacatagtatatattttctgagctttgttgcttactactgctactcagttctgttgaactagcttgttttgtttgagtctctttggaagactcttttatcaattttgtcgtactttgactgctatcttttgatgaactattggtcttactgcaagccgtaattgtaaaaagtatgagtagtgaaagtattccaataaaaaattttttcattcatccttctcctataaatattttattaatttttatcttccttaagtcctaaaagtttctccatattggtatcaggtaacaattttgcgagctcaaatcctgtattaatttttgaataaatagaacaaactacaaagatgtttttgttagaaaatttgaccatttttgattgacctgatgaggctggaatgtgatggtggccatgaattgctccaataatattaaaattttcgaataaatccaatatccccctatgagcgcatttataagatttgttataggagctgctctttggtgaaagcatactcaattcattaaataatggcgcatgagaaacaattattgttggaatttgtttatcttgagcaagaagtcttttcagttcaatagcaataaaattttgcagttctttctttcgctttacaagagccactggtatggttaagccaatataacgtactccctcataaatcaccatttcattatttaatatcttcattttgggataattttgcgctaactcctcttttatgagttcataaaaggaattatcccctattggtaattttggccatgcctgatctgggtctaaaactaaatccttaaaccattctttttctctaaaatcatcccatttacttttagaaaaaatcttttgttctgaaagaatatctgctagctcatgatttccaataacataaataccttgtatttttgaatccaaaactacagaatcagaaatatttcctactaaaatattgaagtcaggattagagaaaggaagttttccatcctgactatcaatatctgaaataacattaattttattattattttcagtagaatgaacattttcaaagtactgctcaaggtctttcggattttgactatgtgcaacataatttttccgtaaattcctcaattgattacccacatttgatttcagtagtggtttggtcaccacttctttaataggttcagcaatttgaatgttttcaatttctactttaagtggggcaggaagattttctaaaccaactttcaaatctgactgacttgaaagtactaaattcttactttgatcaagataaacattatctttcggttgttcatgctcagaatcaagcaaatgaacagttgttgcaggaacttttgatattttacacgaaagtcacgtgaatatgttacgaaatgctaaaaatcttggaaatcaattgattgttatgctctcgacggatgaatttaatattgagaaagggaaaaagtcctttcaagattatgatacaagaaaatatgttttagaatcaattcgttatgttgatttagttgtaccagaacaatcatgggatgataaggggttttatattgacatgtttggggtaaatattttcgcaatgggtgatgattggaggggaaaatttgactttcttaaagaggagtttcctgatttaaaaattatgtattttccacgaggtaaagtttcgtcatctaatttaaaacaggaacttggaaagctttatctaagccatgataaaaagatatcggatttaaaagatgaataataagaaatgaaaatagtgcaaaaatagcagattatctatcaaaagaaatgagtaggagaaaaaaggtcatggatcatggaagtggtttactgacaagtttatcagtgaaaacaaaaacaaatgtattagaatcatatggaaaggagaaaaagtgataagtttattagttagaataaggttgatgataattaagatgattctttctctttttcttaggattttagggaaatttgtagaaattgatgatagattgattattttttcttcatttaatggtaagacttactcagataatccacgttacctttttgaatacatgagggatgatgaagaatttgctgattatcactttgtttgggcctttaaaaaacaaaaggaaatttctggtaccaagtctgttaaattaaattctttgagatactattatttactgacgaaagcaaaatattgggtctttaatgctaaaatgcctacttattattataaaaagagtgaacaaatttatttacaaacatggcatgggacaccactcaaacgcttgggacatgatatttttgacaatgggaacacttattatcgaagtcgtttatcttataagaaaatgctcgaaagttatgatcaagatagttggcggtgggattttcttatttccccgaatgtttttgcgagtcaagcttttgtcagtgcttttaaaataagagaggaaaaagtactagaggtcgggtatccgcgagttgattatttagtaaatagtagatttgatgtgaacatagatttaataaaagcacgctatggattaccaacgaataaaaaaattattttatatgcgccaacttggcgagataattcttttgacgtaaagggatataaatttcaattaattgtagattttcataaatggaagaaaattttaagtcagaatacaataatattatttaaacctcattacttaatttctaatgtttatcaggttccggaggatttgactgattttgtttatttgatggaggcaaatgcggatattaatgatgcttatttgatgagtgattctttaattacggattattcttctgtgttttttgattatgctaatttaaatcgaccaatctatttttatatgtatgattttgaagaatatgaacaagagttaagaggattttatttaaatattccaaatgacttacctaatgatgtcattacaagggaagatgatttattagtgaaaattaataatgaggattttgattatgaacgcttgagaaagtttaatcaaaaatttaacttatggaatgatgggaaagcttgttctaaagttgttaagaggatttttaatgaaaactaaatcaattattttaacaattattcttggttttttttatcctttttccttgattcctgggcttaggaggaatcgaattacttttatttcattagaacatgataatttatcaaaggattttaagttgatttatgagcgtctatctgaaaaaaagaaatatgaattacgaacagttctctttaaatttgattcttctttctggggaaatataaaatatggttatgcttgtattcgtcaattatttttaattcaaagttcacatttagtgattattgattacaataatttcgtagtgtccaaattttcgcatcgtaagaaggtcaaggttttgcaactttggcatgcaactggtgctttgaaaaaatttgggaatgatgtggagcgagattataaggtgaaaaattatgattatacaatagtcaattcagattttttaaaaccgatttttgcgcgtgcttttaatcttttggagtcacaagtgatggtgactggtattcctaataatgataaaatttttgattcaatttttttagaagaaacaaaacaaagactcttagcgaaatatccgattctgaaaaataaaaagattataacttacgccccaacttttagaggaagaattagtacgcattttcgagaagctatgattgatttggaaaaagttcatcaaaaactcggggaagattacttaattatttataaaagtcatccattgatttcagattcaaaatatgaaaataatgaacgagttttatttattcgggatgagttgatttcgtcactcttttgcattacggatattttggtgacggattattcggcgattgcgattgattggatggtttttgacaagccaattattgcttacagtcctgatttgataaattactcacgtaaacctggttttacttttgattaccaagaggagtttcctggccctatcagtaaaaatgaagaggagttagttgaggcaatcaaatctgtcagtaaaaaagttgctgagaatcgtttgaaacgaaaaaatttactgacaaaatgtataaatttaatgatggaaaatcaactgaacgagtcttagatttgattgaatcaattatgagcagcttttagtgattggaaaggagaaaaggatgacaaaatcagaaacgtcttatgatgaaccatttaaaagaggacataaaaagaaaaaaagaaaaattttacgaatttttatcattgcgctttttgtattgatcgtacttttaggcgcagttggtggtaaagtttattttgatttgaagtcagcgataaataaagcttatgttagtccaccgaccgaaacgacgagtgtttcactaaaaaacaaagaagcttttacgacagctgtccttggaataagcgaaattaatggaaaagaagttttagtttcggcggatatggcagcaatgaatcctcgcttgcaacaaacaacagttatcaatatttcaacaagtgcgttacttccaaatcatcaatctttaggaactctttataattctggaggagcagcagcggtcattcaggaaatggaagagctattgcaggtcaaaacgaataagtttgtaaaaattgattttgaccagattggcaaattggttgaggcaatcgggggactttcacttcaaaatgcaaatgtctttaatgctcaaggttacaattttcctcaaggaacaattagtttaaagaattcaacagaggtaaaggcctatcttactttattaaatgagtcagatagcaaaaaactctttggaagacaacaagaacttgtgatggcgacaatgacgaagcttaaaaatccgcagattattatcggacatttttctcaaattttggctgcttttcctaaagtttttagaatgagttttagttttggaaatttcaaagctttggtagtgaattatcatggggctacaaggattagtaaaatcaatatccatagcgataaagtggagggacagtcaggagtgacgacaatttcacaagctaatcttgatttggcgaaaatacaatttcaagaaagtttaaaataaaagaatataaatcattggacaaacatctaatgattttttttatgacatctatttagtagaaaatgcaatttttgacaaaaagaatgtatttttttaacagctttgactgccctttttggaagagtttatgtataatagaattagttagttttgctattgatatagcagcagaaatggagagatataatgcctaaaaaatttggtcgtattcatcttgttgtaatggactctgtcggaattggtgctgcaccagatgctgacaaattctttaatcatgacgttgaaacgcatgaagcaattaatgatgtgaactcagacacgattggtcatatttcagaaattcgtgggcttgatgtgcctaaccttcaaaaattgggttggggaaatatcccgcgtgaaagtccgctcaaaacggttccaaaagctgataaaccagcagcatatgtcactaaactagaagaaatttcaaaaggtaaggatacaatgactgggcactgggaaattatgggtttgaatattcaaacgccattcccaacttatccagaaggttatccagaggatttacttgaaaaaattgaggaattttctggccgtaaaatcattcgtgaagcaaataaaccttattctggaacagcagtcattgaagattttggtcctcgtcaattggaaactggtgagttgattatttacacttcagcagaccctgttttgcaaattgcggcacatgaagatgtcatttctcgtgaagaactttataaaatttgtgaatatgttcgttcaattacccttgaagggtctggaatcatgattggtcgaatcatcgctcgtccttatgttggagaagctggaaactttgaacggactgatggacgtcgtgactatgcattgtcaccatttgctgaaacagttttggaaaaactttataaggctggaattgatacttattcagttgggaagatttcagatattttcaacacagtaggtgtgaaatatgatatggggcataatcataacgatatggacggggttgaccgtctgcttaaagcaatgacaaaagctgagtttactgaaggattttctttcacaaacttagttgacttcgatgctaaatatggacatcgtcgcgatgttgaaggttatggaaaagcaattgaagactttgacggtcgtttgccagaaatcattgatgcaatgaaagaagatgatttgttgatgattactgctgaccacggaaatgacccttcatacgtaggaactgaccatactcgtgaatatattccactcgtgattttctctaaatcattgaaagaccctaaagttttaccagtgggacattttgctgatatttcagcaactgttgccgaaaacttctctgttaagaaggctcaaactggtgaatcattcttggatgctttggtttaataggaaaaaatttctgtcagtaaattttactgacagagtttagaaagatttatttatggctaagaaagcattttgtcagtcgtgtggaatgccaattgctgatgattcttataagggaacgcaagcaaatggagagttttcaaccgactattgtatctattgctatatgcaaggacgatttgtccaaccagaacttacttttgctgaaatggttgaaattgggcgaaaaggtttagataataattcaatgcccaaaatgcaaaaatggcttttcaaaaagctttatccaatgcaattcaaaggtttgaaacgctggaaaaattaagttcttaacttactgatagaaatcctgtcagtaaatttgataattatattaaaagaaaaggaaattaaaaatgccaacaccacatatcgaagctcaaaaaggcgaaatcgcagataaaattctcttaccaggagatccacttcgcgcaaaattcatcgcagaaaacttccttgaagatgctgtgcaatttaaccaagttcgcggaatgcttggctttactggaacttacaagggacatcgtgtttctgttatgggaacaggaatgggaattccttcaatctcaatctatgctaatgaattaattacagaatacggtgtaaaaagattaattcgtgttgggactgctggttctgtaaatgaagatgttcatattcgtgaccttgtcattgggcaagcagctgcgacaacttcagcgattatccgtaatgatttccctgattttgatttcccacaaattgctgattttgatttgcttgataaagcttatcatattgcaaaagaccttggaattacaactcacgttggaaatattctcagctctgatttgttctacggtggaccagatgcagttaaagttggaaaacttggtgtgaaggctgttgaaatggaagctgctggcctttattatcttggggcaaaatataaagttcaaactttgggaattatgacaatttccgaccatattttgactggagaatcaacaacttctgaagagcgtcaattgactttcacagatatgatgaaagttggtttggaaactttgatttctgaataattagttaaagttctgtcttaatgacaggacttttttatttattatcaataaaaatgcatttaatcatctgtgcttaaaaaattttgatatgatggaataaactaggaaattaaattttccttcaaacaaaggagaaaagatgacttacgaagattttatcaaagaagcaggattggcaagagaaaattttaggtgggcttgggcattttgtaatgaggttgatggtccaataactgagccagaattggctgataaacttttagatttagtattagaaggaaagaaaagtgcgacggctagtgctgtagctgagtatggtgaagatgaaccattcccttcagttgatggaaaatttgatattttactagatggaaaaggtcaaccaagagctgctattacaacttctaaagtttatgtgcgaaatttttttgatgtcagcgctgagcatgcttttaaagaaggagaaggggatcaaagtttagactactggaggaaagtgcatcaagacttttggagtgacttaaaagtatatagtcctaatatggaagtgctttgcgaagaatttgaagttctttaccaaaactaaaagtggtaaataaaaattgttgactatttttttagtcatgctataattattttaaaattatgctttatgaaaagaggaataaaatggaagaaatacttattgtgactacaaatgaagtggctggttatcgaattactgaagtatatggtgaagttttcggattaacaacgcgttcaagaaatttattttcaagtgccggtcaacagatgaaaactgttgtaggtggcgaaataaatggttatacaaaacttcaacatgaaacccgtgaaacttcgattgatcgtatgagagaggaagctaaagccaaaggagcaaatgcaattgttgcgatgcgttttgactcatcgactttccaaaatattgattctgtcgctgcttacggaacagctgttaaaattgaaaaaatctaaaggctagcgaaagctagtttttttatttccgaacaatttttagttaagcctgccaaaagaaatactattaagggaaaattccttcattttttgttagaataatattaaaattagtataattaaactcaaatatgagatgcctttagaggagaattatgaaaacggatattgaaattgctcaagctgctgacattcaacctattaccaaaattgctgaaaagattggactatcatttgatgatatcgaactttatggtaaatacaaagctaaaattcctttagaggttttagataagtttgaccaacagtcagaaggaaaacttgttttggtgacatcaattaatcccacacctgctggagaaggaaaatcgacagttactgtcggtttggctgatgcatttgcaagacaagttaaaaatgtaatggtggccttgcgtgaaccttctttagggcctgttatgggaattaagggtggagctgctggtggtggttttgcacaggtattaccaatggaagatattaatcttcattttacaggggatattcatgcgattacaactgccaataatgctatttcggcatttcttgataattcgcttcatcaaggaaatccgttaaatatcgacccaagaagaatcatttggaaacgtgttgttgatttgaatgaccgtgcccttcgtcatgtcactgttggacttggtggccctttaaatggtgtgccccgtgaagatggttttgatattacagtagccagtgaaattatggcggttttatgtttggcaacttcaatcagcgatttgaaagaacgtttaggaaaaattgttctggctcagtcttatgaccgtaaacctgtaacacttggtgatttaggggttcaaggggctattgcgatgctcttgaaagatgcactgaaaccaaaccttgttcagacaattgagggaacgccagctttgattcacggtggaccttttgccaatattgcacatggttgtaattctgttttggcaacaaaaacagccttaaaactatcggatattgtcattacagaagctgggtttggagctgaccttggtggtgagaaatttttagatatcaaaactcgtcagctcggaaaacaacctgatgcggtagtaattgtggctacacttcgtgcacttaaaatgcatggtggccttgataaaaaagaattgactaaggaaaacgtagaggctgttaaaaagggctttgctaatttagaacgtcatattaaaaatatgcagagttacggtttgccagtaattgtggcaattaatgagtttgcatcagatactaaatctgaaatttcagcattaaaagagctgacagaagcattgggagttccagtttcattgacccaagtctttgctaagggtggtgaaggtggtttagatttggccgaaaaactgtcaggaatgttacaagaaaaatctgattttagctatctttatgacctaaaagagccattatcagctaaaattaacaaagttgtgacagaaatttatggcggttccaaagtcaattattcactaaaggctaagcgtcagatgagagaaattgaagaaaatggttggaatgatttgccagtatgcatggctaaaactcaatattcattttcagaccaaccaaatcttttagcggcgccagaaggctttgaagttacagttcgtgagctacttccaaaaattggagctggatttatcgttgctcttttgggggacgtgatgacaatgccagggcttcctaaaaatccagcagctttaaaaatggatgtcactgatgatggaaaaatctcaggattattttagaaatgagtttaagtgattttgttacgtaaagattaaatgtaaattttttcggtaacaaatttacaaaaaattaaaaacttgtaaaaccgcttgtcaagcggtttttttgtgttatacttgctaacaatgttgaaaaaaataattatttctgcagcacttcttacaagttttagtgctgccctgattgcgaatcctgcaaaagcggattcagtatttgatgataataaagcacaaagttcactgacagatttgtcagcagcaacaaattcacttgatgttttaacaaaaacaatgaatgatactgttagtgccgtttcaaaagtagaaaaaacacaaagtgcggctaaagaagttcagacacgagctgacaaacttgtcagtacagccaaaaaatatttaggtgttccctatgtttggggtggaactacaccagctggctttgattgttcaggattcacaagttacgtctatagagaagttttaggtaaagaaattggtcgtacaacttgggaccaaattgcaagtggaaaacaaatcgggcttgaccaagccaaagttggagatttgattatcttttatggtggagaccatgtgggaatttatcttggaaatggccaagtgattcatgcaccacaacctggtgagtcagttaaaatcagttctgttactgatatgtcggctgattttgcattagagtattaaatataatagaaggaaatagcatttattgctatttttttgttattcttatagctaaatctggctataagttttttttatggcaaaggacttaagttcgtgttaagataggtctatcaaatttttaaaggggaacttttatgagaacatcactaaaggtcacatttgccgctctttcacttatcgctgctggaactttggttgcatgctcatcaggttcaaaagattcatcagataaagccacatctgttgtgattgcgacagatggggcaacaaagccatttacttattcagatagtcaaggaaatttaacgggttacgatattgaggttgctcgtgcggttttcaagaaattgccacaatataaagtgaaatttcaagtgacagatttttctgggattgcaccagggattgattctggtcgttaccaaatgggagccaatgattttggctgggaaaaaagtagagctgaaaaatattatttctcatcaccactatcaaaatcaaacaatgcagttcttgtgaagtctgggacttataaaactttggcggatttggctgggaaatcaacaattggtaatccagcatcaaattatactaagtcaattcaagattggaacaaagccaatccagataaagaaatcaaaattagttactcagcagattctacttcaattaacacaagattcacgcaagttgaatcaggaaaaattgatttcatgctttatgataagatttctttagagtctgcagttaaagaacaaggttttgacaatctaaaaattgaagatatcagtatggatactggtgatgctgaacatgacggttatgaatatttcctctttggcaaagattcgcaaggtaaaaaacttcaaaaagatgtgaatggagttttggcaaaaatgcaggctgatggtagtttggcgaaaatttctaagaagtatcttggtggggatttcgtgccaaaagcagaaatgtttaagtaaattttactgacaagaaatttaacctaaaatcgaagagctgtcagtaaaatatttgtctcttggcaaatcaaaatttactgacagctcagttcgtaaaaaataggagaaaaaaagaccaaaattttgtataatagtagaagtgatggtcaggtaaaaaatcgaacttataagtaaaaatattaaatgataagttcaataaatccgaataaactctgtcacttttttactgacagagttttccctattagaaaaataaaaaatatgaaaaaaaataaaaaaataattcttgggattgtcttgcttttggctttaattatcttgccagctcttccctttctcttaatcaaaggtcaatataattttcatgacttttggaccatgtttttcacaaagatttttagttggtcagcatttgtagatgcctttttaccaattataaaaatgattccgtcgtctcttgaaatgacaataattgccatggtctttgggttacttttaggactcattcttgctttggttcgtattaataaaattccaattttgaatcaattgcgtgctttgtttgttagtttcattcgtggaacccctatcttggtgcaattatacctttcatatacagggattccgttgattttaaaagcaatcaatatgaattatggaacgaattttaatgtcaatacaattccagctatgctttttgtcattgttgcttttgcactcaacgaaggggcttataactcggaaacaattcgtgctgcaattcaatccgttgataaaggacaaatcgaagcagccaaatcactcggaatgacaaacttccaagtttttatgcgtgtgactttacctgaagcagcaaccgttgcaacggctcctttaggaaacgctctgattggacttttgaaatcaacttcacttgccttcgttgcaggtgtggtagaaatgacagctcgtgctcaaattattgggggctcaaccttccgtttatttgaaacttatttagccttagctttagtttactggccaatttgtattatttttgaactcttaattcgtggattagagcgtaaattagacgtaagaatgccaaatgataaacgtaaaaatcgtgcacaaatttcattgagcaaaaatccatttaaccaagcctaaggaggacgataatgattaaaattacaaatataagtaaaacattttcgggtaatcaagttctcaatgacattagcttggaaattgaagaaggagatgttgttgcccttattggcgcttctggtgctgggaaatcaacctttctccgggctttaaatgatcttgaaagaccagatagtggtcaaattgaaattgatgacttaaagattgattattcgacaatcacaaagcaagaagtacttgaacttcgcagaaagactggaatggtttttcaacaatttaatctttttgaacgtcggactgcccttgaaaatgtaatggaagggttgattcaggttaaaaaattatctaaggcgcaagcaaaagagattgccgaagctgaattagataaggttggtctaactgaccggaaagattactatccaaaatttttatcaggtggtcaaaaacaaagggttggaatcgctcgtgctttagcgatgcaaccaaaacttttacttttagatgaaccgacatctgcccttgatcctgaattagttggtgaagttcaagaagtaattttaaatgcagctcaaaataaacaaacaatggttcttgtcagtcatgaaatggactttgtttataatgtagcaacaaaagtgctttttcttgaacaagggaaaatcattgaagcgggaactcctcaagaagttttctactcaccaaaaaatcctcgtacacgagagtttttatcacgtcatgtcaagaatttagaggttaataactaaaatgatgattttacagttttatttaaaaggtctattaatttcagctatctttgttttattggtaggtggattatatgcgttcacttaccttgtgcgaaatacgaaaaaaccgtggactgaaagaagaaaccgaatttttgatttaattttagttggtattttaacgacgcctatcctgagttttgctgttttaggagtacttgtaatactaagaattcgtggactttgatttctatttatgctttaaataaatctaattaatggaaaaatatcgtttgacaatgtaaaatggtgctataagattttagatattagaaaaaagagtttttagaactaataaaaaagggctcaagtttgctgaaatgctagcttgagtttatgaatttaaggggagttctttagctcttagaaaagggattaaaaatgacagaaaagaaatatgatgttgtcatcattggttcaggccctgcgggaatgactgcagcgatgtatactgcacgttctgaaatgaaaactttgcttttagaacgtggtgttcctggtggtcaaatgaataacacagctgagattgaaaattatcctggctatgaaacaatcatgggtcctgaactttcgatgaaaatggctgaacctttggaaggtttaggtgtagaaaatgcttatggttttgtgacggctattgaagaccatggggattacaaaaaaattatcacagaagatgatgagtttgtcactaaatcaattattattgcgacaggggctaatcaccgtaagcttgaaattcccggtgaggaagaatatggggctcgcggagtttcctactgtgccgtttgtgatggtgctttctttagaaaccaagaaattttagttattggtggtggtgactctgctgttgaagaagctctctacttgactcgttttggtcaatccgtaacaattatgcatcgtcgtgataaattgcgtgcacaagaaattatccaacaaagagctttcaaagaagaaaaaatcaactttatttgggattctgttcctatggaaattaaaggggatgataaaaaagttcaatccgttgtttataaaaacgttaaaacaggtgaagtaactgaaaaagcttttggtggaatcttcatttatgtgggacttgacccagttgctgaatttgctggtaatcttggaattactgatgaagccggttggattattaccgatgaccatatgagaacaagtctacctggtatttttgccgtaggtgatgttcgtcaaaaagatttccgtcaaatcactacagctattggtgatggagcgcaagcagctcaagaagcttataaatttgtagctgaacttgattaaaataaaaaaattactgacaaaatcgtcagtaattttttattaaaggattcggaatgacttttaatcgaaaatatggtaaactgtaagtaacgcaattttgaaaaaggagattaggtttatcgcctaagtaatttataagactatggaaaaagtaatttatgacattttgcttgttgcaatgcttgtagtttcagcatttattattgtagcgattttcatgcaaccttcaaaacaagatggagcagcagatgctttttcgggtggaacaggtgaattgtttgaacgtcgtaaagcgcgcggttttgaggcagtgatgcagcgttttacagcaatcatgattggcttatggctagttattggatttgctcttgttgttttatcaacacgttaaaattgcgggctgaaaacagtccgtattttattttcttataaatgtttttctaattgcgtcaaatgtttaattgtccaaattgtcagtggtagaattgattctatcagtcaaaaatgtctgataaaatgattaataccactgataatctcttaaaatattagctaaaaaatcaagttaatatttgaaacaaaaaaagaaaggggctttttgtccaatttttgtggtcaaaaagttcattgagagaatataatgagtattagagaagtaatcatggactatcttgagaatagttcaaaaaaagcactgtcagtagaagaattgtcagttgcgttacatatgaataaggctaaagattacaaagtatttgtcaaaactttagcttcactagaagccgagcatttgcttaattttactgcaaaaggtaaagttgaactcgccgaaaaagaagaggcaaaagttgtcatcagcggaattttccgggccaatgcagctggctttggttttgtcagcattgatgctgaagaaccagacgtttttgtcgcaagaggtcaaacggctttcgcccttgatggtgacgaagtttttattgaaattgataaaaatgccaatgcgctcaaaggaacttctgctgaagggcatgttgtcgaaatcattcgccatgacgtccatcaggttgttggaacttttgtagctttgaatgatgatgaaaaagagcaaacaggactgattggttttgttaaatctcggaataaaaaaatcccttatcgtgtttatttaggaaatgaaggattaattcctgaaaataaagcgattgttcgtgttgaaatcactcattatccagataaggaatttccacagacaatgcaaggattagtcactgaaattattggccaagcagatgaccaaggaattgacgttttggaagttttggcttcaatggatattgtttctgaatttccaaaagaagttttagaccaagctgaagctgttccagaagaagttccagaaaatgaaattgtgggacgggtcgattatcgtaatgaaatcacttttacaattgatggagcagacgcaaaagaccttgatgatgctgtgcatgctaaacgtttggaaaatggaaactatgaattaggagtacatattgcggatgtttcacactacgtcactgaaaattctccattagataaagaagcttacgaacgtggaacttctgtttatgtaacggatcgagtagttccaatgctgccagaacgtctctctaatggaatttgttcattgaatcctcgaatcaatcgtctaacacagtcttgtgtcatggaaattagtcctgaaggtagagtgatcaactatcaaatttctcaatcaattattaaaacgacagaaagaatgacttatgatgccgttaaccaaatgattgcaggagatgaagcagcacttgaaaaatatgctaaaattgcagattctgtaaaaataatggttgaacttcaccatattttagaagccatgcgtaaaagacgcggggccattgattttgatacagtagaagcgaaaatcattgtcaatgaaaaaggactgccaattgaaattagaaaacgaacacgtggcattgctgagcgaatgattgaatcattcatgcttgaagcgaatgaaacagtcgcgacacattttgaagcgcatggactgccttttatctatcggattcacgaacaaccaaaagctgatagattgcaacgttttattgattttgcagcaacttttggaatgcaaattgaaggaacttcaaatggtattgatcagaaggttttacaagctttcatgaagaaaattaaaggtcagcctggcgaaatggtcttgtcaactatgttgttacggagtatgcaacaagctcgttattcagaaaacaatgaggggcactttggtttagctgcggaaaattatacgcactttacttcaccaattcgtcgatatcccgatttgttggttcatcgattgattcgtgaaattggtgagggaaaaacgccagctaatattttacaaaaatgggaagataaaattcctgaaattgcagaacattctagtcatcgtgaacgccgggcggttgatgctgaacgtgaagttgaaaaaatgaaaaaagccgaattcatggaagaacatgtgggtgaagagtttgaagggattattacttcagttactcgttttggaatgtttattgaacttgaaaatacgattgaaggtttagttcatatttcaacccttaaaggtgattattttaattatcaagaaagaatgttggcgcttattggcgaacgaagtggacttacctttaaaattggtcagcctattaaaataaaagttgtcaaagctgatagaatgactggggagattgattttgaatatctaccttcagaattagatttgattgataaagcagcgaaagcgaagagaaaacctgaacataagggtcgcaaaaaatcaaatcaatctcttaaggttaaatcagtagcgacaaaatctactgacaaatctgctaataaatcaaaaaatggcagaagagctgacgagaaatctgaatttgataaaaagaaaaagaaatctgctaagaaaccattttacagtaaagctgctaagggcaaatttactgacaaaaaagataatggcaaaaaatttactgacggaagaaaaaagccacataaaagaggctaaaatttgagagaaaaaaatatgacaactttgaatttagaaaaaacagccttggttattattgacctacaaaaaggaattgcagggcgtgagggatttgctccttattctgcacaagaggttttagctaaaaataaagaacttgtaacaagtttaaaaaatacaggcgctttaattgtttttgttcacgtcaaaaactacggtggcgaaactttaaaaccaaaaactgacaatccagctgttgcacaaggacaaattccggcagattttgctgattttgtcatgcctgaagcatatgataaagaatataataatgtcattcatgtcgctaaacataactggggcgcattttacggcacggatttagatgtccaattacgtcgtcgtggaattgatgaaatcctcttgactggaattgctacaacgatcggttgtgatactacggcccgtgaagctttccagcatggttatcaagttattgctattgaagatgcaatgacagattttaatggacaactccatcaaggaattgttgagggaattttcccacgccttggacgagttcgctcaacacaagaagttttaaaaatgattgaagaaagtaaataagtttgggataaatattttactgacagactgtttaggagtggctgtcagtaaattttcctagaattatttagtgaataaataatatgaaaaatcgcttaaagttaattggaaaaattcttgtcagcattattttagtatttgctctgattattggctcttatgtcatctatgtttatgcacaatatcatcgccttcctaatgatatgaagcagacaattaaaaatcctcaaactcagcaagttgagctgggacaaacctataaaatgatgacttttaatatcggttatggatcttaccctccttctttcaattttttcatggatggtggggatgatgtgcgagcttatagtaaatctgctgtcaaatctgcaattcaagaagatatcagacttattaataaagagaagccagactttggaaatattcaagaaattgattggcaaggagatcgcagccaacaagtaaatgaacctcaaatggttcgtgctggccttcccgattataccagtgttctgacacagaattacgattcagcctttcttttttatccggtgaccaagccaattggaaaagctaaatctggaattatgacttattctaaatatgaaattgaaagttcaacaagatataagttgcctatcgaaactaattttaataaattttttgatttagaccgagctttttctgtcagtattttgccaattaagaattcagataaaaaattcgtcatctttaatacacatctgtcagcatttatcactgaccaaaaaattcaaaaacaacaattattgactttatttgatgagatgaaaaagtatgtttctaaaggagattatgtcatttgtggggctgattataaccatgccctagctggtaaagctcatccagaattaacatggatgaaggaatttcccacggaaaatttgacaaaaggaatgcgagtggtcgcaccaaccaatgccccaactgttcgttcacttgattatgcctatgataagaaaattccaaaaaatacatttggaattattgacggatttcttgtttcaaataatataaaagacttaaaaatacaaaccattgataatcaattcaaatcatcggaccaccagccggttgtcatggatttctctttggaaaagtaaaaaaagcgctaagcgcttttttattttacttaaaaataattcccagtaacaacgtaagggcaagagaagcattaaataacatcagattgtcaatttgaaggtggaaagtctctgatttactttgtttggctctaaattttttaatattaggaataactttcagggcaatgatgctcattaataatgaccaaattggtaaaattcccaaagcaatggcaattaaaatacaaagtccagcaaataaatatagtccagtaaatacttttaaactgagtggaatctttagataataaggtaaagtataacgctcattgcgaatgtcctgttctaaatcgcaaatattatcagaaaacataatattaaaattttgaacgaaacacatcagaccgactagaaggattggtaaaagaattttaaagtcccaagtccatgtcatgaaacaattcctgtcaaaattaatgaaaaaatagcctttatcataagaattaatatagacagcaaggaaaaaaccaaagaatccttcgcaaagaccggctaaaatttcgcccaaaggaaaacgagaaaaagcaaaaggaccataagtatagaaaatagcaattaagaaacaaagtccaccaattggtaaaatcgcaagattagtcaagaaaagaacaattagtccaacgactacatcaatcgctaaaagtgccaaacaaatgtttaaagcaagtttaggattaatcgatttagcaacgataatattccatttcttatactcaggatcaagtgctttttgataatccatcagattattccaagccgaaacaaaaagattaatgcttgctaaaccaataaaaaatagaagcgtaggccaaaaatgaaaacttccaaagtaccaaaaggcaaaaagacagccagcaatcggtgataataatgctgcgggcaaggtttgaatacgtgtaaaattaaaaaaagtttttaaagtcatgataagctgattatagcaaaaactagccaataaatcatgaatgattttgactgacagagctgtcagcaaaagtttattttactgacaagaaaattgactgaaaatttaaataaaaatgttataataggataaaaatttgaatggagaaacaaaatgcgcgcagttgtaacagtagtaggagcagataaaattgggattgttgctggagtcacagcaacattggcagaacttgaagcaaatatcattgaaatttcacaaaccttgatgagtggagcttttaccatgatgatggtagttgaaacacaaaatagtgatttttcagcctttcaagcagaactttcaagaaaaggtgaagccttgggtgtcaatattcatgttcaaaatgaagcaatttttaatgccatgcacaaattataatttactgacagaaaaaaattagccaataaatgacttttatttaaaagtatttttactgacagcacgaaaaaaatttctgtcagtaaaattttaatcaaaactaaggaaattaaataatggatattcaaaatatcaaagaaacaattgcgatgattgaagaacaaaatttcgacattcgcacaataacaatgggaatcagtcttcttgattgtatcgatgctgatattgataaagcagctgaaaaaatctatcaaaaaattgtcaaaaaagcaggaaaacttgttgaagtaggtaacgagattggacatgaactcggtattaaaattgtaaacaaacgtgtttctgtaacacccattgcaattattggagcagcaacagctgctgatgattacacaccacttgctcttgcgatggaccgtgcagcaaaagagattggcattgactttattggtggctattctgctcttgtgcaaaaaggctatcaaaaaggtgatgaaattttgattaaatcaatgcctaaagccctagcagcaactgagcgcgtctgtgcttcggtaaatgttggttcaactaaaacaggaattaacatgacagcagttcgagatatgggtgaaaccatcaaaatcatgtctaaaggtgataaatggctcaatgccaaacttgttgtctttgctaacgccgttgaagacaatccatttatggcaggagcttttcatggagttggggaagcagatacgattatcaatgttggagtttcaggacctggtgtagttaaacgtgctcttgaaaaagtccgcggagaatcttttgatattttagccgaaaccattaaaaagacagcttttaaaattacaagaattggtcaacttgttggtcaaatggcttcagaaagacttaatgttgaatttggaatagttgatttatcacttgcacctacaccagcaattggcgattcggttgcacgcgttttggaagaaatgggacttgaaactgttgggactcatggaacaacagccgccctagccatgcttaatgacgctgtgaaaaaaggcggagttatggcagctgaacgtgttggtggactttcaggcgcctttatcccagtttcagaagatgaaggaatgattgccgctgtcaattctggggcattgaatattgaaaaattagaggccatgacttgtgtttgttcagttggcttggatatgattgcaattcctgaagaaacaccagcatctaccattgcagcaatgattgctgacgaagccgccatcggggtcattaatcaaaaaacgacagcagtacggattattccaatgggcaaagaaggcgaacaaattgaatttggtggacttttcggtgtagcaccagttatgagagtaaacaaagcgtcgtcagcagattttattgctcgtggcggtcaaattccagcaccaattcattcatttaaaaactaaaaatacttttaaaattcagctcctaaatatttctaaaaaatgatgagcgcttccaaaaatgatataatagaagaagtgaaaaaatacggaggttattttatggcttacaaagtgaattttaaagatgtagaaacagttggcttggaaacttcgccggtagccgattctttagcaggtttacgagctaatgaagcacgttatttttggaataagtataaatttgagtatctcacatatccagctcatgaaaaagccgacgaagtcgctttgtttgagaaaattttacttgaagaacgtaatttaaaattttcagcaaaaatactcgaagttgctatctatgaaaatgatgaactctattggcctgaattctattacgaagacggtatggttttaaatctgctctatgaaaaagttggacaagagggcaagaaaccaaaacgggcagttggaataaagttgtcagtgggtatggaaatccccaaagaacttgagggaaaattcaaatttgcacgccaacgttcaaaactcgcaggtgagataagaggttcctactttacaattaaacaggaatggctgtaattttctatatagatagaaatatcctatcgtaatttttttgttagaatcaataaaaagggagtagaaatggtaaatatttatttagttcgacatgggaagacaatgtttaatacaattggcagagcgcaaggttggtctgatacacctttaactgcggcaggagaacaaggaattattgaacttggtctaggcttcaaagaaaaaggcattaaatttgaccgagcttattcatctgattctggacgtacaatccaaacaatgggttttatcttggctaattctgataatgaaggaattccatacacttatgataaaagaatccgtgagtggtgttttggttcatttgatggtggctatgacggagaactttttgatggcgttctaccaagaatatttactgaaactggaaatcatcataccgacgaatttcctccagatgaagtaattgctaatgcgatttttgaagttgatacggctggctgggctgaaccatgggaaaaactttcaggacgtatcatggacggttttacagatattgccaaggaatctgaagcaaaaggggctaaaaatattgttattgtcagccatggaatgaccattggaacttttgtaaaactcgctcacccagaactccctcgtccacatggtcttgataatggttctgtcactcatttaagttttgaggatggaaaatttaccattggaaaagtcggagacatgtcttatcgagaaatagggagtgaaaagttagctaaaaaatgaaaagaagaataacatttagtttaatcgtgcttgttcttttgatcattggcgctttgggatttattttatttaccaatgataagtcaaattcaacaaacgaatcatctaaaaaaacaagtatttcgtcttctaaagaggcggcaaagaaaaaagatttacctgacgctaaacaatcagattgggatttagtattggtgagtcgaaaatcacctaaagatgaaatgaacccaacactggcaaccgtaaatgggattcaagttgatcaaaggatagcatcagccgttcaacaatttttagcagcagcccaacaaatatcaccagctgaacatttaatctcaggttatcggtcagtctcatatcaagaagggctttatcaatcttatgtccaagcagaaatgaatggtcaaggaacagtaaattcaagtggaaatccaatttcagaagaagaagcgataaaaaatgtgcaaacttattctcagccaccaagaagctcagaacatcaaacaggattagcgattgatatgagtaatattgatagcctaaatgagagtcaatatgcaaaacaagttgcagcaattgctccaaaatatggatttgttcttcgttttccagaagggaaaaaggcagagacaggaattggttatgaagactggcattttagatatgttggtttagaaaatgctaaatatatgaccgaacacaatcttactttagaagaatatctaaaactattaccagcataaaggaaatgaaatcatgctaaaccgaaccagacttctactctatgttaatgttgctctatttatttacagtgtctcggaaatgattaaagttctccttgttcataataatttctttagtcaattttttaataacttatcgacaaatataaaaacattaacgactaaaatttcgtcaacaattacgagttggcaaagtttaatctatttattgatttttgctttattaatctttctattattgaaattttggcgttttacttttatacttttagaaattatttcggcacttttgattatagattatgccatacttttcattcaacatgaagtaaagtatgaaagcctctttgtcattgctgtaatggtaattacagtcatgaatatttggcaaacatccaaagattccaatcttttataaatgaaattagcactctaataaaaagagtgctaatttttatgtctttttgcttgacaaggtataaacaaagggttataataaatttgttagcacttatagatgaagagtgctaaaacagaaaaaagcttgtagatactaaacagaagtcaaaagctcaagaaatttttgagcttgcgaaagaagttttgcgaaacttcttatctgtggagaaaggagtagccatgattacagaacgtcaaagacaaattttaaatttgattgtttctctttatgccaaagagcatacgccaatcggttcaaagtcgctccttgatagtattcaagcttctagcgctacaatccgaaacgacatgaaagttttggaaaaactaggcttgattcaaaaagaacacacctcaagtggacgtgttccaagtgtttcaggttataagtattttgtagaaaatgtcatccagttagatgaatttagtcaaaatgacttatttaaagtgatgaaagcttttgatggtgatttttatcgcctatctgacctgtttaaaacagcagctaaaagtttatcagaactcactggtttgacaagctttgttcttaatgctccccaacgtgaccaacaattagtttcatttgaaatggtcatgctggatagtcattcagtactttcagttataacattagggactggtgaagtaagaacaaatcaatttattcttccaaaatcgatgaccgaagctgatttagcagtctttagtaatctagttaaagaacgtctggttggtaaaaaagtgattgatattcactatactttacgaacagagattccacagattgttcagcgttatttcaaagttacgagtgaagttctccaactctttgaatcaatttttgatgatttgttcaaagaacggctgaccgtcgctgggcgtaaaaatatctttgattatgcaactgacaatcttgcagaattatataaactctttagcgatgatgaacggatgcttcatgaaattcgcgaaatcactaataacgatgaaatgcgtgccgttaaatttgataatgacgaaaaatacatgaaaaatttaacgattatttcgcaaaaatttgttatcccatatcgcggttttggtactctaacagtcgttggacctgtagaaatggattatcaaaggacgttatcagttcttgacttagttgctaaagttttaactatgaagctgagtgactattatcgttatcttgatggtaaccattatgaaattagtaaatgataaaaaagttatttaaaaaaggagggcctatgtccgaagaaactaaagaagaaatcaaaaatgaaaaagttgatgaagaagtgactgaggagttaacagaggaagcacttgaggatattgttgaagaagaaatcaatgaacttgatgaagcacaaaagttagcgactgagtgggaaaataaattccttcgcgtttctgcagaaatgcaaaacgtacaacgtcgtggaaatgaagaacgtttgcaacttatcaaatatcgttcacaagatttagcaaaaaaaatcttatcttcactagataatcttgaacgtgcacttgctgttgaaggattaacggatgatgttaaaaaaggccttgaaatggtccaagaaagcttgatttcagcgcttaaagaagaaggcgttgaggaagtttcttatgaaagtttcgaccataatcttcacatggctgttcaaactgtcccagctgatgatgaacatccagctgacagcatcgtgcaagttttccaaaaaggttaccaacttcacgaacgtttacttcgtccagcaatggttgtcgtagcacagtaaattaaaaaataaattgaccgcaaagtctttaaactattcataagtaataagaaataaaggagatttaataatatgtctaaaattatcggtattgaccttggtacaacaaactcagcagtagcagttcttgaaggaactgaatcaaaaattattccaaatccagaaggaaatcgtacaacaccttcagttgtagctttcaaaaatggtgaaatcattgtcggtgacgctgcaaaacgtcaagcggtaactaacccagaaacaattatttctattaaatcaaaaatgggaacatctgaaaaagtttctgcaaatggtaaagaatacacaccacaagaaatttcagcaatgattcttcaaaacttgaaagctacagcagaagcttatcttggagaaaaagtagaaaaagcagttatcactgtacctgcatactttaatgacgctcaacgtcaggcaactaaagatgctggtaaaattgctggtcttgaagtagaacgtatcgttaacgaaccaacagcagcagctcttgcttatggtcttgataaaacagataaagatgaaaagattcttgtatttgaccttggtggtggtacattcgacgtttcaattcttgaactaggtgatggtgtctttgatgttcttgcaactgctggtaacaacaaactcggtggtgatgattttgaccaaaaaattattgactggatggttgccgaattcaagaaagaaaacggaattgaccttgcccaagataaaatggctttgcaacgtttgaaagatgccgctgaaaaagcgaaaaaagacctttcaggtgtaacaactactcaaatcagcttgccattcatcacagctggtgctgctggccctcttcacttggaaatggctttgactcgtgctaaatttgatgaattgacacatgatcttgttgaagcgacacgtcaaccagttcgccaagccctttctgatgctggcttgtcaacttctgatattgacgaagttctcttggttggtggttcaactcgtatccctgctgttgttgaacttgttcgtcacgaaacaaacaaagaaccaaataaatcagtaaaccctgatgaagttgttgctatgggtgcagcaattcaaggtggtgtgattactggtgacgttaaagatgttgttctccttgacgttactccactttcacttggtattgaaacaatgggtggtgtcttcacaaaattgattgaccgtaacacaactatcccaacttctaaatcacaagtcttctcaactgctgctgacaatcaacctgctgtagatattcatgtccttcaaggtgaacgtccaatggcagctgataacaaaactttgggtcgtttccaattaacagatatccctgcagcaccacgtggtattccacaaatcgaagtaacatttgatattgataaaaatggtattgtttctgttaaagctaaagaccttggtacacaaaaagaacaaacaatcgttatcaaatcaaactcaggtctttctgatgaagaaattgataaaatgatgaaagatgctgaagcaaatgctgacgctgatgcaaaacgtaaagaagaagttgatacacgtaatgaagctgatgctttagttttccaaactgaaaaaactttgaaagaccttgaaggaaaagtagaagaagctgaagttaaaaaagctgaagacgctaaagaagaactcaaaaaagcgcttgaaggtgaagatattgatgatatcaaagctaaatcagaagcactttctgaaatcgctcaaaacctcgctgtaaaactttatgaacaagcaaatgcagctcaaggtgaagctggacaagcaacggatgctcaagaagctccaaaagatgataatacatttgatggtgactttgaagaaagcaaataataatttataaaagcactgattcttttgtcagtgctttttttataaaaattggacaaaatagacatgttgtctaaaaactatttcagattcttgcaatcattttcttcttgtactatgatgaaattagtaagagattggaggagaattaaaagtaaaaagactaataaaattagtcaaaaaagatgttgtttagattagaggaggttaattattatgcgttatacaaatggaaattatgaagctttcgttcacccaagaaaaccagaaaatgttgatcaaaaatcagcttatattattggggcaggccttgcagggcttgcaacagcagtatttttaattcgtgacggtcaaatgtcagggaaccgtattcatattttagaagagttaccgttgtcaggaggttctcttgacggttcatttattccacatgatggtttcgttgttcgtggtggacgtgaaatggaaaaccattttgaatgtctttgggacttattccgaacaattccgtcattagaagtggacaatgcgtctgttttagatgaattttatcgaattgaccgtgatgatccaaattcatctaactgtcgtattatccataatcgtggtgaacgggttgatgacgatggaaaatttacactaagtccaaaagctcaagaagaaataatcaaattgttcatgactaaagaagaactacttgtaggtaaaacaatagaagattgttttactgatgagttcttcgaatcaaatttttggctttattggtgttcaatgtttgcttttgaaaaatggcattcagctattgaaatgcgtcgttacattatgcgcttcatccaccatattgaagggctacctgatttttctgccctaaaatttacaaaatataatcaatatgaatcgctagtaaaaccattaatttcatacttaaaagatcatggagttgattttaaatatggagcacaggttgaaaatgttgaagttgacttttcaaatggcaaaaaggtagcaaaagctattgtatttgctgacaaaaaaataaaagaactgacagaaaatgacttggtttttgttacaaatggttcaattacagaaagttcaactcaaggttcaccaacacaagccgctccgaaaactagtgaacttggtggctcttggaaactttggcaaaatttagccaaacaatcagaagaatttggacatccagatgttttttgtaaggacattccaaaagaagcttgggttgtatcagcaactgttacttggaaaaatttaaaaattcaaccttattttgaaaaattaacacatcgtcaattgcgttcaggaaaagttgtcacaggaggaattattactgttaaagattcaaattggctcctttcatttacaactcaccgccaacctcattttaaagaacaaaatgaccaagaaacagtaacttgggtttatggtcttatttcaaatacacctgggaactatatcaaaaaaccaattgaagattgtacaggtgaagaaattactcaagaattactttatcatttaggaatgccagaagaagaaattgaagcatttgttaaagaaaatactaatacaatcccagtatatatgcctttcattacttcttatttcatgcttcgtgaaccaggagatcggcctcttgtagtacctgaacaatcagtcaatttagcgtttttaggaaattttgcggaaactgagcgtgatacagtctttacaaccgagtattcagtcagaactgcgatggaagctgtttatcaattattaaacgttgatcgcggtgttccggaagtctatgcttcagcttatgatttacgaactttagcaagttcagcctactatctatcagataagcaaaaattagaagatttagagctctcatttattaaaaaacaagcgctcaaagttggacttaaaaaaatcaaagggacatatattgaagaacttttagaagatgcgggtctgatttaaaatttaaatgaagtcacaagaaatagtgaaggagcaaccttcgctatttttgatacaattatttttatgattgaagaaaatttataccaagagcttgttgaaattagacattatcttcatgctcatcccgaaatatcagaaaaagaagttgaaacgacaaaatttattcgtcaaaaattagcagattggcaaattgaaataatggatagtcagcttaaaacaggacttgttgcaaaaatggctcaggaaaacctattattgcgctaagagcagatattgacgccttgcctattctagaagaaacaggattagaattttcctctgtaaacaaaggagcaatgcatgcttgtggtcatgacttacatatgactagtcttttaggagctgctaaaattctaaaagagaaggaaagtcagtttagtgggacaatcaaacttatatttcaacctgccgaagaaattggcgaaggagccaaagaaattctaaaaacaggattagtttcagatgttcaagcttttattggctaccataatatgcctactttgtcagctggagtaattggcttacgtgagggtggagtaatggcagccgttgaacgttttgaaattttaataaaaggtcaaggaagtcatgcggcatatccgcaagaaggtcaagatttgattttagctagtgctgcgatcgttcaaaatctacaacaaattgtttctagaaatatttcaccactgagagctgctgttgtatctgtcacacacattgaagccggaaatacttggaatgttttaccaaacaatgctcgtttagaagggacaataagaacttttgacaatgaagtacgttccttaacaaagagaagattcagtcaaattaccgaggccactgcaaaagtttatgatgttgaactagagattaaatggttaatggaagcggacctcacgttcaacgatttcgagttgacagatgtcatcaggaaaagaaccgagcaatggcatgataaggtggtatatccagagccgtcaagtgcgggggaagacttcgctaattatcaaaagcaagctccaagtgtctttgcttttattggttcaaatgaacaaggggcttctggacttcattttgctgatatgatcgttcaagatgaaactctaaaagttgctgttgactactatttggaaagcgctcatcaattacttgaacactttaaataaaaactattattagatagttttttatttttgaatttttttggaagaaaatgatagttaatgattgattttgaaagataaaggtgttataatgatttttgtaaacgaattcaggagatggaaatgttagcaaatgaaagaaaaagacggattgttgactatctaaaattaaaaagaagagcaacgattgaagaacttcttacattaatggattgctctatatcaacacttaggcgagatttgaatgaattggaaaaagaaaaatctttaagacgagttcacggtggtgcagaacttacacaagacttatcggaagaattaagtatttccgaaaaaacttccaaaaacattcaagaaaaagaagaaatcgctcaaaaagcattatcgaaaattaaagatggggatattatttttttagatgctgggactacaactggtatcttagctgaacttatcaatcaatctcatctttatttaacgattgtaaccaactctgtcagtcatttggcgaaattaacagatgaccgattaatcgtctatctgctcggtggacgagtgaaaaaggtaacagatgcaataattgggagtcaggctttagaacaactttctgcttatcaattcaatagtgcttttgttggggctaacggctttgacaatgaacacggagcaatgacaccagaccatgaagaagcagcaataaaaggactagcagtcaaacaaagtcagaatgctttcatattagccgactcttctaaattaggacaaatgagttttgtcaaatttgctaattctgaagaagttgaattaattaccgagaacaattagcgtttgtttttaaatgagtcgtgtgaaaagatttcactaaaagttagtatttgtaaacctacgtcttaaataaaggagaattatgatttatacagtaacactcaacccagcacttgactacttcatgaattatgaagagttagcacttggtgaggtgaatcgaacagggaaaacacagatttcagcaggtggtaaaggaattatggaaagccgcatgctaagtcttataggtgccaaaagcaaggcactaggatttctaggtggattttctggtcaatatattaaagatttcttaaatgagaatcagattgattcggatttcacagaaatagaagatttgacaagaattaatgtcaagctgaaaagtcaggaaaacgaaacaagtcttgatgcggctggaccaaaacttcaagaaagtgaaattaatcaatttcttgaaaaatttgatcatttgaaagaagatgatatcgttgtctttgcaggtacaatacctaaaagtcttggtgaagatttctatgagcgtttgattgctaaagtccaaaagcaaaaagcaacttttgtcatggatgttgatggtcaaaaattacttgattcgcttcctgctcatcccctactcattaaaccaaaccgagaagaactagaagcaatctttgaaacaagcttcaaaaataatgagcaaatcattccttatggtcaaaaacttttagaaatgggtgctcaaaatgttatcgtatcaatggctggtgatggagcactcctctttacaaatgagaaagtttattttgctcaagggattaaaggagagctaaaaaattctattggtgctggtgattcgaccgttgcaggatttttagctgaatatagccagtctaaagacccgctattagcgtttagacaagcaatcgcttgtggaacttcaaaggcattctcagatgatatgccaagccgagcatttttggaagaaatttataaaaaagttaatatttcagaggtgaaatgatggaaataaaagatttacttaaaacagaggttatgattcttgacctccaagcaactagcaaagaagccgttattgatgaaatggtcaataaattagtttctgaaggttatgtcaatgatttctcaacttttaaagcaggaattatggcacgtgaggcacagacttcaactggacttggtgacggaattgcaatgcctcacagtaaaaatacagcggtcaatgagccagtcgtactctttgcaaaatcaaaagttggtgttgactacgccgcattagatggacaacctgtcaatcttttcttcatgatagcagcaccagacggtgctaatgatactcacttggaagctttagcacaactttcaacttatcttcttaaagacggtttccaagatcgtttgagaaaagttgagtatccaagagaggtcattcagcttttttctgaaaaacaagaagaaattaagactgttgaaaatgctgaacattatattgtagctgtaacggcttgtacaacgggtattgctcatacttatatggctgaagaagcgcttaaaaaacaagccttggaaatgggcgttggaattaaagttgaaaccaatggtgcgcgtggaattgataataaattaagtgcagccgatatccaaaaagcagatgctgttattgtggcagcggataagaaagttgaaatgaatcgttttgctggtaaagaaatggttcaagttccagttgcacatgccatccgagatactgaagaattaattaatcgtgcactttcaggtaaagcaccaatttatgaagcagacggatctgatgaagtaaaagaagaagcatctggtggattaggaaaagcattctataaacacttaatgggtggggtttctgcaatgcttccattcgttgttggtggtgggatacttattgctcttgctttcttgattgaccaagcaatgggagttcctcaaagtcaattggctaatctaggagtttatcatcctttagcagcttactttaaaaatgttggtggtgcagcttttgcctttatgttgcctgttctagctggtttcattgctaactccattgctgataaacctggtttagttgctggttttgtcgctggttctatggcatcttctggtcttgcatttggtcatttagatcctgctaaaatgattccatctggcttcttaggagccctagttggtggtttccttgccggtggtgtcattatccttttacgtaaagcttttgcaaaacttcctcgttcacttgatggaattaaagctatcttgatttatccattagttggaacatttatcacaggtttcctaatgctctttgtcaatataccaatggcagcaattaataccggtctctctaacttcttagcgagtctatcaggagcatctgcccttgtacttggtttagttgttggtggaatgatggctattgaccttggcggtccaattaacaaagctgcttatatctttgcaactggtactttagcagcaacagtttcaactggtggctcagtaacaatggccgccgttatggctggtgggatggttccaccacttgcaactacagtcgctgttatcttgtttaaaaataaatttactaaagaagaacgcaatgctggtttgacaaatatcgttatggggctttcattcatcactgaagggtcaattccatttggtgcatctgaccccgcacgcgcaattccatcatttatgattggagcagcagtagccggtggtttgactggtatggcaaacattaaattgatggcaccacatggtggagtcttcgttctcgcattgacaaacaatcctttactttatctcttgttcatcttgattggcgcaattgtttcaggcctattatttggtgcattgaaaaaagcaaaataaaaatgaatgagaataataagagcggtttaataccgctttttttgatataatagaggaagtaaactgggggattgggagagattattttgagttttattgcactttttgagctggcgctttttttccttaatgttatattatcctttgtcattatttttagggaaagaaaatcaacagcggcaacttggtcatggctctttgtagttaatttactgcctatcataggctttattttatatttactcattggacgtggcatttcacattatcgtatttttaaagaccgaaaaaggtttcagttgggttttgaaaaacaattagaacatgctgaaaaatcttacacagatcgattatttattaaaaaaatgagacaaaatcatgtaattggtcagttgattcatatgctttatgttgaagaaaaatcaattatttcaacaaatactggtgtgaaaattttcaatgatggacgtcagaaatttaatgctctgattgaggatattaataaagcaaaacatcacgttcatatggaatattatatttttcggatggatcgaatgggtcatgaaatctatgatgctttacttgcagctgcaaaacgaggagtggaagttaaacttttaattgacgcttggggttcaaataaaacaaaaatgtctaattttaaagaacttcaggaggctggtgggcatgtagcgcaatttttcccattaattatgcctttagttaatccacgaacaaactatcgtttacaccgtaaaattgtagttattgatggaattattggatacacaggtggatttaatgttggtgatgaatatgcttcaattacaaagaaatttggctattggcgtgacaatcatttacgtttgactggtgatattgtttatagcctacaacatcgttttattttagactggaattctcaacatcattttgaagtaaccgagggagagccttatttcccagattcgattgttgaaggtcatgtagcgactcaacttgtaacttcgggaccagatgaggacaaagagcaaatcaaattaacttacatgaagatgatttcgggtgcagagcgagagattatcattcaaaccccttattatattccgtctgatgctttacatgaatctataaaattagcattactatcgggtgtacaggttaaattattgattccaaataagccggaccacccactggtttattgggcgacttatttccatgctgctgatttagttaaatatggtgcgaaagtttatacttacgaaaatggatttgttcactctaaaacattgattatagatggagagtatgcttcagttgggtcagctaatttagattatcgaagtttgcaattatgttttgaagccaatgttgttatctatgattatgacatttctcaaaaattacgaaatgattttatgaaggatttgaaattgagccgtccattaactttagcgcgttatgaagaacgtactaagttagttcgttttaaagaaggtttagctcgtttaattgcaccaatgctctgaatcctattattaaaaattgaagtagttagatttattgaagaaaaaattaaaaagagtaagatgaaaatggaggaaagagatggagaataaactcaatattgtgattattacagggatgtctggggcaggtaaaacggttgccattcaatcctttgaggacatggggtatttcacagtagataatatgccaccaaatttaattgaaaaatttgtgggccttttgaatacaccagataataagattgataaagttgccttggttgtcgatatgcgttcacgcgctttctttgaagatattcaaagtattgtgactgaattgacggataacgggtctgttaatttcaaacttttatttttagatgcaaatgatactgaattggtttcaagatataaggaaactagaagaagtcatcctcttgctattgatggtagaacgcttgatggaattactaaagaacgtgaaattttagctgatttaaaaaatctttcagaagtggttattgatacaagcgaattgactccaagaaatcttcgggcaagaattttacaaaaatttgcttctagtacggaatctacatttagaattgaagttatgtcatttggatttaagtatggcttgcctttagatgccgatttagtctttgacgtccgtttcttgccaaatccgcattatattgctgaattacgtgataaaaatggaacagataaagaagtttatgactatgttatggaacatccacagtcggaagaattttatgaaaatttgatgaaaatgttagttccaattcttccagcttataaaaaagaaggtaaatcagttttaacaatcgcttttggttgtacgggtggtcaacaccggtcggttgcttttgctgaaagagtctctgcggctttgaaggataaatggcatctcaatgtcagtcatagagataaagaccgtagaaaggaaacggtaaatcgttcatgagcaatccaaaagttgtagttattggtggaggaactggaattccagttgtcttaaaagcacttcgtaaagaaaaaattgatttaacggctattgtaactgtggcagacgatggtgggtcttctgggcgaattcgttcagcggtgaatattgcaccgccaggtgatttgcgtaatgtattgattgccatgtcagatatgcccaagttttatgctgatattttacaatatcgttttgataaatctgatggtgaattagctggtcatcctctgggtaatctaattattgcagcagtttctgaaatgcagggttcaacttatcgtgcaattcaaacattagctcaattttttcatgtggaagggaaaatttatccttcgtctgatgccgcattgaccttacatgctgtttttaaggatggtcatgaggtcttaggtgaaagtcatattgctagctataagggattgattgaccatgtttatttaactcaaacagctagtggtgatagtccagttgcgtccaaaaatgtagtgaaatcaattatggaagcagatactattgtcttgggacctggctcactttttacttcgattttacctaatatcgttattccagaaatctgcgaggctctttggaaaacctcggctaaaattgtctatgtttgtaatataatgactcagcgtggtgaaacagagcatttttcagatgctgaccatgttcgagtattaaatgaacatattgggacaaaagtgattgatactgtcttggtgaatattcaagaagttcctgaagaatacatgaatacgaataaatttgatgaatatctggttcaagttgaccataattttgaggcattaaaagcagaagaggtcaacgttatctctaataacttccttgaacttcgtgacggcggagcctttcataatggtgaggctgttgctaaagaaattgtcgcaatttcacaaagtcaagagtttagacattaaaataatttactgacagagtgtttgtcagtaaatttttataagaaaaaagtctgacagaaagaatagagcagggaaaaaatatcctgtcctgtatagaaagaattatgagtttcacaagtgatgtaaaaaaagaattaacgagtaatttagcaacaactggagcacttttggcacttgtcagaatgaatggctctgtgggtatttttaatggattaactttatcgattacgactgaaaatgctggaactgctaaatatatttatcaaatgttaagagaactctacgatgttcatgctgaaattcgtgttcatcaaaagactacactctctaaaaatcgggtttatacggtttttataactgagggtgcgagtgaattattagatgaattaagtttagcagattcgttgatgttggataatggtgtgccagaatttgttaaaaatgacgaatttatcaaaaaggactatttacgaggtgcttttttatcggcaggctctctccataatcctgaaaaaggtgagtatcagttatcaattgctagtgtatatcaggaacatgcggaagatttacaagaaatttttcgagattttggtttaaatgcgcgcgttattgaaaggaaaaatcgctggatactctatttatcaaaagctgaagaaataatggatttcttgactttaattggagcgatgaaagcaagattgaaatttgaagaggcgaagattatgcgtgaaatgcgtggtttagctaatcggcagtccaattttgaaaatgctaatattgctaaatcagttatggcggctcaagaagcaattaatgctattaaatttcttaatgagagaaaagaattagaacaacttccagagaatttaaaggaaattgctcgtgtacgtctagaaaatcctgaagcaacaattaaagagttgggagagttgcttgaaccccctttagggaagtctggagtaaatcaccgacttagaaaacttgttgaacaagctaatgagttaagaaaaattgagaattaaaaaaactagctagatattcttgctagtttttttatactttgtcttatttccagccattgaggaaaaaacgagaaacgatttcagctttttctataagtaaattcattgataaacctttcattcctgaattgaaaatacttaaaatcagaagaaaatcttcttggctataatcactagaaatttttccttccgcctggcctttttgaaaaagtaatagataaatctgcttctgtaaagaaagggcatcatcatctagtaattcaggactatttgtatattgagtcatcatgttttctgaaaaaatcggctgataaagttcaagttgctgaatttttaattgaagaattgcttgataagtctgattaaaatctaaattactttcaataagagttttaatttccaaagacaattgattgagattttgcctaataacctggttaatcaattgatttttgctatgaaaatatttaaagagtgtcacttttgaaacatccgctttgtgggcaatttcgtcaacggtaatttctctaattgttttttggtttaataagtgaaaagtggtttctagaatcgcttttttctttttttctgtttgattcataaaagttcctttcaacttgattggattgggtatttactatcaaaaattatagcttttttcttgaactatttcaaatgtaagcgtaaaatatgaactataagtaatgattcagtacattttataataatagaggataaaattcaggaggaagaaagatggataagctagttgaggtaaaaggacttcaaaaaaactttggtcaatttcaagccttaaaagatgtttcttttgaggtaaatgctggagaagttcttggctatattggccctaatggtgctgggaaatcaacaactattagaattttgcttggaatcattcgagcgacccaaggaaaagttcaaatttttggtaaggatgtctggcaagattcaattgagattcataaaaaaattgcttatgttccaggggatgtttatctttggccaaatttatctggcggagaaacgattgatttatttttaaaacttcatggagcaatcaatcaagaaaaacgagaccaattaattaaaaagtttgatttaaatcctaagaaaaaagttcgctcttattctaaaggaaatcgacaaaagattgcgctcattgctgctttagcaactgaggctgagctctatatttttgatgagccaacgagtggtttggatccacttatggaagccgtttttcaagaagaagtaaaagcactaaaagctgctggcaaagcaattattttatcaagtcatattttatcagaagttgaaaaattagctgatagggtagcggtgatccgaaaaggagagattgttgaaacaggcacacttgatgacttacgacatttgaccagatatcagtataaagttgaaacagagcaagaaactgttggcttaaaagaattatcttctgttcatgatttacaaattaaagagaatgaagcgacatttcaagccgattcagatgaaatagatgaaattttaaaaacgctcttactttatggggtaaagaagctggaagccacaccaccaacacttgaagatctgtttatgcgacattatcaataggaggcttactatgaaacaaccactttataatacaggagttttatttaagactttaataaaaagggattggtttaagttagttttctggattttaggaatgcttgcttttgctgcttcaggggcagggaaaatggaagttgcctcgaatccggcgacggctagtactctttatacaatgtttgtcaaaaatccagcaatggtcggattatttggaccaactccaataaataatccaactaattatagtctggggccgatttttggtcaaaccatgactttaattacggggctgactttcgctatcatttcgattatttatgttgttaatcgaagcagaaaagaagaggatgatggaattacagaactttttcggtcttattctattggaaaattggcaaatacgactgctttagtcatggaacttttgctcttacatttaataatggctgtcttattagctctttcaatagaggcccaaaacgtggctggcttgaatcatttagaaagtaatttcctatttgctttcacaacaagtgctcagggtttcctttggggaatgtttgctttacttttcggtcaaattttctctgaagcaagtacaactaaagggatgacattcggtttactgggtttgttatatattgttcgaatgctaacagatgtaacaaatctttccataggttggttcaatcctctgtcttggtcttatctagcttttccttatgttaaaggtcatgaaaattggttagctgtctttttgacttttctcttagcttttctacttttaggaatatcctatatcctagagcttaaaagagatgtgggagtggggtattttcccgaaagaaaggcgcgacttcatgggaaaaagggacatttcggatttcctggtctcgttttgaatcttgaaaaaaagatgattatcggttggcttttggcaagttttgttctgggcttagtttatggttcaatgtttggacaaatggaccaatttatttcaagtaataaaaccgttaaggagctttttgttgggaatgaaacggcagcgagtgcgattagaggaaacttcatggtcactctgttttcgatattgtcaatcttaatcgcagcgtttggtgtaattttactgacaaaaatggtgagcgaggaaagaaaaaatcgtctggaagctctttatgctttaccactttcacgactaaaagtgtattccacttatttactgacagctattctgtcagtaattttagctcagtttttagcgctttttggaatatttattgaacagttgggcaataaaaatgctttgagcttcttagaaattatgaaatctggtatgatttggcttgttgctgtcatatttgttttagcaatacttagtctgttacttgggtttgtgcctcgtttggcagaattaatttgggtatatcttgctttcttactttttatgacttatcttggaaaattactatctttgccaaaatggcttgaaaatttaagcatttataactatattcctaaattgccagttgagaaaatgaatcttcctaccgttttattcatattaattttatctgtcttattaattttacttggctttgaagcttatagaagacgcgatttaatcacggggtaaaataaataaaaaagctatcataattgatagttttttttatgaaaattgatattttatagattactttcaaaagtgtcagaatagtatttattaagtatagtaaaataaataaatatatatatataaattaagatttaggggagaattatgaaaaaaattattatttttgctgctcttgcaagtgtattgacatttggcgcttttaattatctaaaaaaaccggggagtgagctgggagtcttagccactaaagcagtcacacctaaaatattgaatcctaaaaacaatgaagtaaatgagaaaagtttagataattttgcgaagaatacccatataattatatcgtcacctgataaagagaaggcgattgatgaggtggtagaagaagagttaaataagaaagataataaactgaataaggatgaattatatgctctatataataattcaactgaagaattagaaaatactagccgttcagttgcagattttatgaatgatatattaggaagtaaatagcgaatagcttgacttttaaattgtaaaatgaacaacaaaatgtcgtataagcctgattttacagtatttcttagcattaataagaaatttatgatagaatgaatgagttattttataaatacgctttcaggagaaaaattatcatgatgaatccggcagaaattttatctgcgaccattcaccacggtcaggaaaaaattaaacgtccatttttagaaaaaactgtgcttggttttattggcggagcaatgatttcctttggttatttactttatattagagtagtagcttccgttgctgaggaattaggaagccttgcgagcttaatcggagcaagtgtttttccaattggcttaatcgttatcttattgggaggtggtgagttaatcacttcaaatatgacagctgtatcaacttcattatttgctaaaaaggtaagtttgagtgatttgcttaaaaattggttgattattactttgtttaatgtgattggagcaatttttgtcgctttcgtctttggacatctcgtaggattgactggtacaggagattataagacggaacttttgagattggctcaagcaaagattaatgcgagttggtcacaagaatttctatcagggattggttgtaattggtttgttggtttagctatgtggatgtgttacggagcaaaggatgcggcagggaaaatattggccgtttggtttccagtgatggcttttgttgcgattggttttcaacatagtattgcaaatgcttttgttattcctgcagcaatttttgaaaatggagcgagctggctagattttgctcataatttcttgtttgtttatcttggaaatcttttaggtggatcaatttttgttgctggtttttatagtttagggtatcgtagacaggctagagaacaagaagaacttaaaaatcaagaataaataaaaaaagttactgacagaaagtcagtaactatttttttaactgatgataacgattgtaccaaatctcgacgtactctttagaaaaaggtcctttttcattgttaatccagtcaacaagaattttgacattttcttttagaatatgatcaatttcctttggatagtgcattttgcggcggtggcgttcatattcttcaacatcgagtaattttttttctccatctttgaagaccttcacgtcaaggtcgtaatcaatatatttcagcgcttcgttatcgaggacgaaggggctcgctagattgcagtagtagctaacgccttcctcacgaatcatagcaatgatgttaaaccaaaactttttgtggaagtaaacaatagcaggttcgcgtgtcacccaacgacggtcgtcagattctgtcactaatgtgtgatcgtttactccaataattgaattttcatttgtttttagaaccatcgtatcgcgccaagtgcgatgaagattcccatcatgtttatagctttgaatcgtgatgaagtcgccttctttcggaattttcaaggctattctctctttctcaattcaaagttctcatctattaatataccattttttaaatgaaatttacagtaaaaatgtttagtttaagcaataaattactaataattgttcggatttttttatttttatgtagtagaactgtgtttttatactatcaagaaatattagtcatccaagtcaaaaattgtcaaggcagactgaaattcttcccgcaaatgtgctttacgaaattttagccaatcggaacttttgcgaatcgcatggtatcttttgcgcaaatgccagttttcggcaatttgatactgcggatattcttctaaaaagtgattaatcatctgccactcataaggatagcctagtggatgagcgtgatagaggactttgtcaatggttaatggcaagcgtctttgatgaagatgaccaaaaacaacatcactgattttgggaaatttattaaaggtttcatgaaaatgttgcgaacctaagtaggcattaaatcgggcaaatttttcataacgagtattaatgataaattgctgatgaggaacgaaatgagtactgacaataattctatcaatcttaggatttgctgatagttctgtcagtaacttttctaatttctgtaattcaagatttgttatcttgatatcatcaaattgacgatgaatttttctatcaaaataaaatgaatttttaaaagctatgattttttttatatcaatttttccagtcatgaaagaataatcataccaaccgtggaagctgacaaaagcagtggaagcaaaagtttttacttgaaaattactgacagaaatttcttcttcagaaagaccaaccatatcgtgatttccaagattgtaagtgactgacagctctgtcagtaattctatttgcttgaaaaatggttcggaaattccgtgaaaatcatttgaaatatcaccagcaaaatgtaaatctgtaatctttaaatcctttaaaagagacagaaaaatatcaatttcttcttgagaaaaatgattagaatccatatgaaaatcagaaatcacagccaagcgtctttttttagtcataataaaattatagcatgtgatagaagttctatctaataaataaatttttgatgaatcattatctattgaatagcttactttaggcttataagtggtgaatatggtataatgctactatggaattatcagaaattagaaatttacttgaaggatatgctgagaagattaatggctttcgggaatcattagatcttgagcgtttggaagaagaaatagctcttttagaaaacgatatggcacaacctgaattttggaatgatcaagcagcggctcaaaaagtgattgatgaatcaaatgctttgaaagccaagtatgacaattatcaagcgatgaataatatgcttgaggaagcgcaaacgatgcttgaaatgcttcaagaagaagctgacgaagagatgcaagctgagttagaggaaatgacaattgcgctgggtcaaaaaattgaatcttatgagcttgaaattatgctcaatcaaccttatgaccatatgaatgctgttcttgaaattcacccaggttctgggggaacagagtcgcaggactggggctcaatgttgatgcggatgtacactcgttggggcgaagcacatggatttaaggttgaaattctcgactatcaagacggagatgttgccggattgaaatcagttgcccttcgatttgttggacgaaatgcttatggctttttgcgaggagaaaaaggagtacatcgtttagtacgtatttcaccttttgattcagccaatcgtcgtcatacttcatttacctcagttgatgtgatgcctgagttggacgattctattgaagtagatgttcgtgatgccgatgttaaaatggatacttttcgttcaggtggagctggtggacaaaatgtcaataaagtctctactggtgtgcgtttgactcacatcccaacgggaattgttgtgcaatctacaatggatagaacgcaatatggtaaccgggataaagcgatggctatgttgaaatcgaaactctatcaattagaaatggataaaaagcaagctgaagttgatgaacttcgtggcgaccaatcagaaatttcttggggaagtcaaattcgttcatacgtattcatgccttatcaattagttaaagatacgcgtactggctatgaaactggacaaatttcaaatgtgatggacggagaattggacgggtttattaatgcttatctccgttggaacttgtagattataaattaaagtttcgtatgtttgaaacgtttacgaaacattaaagttattaatgaaaaggttataaaataaaagtgccacctaaagcacttttattttgatataattataagagttcaattgatggattcattctatgaaactgtcggtagggctaaaagttctgttattttagaaaaaaagaaaaggtacgtgtgtgcccgttttcttgttttttgagagcaggatttaaaaacatccatagtgattaaaaaaatggattttacggaggagtcctaacgtttgttaggacttggaagaaaaatctagcataggaaaggtactatgagtattataaaattaagcaacgtttccaaaaaatattctaatggaacaacggctttgcgtaatatctcgcttgaaattgagccgggagaatttgcctatatcgttggtccatcaggagccgggaaatcgacctttatcaaactactttatcgtgaattaaagattgaccggggttctggaacagttgcgcaatatgatttatctaaattaaaacgtcgtgatgtgccaatgcttcgtcgctctgttggagttgttttccaagactataaacttttgccaaagaaaactgtttttgaaaatatctcttacgccatggaagttattgggaaaagtcctcgtgaaattaaaaaacgagtgaatgaagtgcttgaccttgttggtctgaaacacaaaattcgttcatttccaaatgaactctcaggtggggaacaacagcgtgtagcgattgctcgttcaattgccaatgcaccaaaagtattgattgctgatgaacctacagggaacttagaccctgaaaactcttgggaaatcatgaatctgcttgaaaaaattaatcttcaagggacaaccattttgatggcaacccacaatagccaaatcgttaacactttaaaacaccgtgttatcgcaattgaaaacggacgaattgtccgcgaccaagaggaaggagtttacggctacgatgattagaaatttcttcaaacaccttttggaatctctcaaaaacttaaaacgtaatggttggatgacagttgcggctgtttcatcagtaacaattactttagttttagttggacttttcctttcagttatcttgaatacttcaaaaatatctaatgggattgaaaacaatgttcggattgttgcctacatgaaattagatgttcatgatcaagagacaaaaattcaagatccaaaagataataaaaaaacaatcaataatcctgaccaccttaaaatttacgactcaatcaaaaaagttcctaatgtaaaaacagttgaattttcaagtaaagaagctcagttacaagaactaacaaaggctttaggaaataactggaatctttttaaaggggatgccaacccactttatgatgcttatcttgttgaagctgataaaccagcaaatgtaaaatcagtcacttcaaaaatttcaaaactttcaggaattgaaaaagctacttatggtggcgccaatactgcaaaactgttccaaattgctcagggaattcgaacttggggaactgctgccgcagctttattgattttcgttgctatcttcttgatttctaacaccattcgaattactatcctatcaagacaacgtgaaattcaaattatgcgtctggttggagctaaaaatggttatatccgttggcctttcttcttggaaggagcttgggttggacttttaggttcaattattccaggacttatcgttgcttgggcttatcgtcttgcttttgttagcttgacaccaagtcttcaatcacaaaaacttgcaatgtttgctcctaaagagttcattcctgcaattgttggattgatggccgtgattggtattttgattggttcatttggagccctcttatcaatgcgtcgtttccttaaaatttaataaaaataaaagagaagttaaatcttctctttttttttgcaaaaaaaaagctgtcagtaaataagtttttacttatttactgacagactcttaaatttgtttaattagatatcataatcttcatcagacatggcttctacttcgccaagaaggtatgaattaccaacttgtgagaagaagtcgtggtttgatgaagaagttgaaattccgttcataaccactgggttaacgtctgctgcggtatcagggaaaagtggatcttgtccaagattcatcaaagctttattggcattataacgtaagaaagttaaaacttcatcagtccaaccgactttgtcataaagtaaacgagaatatttttcttcattttcataaagttgataaagcaattcatacatccaatcacggaattcaccttgctcatcttcagataactcattaaaaccaagttggaatttgtaaccaatataagtgccatgaactgactcatcgcgaataattaatttaataatttccgctgagttaatcattttgttatttccaagatagcgtaaaggggtatagaaaccagagtagaagaggcaagtttcaaggaaaacagaagccactttcttttgcaaaggagtaccagattcataaattttattgatgatttcggcttttgtttgcatataaacgttggtatctacccaattaaaaagttctttaatttcttttttcgtgtttagagttgaaaaaattgttgaataagactttgcatgaacagattccataaattggatattgttgaaacaggcaatttcttgaggtgttcttgcatcatgtttgagcacttcagcaccatcaacagattgtaaagtatcaagcaatgtcaaaccagcaaaggccttagcaaaggtatcacgttccaattgaggaagtttacgccagtcatctaaatcgttagatacaggaacacgagtatctaaccaaaattgacttgttaatttttcccaagtatatttgtcaatagaatcctcaatagaattccagtcaatggcactgtaataagtggggacagtaagattttcagtttcagacatattttaagatatgagcctgctttaaaaagggcaaactcaattcctttctctcatttatttactgacagaaaatattgtcagtatttttagcttagtcataaattctgtcagtaaattttcacttaccaacgaagctgtcagtaaaagtagggactcattagaccaaaaactttcgataatttatcaaaagttaatgtcaataatcgttttagaacatttcgcaaatgcttaccccattttcattcattgacgatactttaatgaatgaaaacaagtaagaaaatagaaagtccgtcttagcggcttccgtagaagcaatagatgctttagcaccaatgcttctgttgtattatataacgcaactttcacattggttagcaccgacttcttcttggtcgtcagtaaatgtacgaatgtagtaaattgttttgattccttttttgtaagcatagttacgcaaaatagacaagtcacgagttgtcattttattatttgccactttccattcatagagaccttcaggtaaagttgaacgcataaataaagtgagtgacaaaccttggtcaacatgttctgtagcagctgcataaacgtcaattactgcacgcatatctgtatcataagctgatttgtaataaggaattgtttcagtggcaagtccagcagctggataataaattttcccaactttcttttcttgacgttcttcgatgcgattgacaattgggtgaatagaagaagaacagtcattgatataagaaatagaaccatttggagccactgccatacgatatgaattatagagtccagaagtttttactgtgtcacgtaaagcagtccaatcctcaattgttggaacagcaatccctttgaaaagttcttgaactttaggagagacagctgcaaaataatcatgtgttaaatatttatcaaaataagaaccatcagcataggcagatttttcaaaattcttgaagctagaccctttttcaacagctaatttatttgaagccactaaagtataatagttcaacaacatgaaataaacactagtaaattcaacggcttctttgctgtcataatgaatttgattttgtgctaagaaagaatgtaagcccattgctccaagcccaatcgcatgcatttcatcattacctttacgaacagttggaacagtatcgaggtttgaagtttcggagatgaaagttaaagcgcgaaccattgcttcaatagaagttccaaattcattgctagaagtcatcatattcaaaacattagttgaacccaagttacaagcgacgtcagttccaaccaccttataagtttggtcatcgttcaaaacagaaggcgtttggacttgcaagatttcagaacaaaggttagacattgaaattacaccatcaacagggttagcttgattgactgtgtcaacatttacgatgtaaggataaccagattcttgttgaagttttgaaagttcttgctcaagttcacgggcattaatcggtgttttacgaatttctggattgaccaccattttgtcatattcagctgtaatatcgacttcggcaaaaggtttaccataatatttttcaacaaaatatggctcaaagagatacattgtttctcccttttttaccaattcatagaatttatcaggaacagtaaccccaagagaaagtgttttaacacgaattttttcatccgcattttcttttttagtggacaagaattccataatatctggatggaatagtgataaataaacaacaccagcaccttgacgttgccccaattgattggcataagaaaaggcgtcttcaaaaagtttcatgacaggaacgacaccagctgccactccatcataacctttgataggtgcaccagcagcacgtaaattagtcaagtttagaccaacaccaccaccatttttagaaagttgcaaggcagagttaattgttcgtccaattgaattcatatcatcagttaattgtagaagaaaacaagaaacaaattcaccacgacgcttacgtccagcatttagaaaagtcggagtcgcaggttgataacgacgattaatcattgcaaaagcaagattattagctaatttttcatcgccgtcagccatgtataaagcattcattaacacacggtcttcaaaatcttcaagatagagagaaccgtcattgtttttcatggcatattgattataaaatttgtaagcagccataaatgaatcaaaatgaaattcaaatttactcaattctttacgaagattggtaatgaattctggtttatatttttcaagaaactcagcttctagatattcttctttaacgagccaattgagtttatcgatatatgtatcggcttcataacgattaggttcgacattttctttaaaaaaagcagtaattgcttctttatctttagcaagaggaatgctaccattaacgggaatattaatctcgttattaagcttgaaataagttacatctttaagttgttttagagacataagtgacctttcttaaagcgttcaaccataaagaacagaggggtgaactctaatattataataagttcaaactaattaatagaaataaaaagttaaaaataaagaggcttcactcaatagggtgaagccataaaatcacagcggatttttgaaggtgactttcgctcctttgtcaagctgtgtagcgagtttttcgacagcagcaacatcggctggtgtaccattaaactcaaaatcatataaaagcggaatttggtattttgcagaaagttctttagcagtaaaaatataaatacctgcgaaattacgatttcctgtaccaataattcctagacaatgtttataattatcattataagccataaagtcaaaaacagggtccataacatctattgatttggaaacagttggagattcttcggcataacttggcgttatcaaaagaaaaggttcattcatttctatatcatcgtcaggactaatttcgacatttggtaagtttgttttggaaacaaagcgacgtgtttgcccagtcacactgaaataagcaagtttcatattaagccaactttgctaattcgctaggacggaaaccagagaaggcaaagtcatctttagtaatgacaggtgcagcacgaaatcccatttcaatcactttttcaacaaattcaggttgttcatcgatattgatttcatcgaaggcaattttatgttctgagagccattttttgaccattttgcattgcatacaattgtttttagaatagactgtaaccattttaaatctcctttgaggacaaacgtattttattagtgagagtaaaaagtctttgactttttctcaactttttatagtcttattttatcgtaaaaaaaatatctagtcaaattaaagatactagatattgtgttgaattatgtaaaattataaaaataacacaacatattgtgctatttttctttttgttttgataagtttaaaccaaatgggacaagggattcgcaatgatttttgattcttttgagatttgttctatgtcgtaaaataataataattgctaaaacaaaaataataattgagaataaaaggtcgtaggaagtaagaataaatccgatgctagggaaaataagaattcccaataaagcaaatacagcacctatcacactagagagactaatcatgctaaaaagccataggacaatgataaagacaacaagaaggtaaattaagaagagcggactaaatccaagaatcacaccagcagaagttgcaacagctttaccacctttaaagcggtcgaatattgaaaaagtatgtccaatgacagcaagaagaccgaaaattagaggtgaaacaccattgatatggaagaaaaggggtaaaagagtagcaagtgtcccctttagtaagtcaaaagcaaaaactgaaattcctgcctttacacctagaattctaaaagtattggttgttccagtatttcctgagccatagtcatggagattttttttgaaaaaaatcttgccaatccataagccgaatggaattgcccctaaaagatagctggcaatgagaagaataatagtaagcataagttctccgaagtttatttcgtttaaaatcgataatctcttttaactgtacaattatatcatatttttaataaagattactgacagtattgaaacatcttcacttacttttggaaaaattcttactattagatgaaaaaaattgtcagcagtcctttgacaaagctttctgaacaaggtacaataatcaagatgaatattttttattagctcattgtggataaaaaaatagtgatttagatagaagatataggctttcgatgagaggaaaataaatggtaatagatattaataactatgatgacagtgcgattcaggttcttgaaggattggatgctgtcagaaaacgtccagggatgtatattggatcaactgacggaactggtttgcaccatttggtttgggaaattgtagataatgcggttgatgaagctttatctggcttcggtaacagaatttcagtgaccattaatgctgatggttctttatcagtagaagatgaaggacggggaatgccagttgggaaacacgccatgggtattccaactgtggaagtaatttttactattttgcacgcaggtggtaaatttggtcaagggggttataaaacttctggtggactccatggtgttggatcttcagtcgtaaatgccctctcgacttggttagaagttgaaattactcgtgacgggactgtttatcgtcaacgttttgaaaatggtggacatccagcgacaactttagaaaaaattgggaaagcaccaaagtctaaaacaggaactaaagttaccttcatgccggattctagcattttttcgacaacagaatttaaatataatatcatttcagaacgactaaatgagtctgcttttcttttaaaagaagtgacgattagtcttgaagataaacgaacagatgaaaaagaagaatttcattatgaaaatggggttcaagatttcgtttcttatcttaatgaagataaagacagtttgactccagttctttattttgaaggaaaacaagatggttttgaagttgaagttgcccttcaatataatgatggctattcagaaaacattctttcattcgtcaataatgtccgaacaaaagatggcggaacgcacgaagcaggtttgaagacagcaattacgaaagcaatgaatgaatatgctcgtaaagtaaatttactcaaagagaaagataaaaacctcgagggttcggattatcgtgaaggtttgacagccgtcttgtcagttttaattcctgaggaacatctccaatttgaaggacaaaccaaagataaattgggttctcctttagctcgtccagttgttgattctttggtttctgagaaactaagtttctatttgatggaaaatggcgaattagcgcaaaatttgattcgtaaagcaatcaaagcccgtgaggctcgtgaagcggctcgtaaagcgcgtgaagattcacgaaatggaaagaaatctaaaaaagacaaaggacttttgtctggtaaattaacccctgctcaaacaaaaaatccaaataaaaatgaactttatttggtcgaaggagattctgccggggggtccgctaaacaaggacgagatcgtaaattccaagccattttgcctttgcgtggtaaagttattaacaccgaaaaagctaagatgcaagatattctcaaaaatgaggaaatcaatacaatgatttataccattggtgctggcgttggggcagattttaccttggctgatcgtaattatgacaaaatcattattatgaccgatgccgatactgatggagcacatattcaaacgctcttattgactttcttctatcgctatatgaaaccattggttgaagcgggtcatgtctatattgcccttccaccactttataaaatgagtgaaggaaaaggcaaaaaagaaaaaattgagtatgcttggacagatggtgagttagcagaacttcgcaagcaatttggtaaaaatgctaatttgcaacgttataaaggacttggagaaatgaatgctgaccaactttgggaaacaacaatggacccagaaactcggacattgattcaagtgaccattgatgatgcagctcaagcagagaaacgtgtttcagtactgatgggtgataaagttgaacctcgtcgtaaatggattgaaaataatgtgaaatttacaatggaagaagaaacagtattctaagttactttctttaataattaacctcgatttttcgaggttttttactttaatttatgatgtaagtatcactattgctcactttaggtgtaacaacaagcctattcgtaagccagcaaagctagcaagagaaactttgtttcattttgttagctatgatataatggaagaaattctaaaagaagacaaaaaatgaaaagagaaaaaatgcaaaaatcagctttaattattattgatttgcaagcattcattaaaaaattagcgaaagatgctgttccttatggctgggataaaattattgaaaataatcgagctttaatttctgcatttgaccaaaaaaatcagccagtttatattgtgactgttgaaccaaaaatactttggcaatcagctaaaaaagctttttctcggatgattttgcaagatgaattggataaaaatccaagattacatcaattagtaaaatatgggccgtcagcatttaaacaatctgattatggcttagctgacgagttgaaaaataattctgtcagtaaaatttatgtttctggtgtgtctatgagtaatggagtattaaaaacagccagagatggggcggacttgggatttgaagcgatgataattgaagacgcctgtgctgacagaaagttaaaaaacttccagaaaacaaaaactgacgaaataccaaaatttgggaaattaattaaaacaagagaaattatcgaggaactgaataaaaatgtctgagaaatatgtcgtatttgactttgaaactacaggattttctgcacaaaaaaatgaaattattcaaattggagcggtaaaatatgatgagaataatcaagagcaagctagatttaatcagttagtaaaaaatcaacgctcttatgtctcaactgaaatcactcaattgactggcataaaaccagctgatttgttaaatcaaccaacgattgaagaaattttacctgaatttttagacttcatcaaaggtcatttattagtggctcataatgccccttttgatatttcttttctttatcaggccattattgattgtgccattactgatgtcgaggcttttcgtgtctatgatactttggcagaaagtaaaaagttattaactatgtcttcttatgctctagaaaattttaaagacctactagaaatgaatgatttacgttcgcatgacgcgctcaatgactgcttaatcacggcaaaactttatcaatatttacagaaaattgaagaagttgagctgtcagtagaatcagaagttactgacgaactcggtcagttagatttatttggtgacagctctgatgaaattactgacagccttcgcagaaagttaaatttaccaatcaccaaagctttagtctattatcagcaaaatcttgagcgaaaatgggaacgatttgaagttcttggaatttcgattgaacgagagtactccgtaggttcgagtttaaatattcgtttacataattcagagaaagtgaaaattcattctgattttctaaaagaaatgcaaaaagccaatttcgtgacgattatggaggaagaaaaatgacagcaatttggaaagaaaaaagttttaatcaacttacattagatgaaatgtatcaacttttaagcttgcgtactgctgtctttgttgtggagcaaaactgcccttatcaagagcttgatggcaaagaccaagtagccaaacacctctggttagaaaatgaaaatggtcaactgatggccctttgtcgcctacttcccaaagagatttcatttgcagaggcttcaattgggcgtgtccttgtcaatcctgaatttcgtggacaaaatttgggaagaggactcattgaaaaagccttagaagtccttaaagaagatggggaagaagcagtaacaattgaagcacaatattatttgcgtgatttttatgcttcatttggttttgttgaaaattctgaacccttttacgaagatggtattaaacatgtcaatatgattttgaaattctaagatgaaataatttactgacagctttgtcagtaattttttcacttcaaattaagctgtcagtagattttaaagagataaacaatcttatcaattttgaccaataaataatttgtaagtttttttcgttttgattttgtggtagaatagaaaaagtgattttatattgtagaatgctaagagcagagaactgtcagtaaaaatcaaagattcatttataaattagcaaataattaattaaaaaagtaaacaaattttctaaaaagaaagttaaaatatgtcaaacattcaaaccttaccattagaagatataatgggtgaccgatttggtcgatattcaaaatatatcattcaggagcgggcccttcccgatatccgtgatggtttaaaacctgtacagcgccgtattctttattcaatgaataaagacggaaacacatttgataagtcttatcgtaaatcagcgaaatcagtcggaaatgtcatgggtaatttccacccacatggagatagctcaatctatgaagcgatgattcggatgagtcaagactggaaaatgggcgaacctttaatcgaaatgcatggtaataatggttcaatggatggtgacccaccagccgctatgcgttatactgaagcccgtctttcagaaatttcaggctatcttttagcagatattgagaaagatacagtaagtcaagcttggaactttgatgatactgagaaagaaccaacagttttaccagcagccttcccaaatcttttagtcaatggctcaaccgggatttcagctggttatgcgacagatattccacctcacaatttgggggaagtcattgatgcaaccattcatatgattgaccatcctaaagctgatgtagaaaaaatcatggaattcttaccaggaccagattttcctactggtgggattattcaaggaaaaggcgaaatcagaaaagcttacaaaaaaggaaaagggcgcattgttgttcgttcaaaagtcgatattgaaccaatgaaaggcgggcgagagcaacttattgttactgaaattccttttgagctcaataaagcaaacttagtcaagaaaattgacgatgttcgtgtcaatgctaaagtgcccggaattgcagaagtcagagatgagtcagaccgtgaagggcttcggattgcaattgaattaaagaaagaagctgatagccagcttgttttgaattacttgtttaaaaatactgatttacaagtgaattataacttcaacatggtcgcaattgataatatgactcctgttcaaaccggtgtcttacaaatgctccgctcttatgtcaaacaccgtgaagatgttatcgttaaacgttcgcagtttgatttaaataaagcagaaaaaagacttcatattgttgaaggtttgattcgcatggtttctattttagatgaagtggtagcaacgattcgtgcttcagaaaataaagcagatgccaaagaaaatatcaaagtttcatttggatttaccgaagagcaagccgaagccattgttactttacaactttatcgtttgaccaatactgatattgtcactctacaaaatgaacaagctgaattagagcaaaaaattcttgaacttaaagcgattatcaatgatgaacgtaccttgtttaacttaatgaaacgcgaacttcgtgaagttaagaaaaaatttgccaaaccacgccgtagcgaattacaagatgaagttcaaactattgaaattgaagcgagcgaattgattgtggcagaagacacggtagtttcagtaactcgttcaggttatatcaagcgaacttcaccacgttcatttgcttcatcagcccttgaagaagttggtaaacgtgatgatgacgagcttctttactatgccaatgctaaaacaactcaacatctcttgcttttcacaaatctcggaaatgtcatttatcgcccaattcatgaactttcggatgttcgttggaaagacattggtgagcatctatcccaaagtctctccaatttttcagccgatgagaaagtaatttttgttcagattgtggatgaatttgctggtgaaaatctagttgttgtcacaaaaaatggacaaataaagcaaatcgaacgtgaaagtttctccccttggcgtacctatcgttcaaaatctactccatatgctaaacttaagggagaagatgatgaaattgttttaatcaccccagtacaatttgcagaccttatgcttatttctgaaaatggctatgcccttcgctttaatcttgatgacgtcccagttctgggtgctagagctgcaggagtcaaggccatgaatctcaaaaatggtgataaaattaagtccgccttctttgttaactcaaatagttggtaccttttgactcaacgggcatttatcaaacgtgtcaagacggatgatattccggctacctcacgtgctaaccgtggccttcaagtactacgaaccttgaagacaaataatcataccgtctttgcagccggcttaatcaattcaactgctgatttatcagcgctaacagaggaattagatttgttcagtcaagctaaagcaccagcgacaaaagaaactgatgaacaagtattagaagttatcagtgagactggtaagaaatacgatatcaatttgtgcgatttatcattatcagatcgaacaagcaatggacatccaattgctgatgatcttgaaaaaattgcaagcgtaaaaataaaataaaaaaatcagctttggctgatttttttattgtcttcgaccaataatataacgaaagagtgccgcataaagtagccaaagaataatacaagcaccaataatccaaacccaagcatctttttggttagtaagtggaagtggtacattcattccaaaaaaaccagtgatgactgctaatcctgccaaaagtacagaaacaattgtcaaagttgtcatattatcattcaaattattattaaggacattattataagttcctgctaattgttcaagaatttgagcattaaggtgtgtcatactggcaagctgttgtgcttcgataattgcatcttcaagctgctctttttcagtttcattgaactgtctgtaaatactttttgttttaagttgttcaagtagtagagtattttggttggcactagatacaatatacagcattcccgtttcaatatcagaaagggccaacaaatttttctttgttgttttttcacgcaacttttgattaatttcttcttttgatttatcaatttgttctaagtaaggaaagaaagcctctgaaatcaaaaataaactgatgaaaagaagatgataaactgtttctggttcattttgaaaacaatattttttaatttgattaattaaatattcattttctggatgataaagagtaattaatcgatttttttgtgctacaaaagtaatgggaaccgtcttataatgaacttctgaattgagtaaatccagactattgaaaatcagtacaaagtcttgactatcagggatgaactccgtgtgaggacgttcatttttatcttcggcatattgaagcgtttctaagtcaataccataagtagcaagttcagaagtatttctaaggtcttcgacattaaaagaaagccaagtgagttgagggtttatttttatttcttgcatgataagatatcctatgttctaatagagccattttagcaaaattgtaatttttgagcaaataaataggcgaaaactattagtaactaacttgagaaattgctattttaaagaatacgtttttatttcttgacaatctttaaatttaaatgctatactttagctacaattgaataaatcttcagggcagggtgtaattccctaccggcggtatagcccgcgagctgcttgcagcatgattcggtgaaactccgaggccgacagtatagtctggatgaaagaagataataaaaccataatactctagtcagtattatgtctatttagcctaaaactctggagtgaatttaaataattcactccatttttggttttttgagctgcatttttgctcgaaaaaaaatagaaaatttatcaaaagaccctgaaattttattttagggtcttattttttattagaaaggatgaatagatgaaaaaagacgaatactacatggatttagcaattgtacttgcaaaaaaaggaggtggtaatgtcaaccctaaccctcaagtaggagcccttattgtcaaagaagggagaattattggtcaaggctatcatgaaaaatatggggaagctcacgcggaaatcaatgcttttaaggattgtaacgaatctcccgaaggagccacgctttatgtgaccttagagccttgtgcgcatcagggaaaacaacccccttgttttgaagcgattataaaaaatagaattaagcgtgttgttatcgggcatttagaccccaatcccttggtttcaggaaaaggaattaaagcaatgagagaagctggaattgaagtttctatcaaagtcttagaaaaagaatgtgaagaattaaataaaattttcttttattatgttagtcaagggcttccctatgtcatgatgaagtatgcaatgactttagacggaaaaattgcgacatcagcaggtcaatcaaaatggattacaggtgaaattgcaagagagaaagtacatcaagaccgttcacgttttatggcaattatgattggtgttgaaacacttattttagatgatccacaactctctgtcaggttggaaaatggaaaaaatccgataagaatcatttgtgatactcatttaagaagtcctttaacttccaagattgtttctacagctactgaaattccaacgattattgctacagctgagtctgaccccgaaaaacaagctccctttcttaaagtgggttgtgaaattatcttagtttcttgcctagaaggaagattgaatttgaaagaattgaccaaaaagttaggagaaaaggggattgacagtatcatcttggaaggtggagggacattaaatgcttcggcattaaaagcagggatagtccaaaaagttcaaacttatattgcccctaaaatatttggtggaaaagaagcaccaagtccagttgaaggacatggaatcgagcaacccaatcaagcctatctcctaaaaagtcctcaaataacccatctaggagaagatattttattagaaagtgagcttctttaatgtttacaggaataattgaagaaataggggaagtgagtcgcctgcaaaaaagagaaaaatcctccaaaattagtatccgtgcttccttgattttagaggatatgaaacttggagattctatttcaacaaatggtttatgcctgaccgtttctgaatttaatcaaaaagaatttatggctgatattatgcctgaaagtctaaatcgttcaaatcttgggaccttaaatgtgggcgccaaagttaacttagaacgagcgatgccattaaatggccgatttggtgggcatattgtgtcaggacatattgatggagttggccagattttagaagtaaaaaaagaagaaaatgccatctggtttgaaatcaaaacgagcttaaatttaatgagatacatcgtcgaaaaaggctcaattacgattgatgggattagtcttacagttgctcaggttaagtcgaaatcttttagtgtttctattattccacatacgctcaaagagacgataatggcagataaaaaagtgggtgatactgttaatttagaaaatgatattttggggaaatatatagaaaaattatggggcgatagtagttcttcgatgaaagaatcttcattaactaaagaaaaactacttaacaacggatttttataggagataaaatgttccaatataataaagtagaagaagcacttgctgcacttaaagcaggggaaatgattatcgttagtgacgatgaaaatagagaaaatgagggcgaccttatctgtgcggccgaatatatcagtccagaaataattaattttatggcaagtgaggccaaaggattgatttgcgcaccactcagtgaaacttatgctaagaatttacaattagaggcaatggtagagaaaaatacagataatcatggaacagcttttacagtttcggttgatcatattgaaactagcacaggaatttcggcttttgaacgggccttaaccataaaaaaacttgttgatgccgagagtttaccaagtgattttcgtagaccaggtcatgtatttccgcttattgccaagaaaaatggtcttttagagcgaaatggtcatactgaggctacggttgacttgttgcgtctggctggtttaaaagaagtaggtgtctgcgttgaaataatggacgaagatggaacaatgatgcgtaaggagaaactgaaggaaaaagcgcaagagtggggcttgaaatatatcaaaattaaagctattcaagagtatcttaagcaaaatgaactgcaagtagagcaagtgactagagccaagctaccaacgaaatatggtatgtttgatattttaggatttgtcaataaaataaatggtgagcaccatgttgctttagttaaaggagatattggtgacggtcaagctattctttgccgcgttcactcagaatgcttaactggtgatgcttttggttctttgaaatgtgactgcggtgaacaattagaagaggcattaaaaaaaataaatgatgaggggcgtggcgtgcttttatatcttcgacaagaaggacgtggaattggtttgattaataaacttcgtgcctactcacttcaagatgaaggacttgatacagttgaagctaatttagctttgggatttgaagaagatgagcgagaatattcgattggagcacaaattctaaaaataattgggatgaaatcattaaaattaatgactaataatccgcaaaagattaatgattttcaaaaatatggtctagtagttgaagaaagagtagctctccaaatcaaagataacccttttgaccgtgattatttaaaagtaaaacaaaataaaatgggacatttgtttgactaaagtaaaatagaaagtaaggatagaaatatgacaattattgaaggaaatttaagaacagagaatgcaaaatatgggattgtagttgctcgatttaatgaatttatcaatgcaaaacttttgtcaggagcattagatgcactcaaaagacatggagtccaggaagaagaaattgatatagcatgggttcctggggcttttgaaattccccttgttgccaaaaaaatggcgacttccaataaatatgaagcaattatatgtttagggactgtcatcagaggctcaacttctcattatgattttgtttgtaatgaagtttctaaggggattgctcatgtttccttaaactctaatattccggtcatgtttggtgtgctaacaactgaaaatatcgaacaagccattgagcgtgcaggcacaaaagctggaaataaaggttttgaagtagcggttggagcaattgaaatggttgatttgatgagaaagattggctaatttatctataagtgcatttatttaaatgcgctttttattttgaaataggataaaaactgttctagcgagctatcagattgcgaaatatgctataattaaagcatgaaaaaactactgtcacttgttattatcgttgttggaattgttgctgaccaaatttttaaaaattggattgttgctaatattcagcttggagatacagaaaaaatttggcctaatgttcttagtttaacttatatcaaaaatgatggagcagcttggtcttcattttcaggtcaacaatggtttttccttgtcttaacaccgatcgtcttagttgttgccctttggtttttatggaaaaaaatggcacaaaactggtattttattggattaactttaattattgcgggagctttgggaaattttattgaccgaattcgtcaaggatttgttgttgatatgttccaaactgaatttattaattttccaatttttaatattgcggatatcttattatctgttggttttgttcttcttttcattgcaattttgacagacaaagaaacaaaataaatcgattaaaaaatcactgacagaaatttttatttaacatttataaaaaggaaaaaatacttgcctatcataaaaattaacgaagaaaacaaaggcttacgtcttgacaaggcgcttgccaatcaaacagaatattcacgaagtttactgacagaacttatcaaaaatgataaagtgtttgttaacagtgaagccaaaaaagcaaagtataaagtaaaagtaggggacaggattgaatttgaagttccagaagcggaagttcttgatatcgttgctgaagatttgccgctagaaatcatttatgaagattcagatgttgcagtagtaaataaacctcaaggaatggtagttcatcccgcagccggtcatgcttcagggacattggttaatgcaattatgtatcatatcaaagatctttcaagcattaatggtgtaattcgtccaggaattgtgcatcgtattgataaggatacgagtggccttttgatgattgctaaaaatgataaagcacacgaaagtttggcagcacaattaaaagataagacgagcaaacgtcgttatttagcgattgtccatggtgaaattgctaatgataaagggaccattgaagcgccaattggtcgtaatcttaaagatcgcaaaaaacaagccgtagtttctggcggaaaaccagccgtgactcattttgaggttttagaacgattttatggctatactttgattgcattacgcttggaaactgggcgtacacatcagattcgtgtacatatgaattacattggtcatcctgtggctggtgatccactctatggaccgaataaaacattgacacctaataaagggcaatttttgcatgctgaaacattaggttttgaccatccaacaactggtgaatttatggaattccaagttgatgcacctgagatattcaatgaacaattagaaaagcttagagaacaagtttaaacttgttcttttttgtatttaaaattgaactatatttactgacagactttctgtatttgtcagcaaatcagacatcaataaaagatagatgatgtataatagagttactgatagttagtaggtttttattagtaaaaggagactattatgaacttttttaatcagatttttcataatcaaattttaatgacagccattgtgagttgggctctggctcagttaattaaaataattatcgaacttattcggacacatcgtattaattggcaattaatttttgcaactggcgggatgcctagttctcatagttcattggttgttgctttggcaacggctactggattgaaacaaggatttgattcatcgctttttgctattgctactgttttagccttcgtcgttttatatgatgcccaaggtattagaagacaggcaggaaatcaagccagaattatcaatcggatgttacaaaatgtcgaaaatgccggaatcaaagtagacaaaaatttaaaagaattattggggcatacaccaattcaagtgatgggtggaacaattttaggaataatagttgctttagtaatgaattaagaaaaaattctgttgcaattagagtcgtaagcgttaactatagtgtagtttataaatgtgaagtaaaaaatgagaaattatcatctaaaaattaaggttattgtaagaaacaaaagccaagctatggtaaaatggtaatatgaataatattgtatttattaagtataaaaaaggattctgtcttgccttaatgataggactctttcttttaattaacgggattgccatttctttgacgcaagtgtggaatgcagatcacatcattgcgcttttgttaggaaatattcttttaatagcagcctatttttattttgttggaatttataaattatcaaaaaaactttttgactcgaaggataaaaatgaaactactggcaagtctgtcagtaaaattgagttactgacagacttgtcagtaacaaaatattatcgaataagcttttgggtagtagctttgttaacttttagtttgccgtttctttttatgattcatgtgcctgatagtaagcatgcttgggactatttcgttatatttaattctacgacagaactccatggtcaatcttttggactgttacctgaaactgcttcgcgtttaggatattttcttcgttatccaaataatcaatttttagggattttattcaatcaagttttctctccttttgcaggaagtgttgaactaaaaatgtgggttgtgacagcagtgtctgcactattgacaagtctcggagttttagctggaaccttaggtgttaaggctttaagcgggaaaagacatgcgctcttatacaatatttgtgcccttgggttcttacctttttacgtttatggtgcacaactttatagtgatacgattacacttccttttgtatcctttagtttgttgttctttatttatgccattaaatcacaaaaaataactcaacaagttctatggtattttttggcaacattgttggcagttataggttatgaatttaagccaacggtgttaattgtgcttattgctgctttgattttccttggacttaataaaaaatggaaacaacttttgcttttacttccaatgtttgctattttatttgttggtggacatttcatggttgaagcaactattgcgaccgagccagccttttctcaagaggctaatgaacgtcgtaatcttccgatgatgcactggattgctatgtcttggtcgccaactaataaaacgggtggattcaataagaaagtgagactctattctgaatctttcccaacttatgaagcgaaaaaagaggccgacaaacaactcttcatagataatcttaagaagatgggacctgtcggagttgtgcgacaaattggacgtaagttggcctatacttggctatatggtgatttgaacagttcgttttatacttatcatcatgaaaataaatttattaatcgttactttgattatttatcaggaacctcattttctttggatggccctggtaatataacaggttggtttatgctaaaggctgttcaaaccctttattggattggcctagttgttttgctgtggcgtcaaatctggcgaattttaatcagcaagagaaattggtcaaatccctggtttattccagctttggcctttgttggattgagttttttccttattctatgggaaacaaattcacgttacctttatcaatttgcccctgttatgattgctttagcaagtttaggtttaatagaaaagcagtttaaaaagaaaaaaattaaggagtgaatatgactaagattctttatatggtcgtgccatgttacaatgaagaactggtacttgatgaaacttccgaacgtctcaaggctaaatatgaacaattgatttcaaataatattattagtccaaaaagtagagttgtctatgttaatgatggatcaaaagataagacttgggaaaaaattcaagaaaaacataatgaaaatccgatgtttagtgggattaatctctcaagaaatcgaggacatcaaaatgctttgctcgctggtttaatgaccgtgagaaatttagcagattgtgttatttcaatggatgcagatttgcaagatgatattaatgcaattgatgaaatgcttgaaaaatttgaaaatgagaactgtgatatcgtttatggtgtacgggataatcgggacactgatacagttttcaaaagaagaaccgctggagctttttataaattaatgcaaggtttggggagccaaagtgttcctaatcatgctgattttcgtttaatgagtcgccgtgcccttgacggtttagctcaatttcctgaacaaaatctcttcttaagaggaatggttcctttggttggctataaatctgatatcgtttattataaacgtggagaacgttttgccggtgaaagtaagtatcctttgaaaaaaatgattagttttgcgctggatggaattacttcaacatcagctgcaccgatgcgtttgattttttggattggtttaatttggtttttgctagctattgtaggagcaatttatattattgctcgccattttattaatggttctgacgttgcaggttgggcttcgacaatgttggcaattgttggatttggtggggctaatctattagctctaggtgtaattggtgaatatatcggaaaaatcttcttggaagttaaacaacgtcctcgttatttgattgaagacttcattaacgaagattaaaaatgataaattatcattaattattcagaaaaaccgtatggtttttttgttttatgcttgttataatgagcaagtaaataaaaatttttgattacatttgcatttatagaaaggcgaggtgccaaatgagctaccatgttttgattgttgaagacgaaccgagtctctctgattatgtcaaaaaagagttgatttttgaagattatcaagtttcaaccgcttttgatgctctttctgctttggaaatatttgaaactgctaagcctgctattgatgttgttttgcttgattggatgatcccaaaattagatggcttgacagtattacgtcgaatgaaaaaaattcagcctgatacaccaattatcttcttgacggcgcgtgattatattggagataaagtcgccggtcttgatgcaggagcagatgattatattactaaaccttttgaaattgaggagctattggctcggctgaggttgatttttaggaaatggtcaaattcttcttccaaggtctatgaacttgattacttaaaagttgatttaagtgctcatacaacagaagtggctggtaaaacagtcaatttaactcaaagagaattttctttgttaagctattttttagaacatcgtggtatagtgataagtcgagcagatattttggatgatgtatggggcatggattttgatggtcaggaaaataccgtggatgcttatgttcgttaccttcgtgctaaaattgatttgccaaatcataaatctctcattgaaaccgttcgtggtataggttatcgtttaaataacgaaaactgagagaggaaaagaggtagccttgaataaagtgaaaaataaagaagaattattagatgttagttttaacacaatgcttctgggtaaaagtatttttgcttttgttgaatttatatcaggtttacttttaatctttgttccacttgatttaattaaagcaactattcaccatcttgcactggctatttctctaagcccgctctctacgatgattacaaatgcaggagaaagactgaccaatgatgctactttatttgctattgtatatttacttttacatggtgcactaaagttggtgacgttggctctgctctggaaaaagattctatggtcataccccttatcaatattacttttagttagttttattctttatcaaatctttgaattttttaatcatgggtcaatttcaatgctcgttttatgtgcagttgacgtattgatgattattttaaccttattagaataccgtaagttaaaagcacatatttcaaaagagggctcatactcttccttaaaaaatagtaaagtaaattagcgaatgaaagaaatagaatcaaaaacaagtgccaaaattattaccgatacttttgtccgtatttttttaatttttagtctgttgattacaatcattgtttccggaattgttgcatttacaagtttacaaatccgtaagagtgagggagcggcacttttaaattccgttcaaacggcagcaactaatgggcaagtgaattgggatgaatttaaacttgatagtgaaaaagacgaaaaagctacatttgttcgactgacaagtccttcaggtcaaagagaagaaagtcagggaacaacaaattttttaaaatcacgaaaatcttgggggaattttagtctattaagagatgatatttttttatatagttcaaaaacttctaaaaatggaaccaaagccgaattatggttgaatataaatgttgtagttaaatcaatgattagagctatattagttattattgctgtcatgattttcctatttttccttgctttgattttaattcaaaaagcggccagaacgattagtcagcctttgacagatattgtggtggcaactgatggaaaggatgttaaacaagttcctgtcagtaaaaatcctcttgaagttcatcagttaagtcaaagtttcaatcgtttgctcaatcaactgaatcaaaaaattgaaaatgagcaacaatttgtttcggatgcttcacatgagctaagaacgccagttgctgcaattcgtggacatgtgaatttactcaaaagacgttggcatgaacatccagaaattgttgatgagtcactttcctatattgatgaagaatcaatgagaatgaaagttttaatcgaaaatttactgaccatttctagaggtaatcatttagaaatgaaaaaagaaagaattaacttaagtaaatttactgacaaagtggtcagtgaaattcaacccgcgctaagacaaaaaataaactttgatatccaaacagatttatttgtcagtatagataaaatggcgctatacaaaattattattatctttcttgaaaatgctggaaaatattcaccttccaactcagaaattacaataaatattactttggaaaatcatcaagttgattttcaggttgctgacgaaggtattggcgttccagaagaagaaaaagataatatttttgaacgattttatcgaattgataaatctcgttcaagtgaaattcctggaacaggacttggtttggcaattgcgaaggaatatgcacaattgaatgatgccaaagtctttgtttcaaataattctccgaaagggtcaatttttcatctcctaatggagtctatagaaaactaattaattatgaataaaaaaatctattatatttcgggtgctattaccacccttgcctttttaattttaactctctttgttaaaattgattttactcatggtccatttccttttgatcgaccaattcaaacttgggcttttcatttgcaaagctcttcaggactcacttactttttctctcatatgacaaatatttttggagataaaggtggaataattgtcgcagttctacttgctttggttttatatcttctctttaaacagaaagaagcgacaatctggtttgcggcaacagttgttttaagccttgctttaaatactgctattaaagtaattattggtcgggaacgtcctgatattcatcggttgacggcttttgcaaatgaagctgggaaaagttttccaagcggacattccatttttgcaacaattatttttggaagtattttctttatctgtctaggaaaacttaaaaatcgttcttctaaaattttattaggcattttatgtattatattaattgcattagtaatgttttcaagaatttttgtaggggtacattatccaagtgatacaatcggcggatttctcgaaggaattagtattctattacttacttaccccgcatatattaagtatcaagaaaaatctaaaaaaaccaattgatatcaattggtttttattaatgtcgaaaacaaattataccaattatcgtctttttgagttttattagaagttttatacttgacaacgacaaataagtgtaatataatgctatttataaataaatattagaaaaataattaactataccaattttaaaggtgagttaaatggagctttattatgtgtgggattgttggtgttgtaggtagtaaaaatgcaactgatattttgatgcaaggactagaaaaacttgaatatcgtggttatgattcagcaggtatttttgtaaatggtcaagaaacagcagcaaaattagttaaatctgtcggacgtattgcagacttaagaggaaagttagggattgatgtttcaggaacagccggcattggtcacacacgttgggctactcatggtaaaccaacggaagacaatgctcatccacatacttcaacatcaggtcgctttattttagtacataatggtgtgattgaaaattttgttgaacttaaaaacgaatttttgatgaatgatacttttaaaggacaaaccgatactgaaattgcggttcatttaattgctaaatttgctgaagaagaaggattatcaacacttgaagcattcaaaaaagctctaagcttaattcaaggttcttatgcctttgctcttatggatagcgaagatgcagaattaatttatgttgccaaaaataaatcaccattattaatcggccttggcgaaggctacaacatggtctgctcagatgctatggcgatgattcgtgaaacgtctgaatttatggaaattcacgataaagagcttgttgtgttaacaaaagataatgttacagttatggattacgaaggtaatatactttcacgtgagtcatacacagctgaacttgatttatctgacattggaaaaggaacttatcctttctacatgctcaaagaaattgatgagcaacccgcagttatgcgtaaactcattgcgacttatgcaaatgaagatggaacaatgaaagttgatcaagacattatcaaaggaattcaagaggctgatcgtatttatattattgccgccggaacgtcttatcatgcaggttttggggcaaaaatgatgcttgaatctttgacaaatacaccggttgaacttggtcttgcttcagaatggggttatgacatgcctttgttgagtcaaaaaccattctttattttcctttcacagtctggtgaaacagctgatagccgtcaggttttagtaaaagtaaatgaattaggacttccgagcttaacagttacaaatgttcccggttctactttatcacgcgaagcaacttatacaatgttaatcggtgctggaccagaaattgcagttgcttcaaccaaagcatatacaggacaaattgcaactttggcttttcttgcaaaggcagttggtgaggctgaaggagaaattaaagcaaaagaatttgatttagttaaagaattgtctttagttgctcaatcaattgaagccactttatctgaaaaggatgaaattgcagcaattgtagctgacttattgccaactacccgcaatgccttctatattggtcgaaaacaagattattatgtagcaatggaagcttctctcaaattaaaagaaatttcttatattcaatgtgaaggatttgctgctggagaattaaaacatggaacgatttcattgattgaaaaaggaactccagtacttgctttaatttctaataatgaagaagtagcagctcatactcgtggaaatgtaatggaaacagtggctcgtggagcctcagctatcacaattgttgaagaaggagtggctcgtgaagatgatacaattgttgtcaaccaagttcatccttatttgtcagcaatttcaatggttattccaacacaattaattgcttattatgcgtcaatgcaacgtggacttgatgttgataaaccacgtaacttagctaaagcagtaacagttgaataaaagttactgacagaaatttctgtcagtaaaatgataactaaaaataaaaagttctgagatttatcagaacttttttggttaattaatcttttgtcagtgacaaaggccagatttttccgtatataatagtatgtatgaactaagagaaaatccgtatccgatgcaacctagggaacgcttagaatttttaggagaagagtgcttgtctgatgttgagctgttagcgatattattgcgaacagggacaaaaaaatactcatcattaaatttggccttggaaattcttcaacattttgaaactttggataatttgcgcaaagcttcgattaatgaactcagagaaatttcaggcattggactggcaaaatccattgaaattcgagcaatgattgaatttggaaaaaggatacaaaccactaatagaaaacgttacggtcaagttttgagttccagagagtatggcctgagtcttgcttttgaaatgcaaaattttgagcaagagcatcttgtggcgacttatttagatggtcaaaatcgaattattgaaaaaaagacaatttttataggggcggttaatcaggcaactacaagccctagagagattctttatcatgcaataaaaaatctctcagtaggactgttagttgcacataatcatccctcaggaaatttacgacccagtcaggctgataaaatatttactgacaaaataaaaaaatcttgtgaggatgtggggatcaattttattgaccatattattgtaggggctggtaattagaaagaagaaaattattttaagaaaatatagctcattttgtgtctaaatatttgacattagtccagtttgaagaattagcaaattcagttccagagtaggtatgtcctcctgtatcataacttgtatttcctggaaccaaagttccagaagagcttgttgctgcatgtgcattttcagtcttgggaataaaagctagatttcccaatggaagtaaagaactaactgtaagagttattaaagttaatccgtagagccattttttctttgatttccaagttcggaattttctttttggtgttttatgacttattctatagccattttgatgcttagaatgatacatctatttattcctcactttctttatctttaataaattttcatttaaaatagaggattttaagaatataattttcaattgattatcttgctatcattttaacattgcaattttatttcatcaagttaaacgaaagaaaaatatttaatgtaatcaaaatctttctaactgtgtaacagtacttatgagcttgaaaaattaaaaattattataaaatgacttttaataaaggcttacaaagccttgtattatttagattaaaataaaaaaaaaaaaaacgtttcgttttacgaacggtttatatatgacattttctatgtaatctttcagtaatcattatcttaatcaaaaaaatcttgtgagaaattatagattctcacaagatttgtcaacttagaaaattaactaccttaaggtgcagttactaatgcccatgtaacttcaccttgataattggctttaggaacttgcaaattattttgggctgttaatttgaaaaacttactatcagaattgagtacctctgtcaccttacctgtacttgaattattatcagacccgactaaaatcggagaattcaaggtcattacggttccgttataagccatcaggctgtccataaaggagagaccaagtgaactacttgtaatttgttgagtttgctcaacattaagcgtccaagaaagatttccatagatattcttcctttcttgaagaaatttattatattttgcttgctctttttttaaaatagagcaaagttgacaagctaatcagaagtgtctctgtaggaattaggttatttgtaactttacctgttttaggaagacttcctgttggttgagatgtatctagatttccctcgcccccaggaacggtaggtttgggaatatttggattggtaacaaaagttatcgttgtatcactcgttactttatctgcactttgggcatctgctcgtggtggatgtccaaccaagaataagaatagaatcacagtaattaactttttcacttaagtttctcctttcttttaaattgatttatcttcatcttcattagtcttatcttcttgttcttcttttttccgacgctttatgaataaaaagataagagcaattaataatagaataatcacgattaaaccaattattagtagccaatcaagtccagaattttgatttacagttgcatctttggcatttaaagctgtggctctttctccagtgattgtaaagtctttatcaaaggtccatttataatcatattttgtgacttggccatttaccatggtttgatgtgttccatttgtatccttacttccataaaccgtcatctttatatggtatttacctggtttaagtggttctgatgttttgccatttaacacaccttgtattgaaacagggatggttaaattaaaatttgaatttggagccatttccattgctgcattattatatgaatagttgacggatttatcatctaacttggttacagtcgcactagtgttcatctgcatgagataagcaggggcactattcgttagatttgctgtaattacatttcgaccattcacttggtctggaccaactttacctaggttgagggttgggtcaactttggctgtatcattttgcaggacaagtccaatcacataacgatagcggttggtgatagaaacgccactacttttttgagtgctttctgaagtgctagcatcttcaaagttaaatcctccagcaattactcctttgatgttttcatcaggcattgttactgtggcggttacagttgttgcacttttgggttttattgtcagcgtctgaggaagtttaacatagtcttttaaatttatttttaatgatgggtctggcttgactaagtctggggtgtaacctacatttcctgattgacttgtgaaggctgttccaaaacttgttttcactttaatcgtctgatttgaattattatttaaggtaaactctacattttgagtttgctttggtttcaaaagaagattgaagtagccaagattttgtccaacttgattttcacctattttgggtgtgactgaaaaatttgcagaatctgcatgaacggtctgagtcgcaatcattaaaactgaaagactgactaaacttactaggatattttttttatttttcattgtttcctccttctcttcctcttgtttacaaacacattatagcattgcataaacatttcttaaatagatataattggcacttttgggttttgtaattgtacttaattttttaaaaatcaaattattttttgaaaatcctttcacaaaaatggcttaaccatgtgtatttttaggatttcaaaacaaaaaacgttcattattcagaacgatttttctttgttattctcttgtcatattacatttttaaggtattgcgaaagtctatggcaccgattttcttcaaaaatcttagtgtatcttgcaattgattcttcccctttttttcatcaatataataataacagtaaaatgattgagcataattgataataacgcgactcatcacatctccaggcataaaaaattgcttagaaatttcaagaatttcttgagcattttcttttttccctgtatcaacatagttgagaattactttgtagagaaaacgatagatgagtactcgataatataaaacattctcataataggatttattatatagaaaatcttctaatatattatcaattaaagtatcattgagtttatctccaatatttgccagaattgaaagttcaaataatccccaaaattggattcctttaatataatcttcaagttcatcaatttcttgcgaaagtagatgttgataaagtcctttagctgaatatgctactagtttttgttctttgctcccacttctattttcttgataaatttcttggaggtgtttaatatctctttgatagtaggcttgttcaatctcatcaaatatggaaatataactatcttgttcaccattattaatcattagactatagtctaatggagaaacattcattttttgaagtgcaaaatcaagtcggtcaaaggagagcatgcttttaccattttcaaaattggagagggttgactttgcaatacccagttcttcaaaggctgaaagcgaaaacccatgttgaattctaaggtcatggaaggctttcccgtatttaaaatataccatttaatcttctttcaattaaattaatttttttaatagtatatttcaaatttagaaattttgcaattattttgcataaaaaaacactgataaaatcagtgaatttttttatttacgtttacgtgcaatcaaatgaactggtgttccttcaaaaacaaaggctttacggatttgattttcaaggaaacgaagatatgagaagtgcatgagttcttcttcattgacaaaaacaacaaaagttggtggtttaatcgctacttgtgttgcatagaaaatcttcaaacgttttcctttgtccgtcggagttggattaatcgctacagcatccataatgacatcattcaaaacagaacttgaaatacgtaagttttgtgcatggtgaatttctttaatcatatctgggagtttattcagacgttgtcctgtcttagcagatacataaacgattggtgcataatcaaggaatttgaactttgtccgaatttctaattcaaagtttttcattgtatcgttatctttttcaagggtatcccatttattgacaacaatcaaaattcctttaccagcttcgtgagcaaatccagcgatacgcatatcatattcgcgaataccttcttcagcgttaatcaccatcaaaacgatatctgaacggtcaatcgcacgcatggcacgcatgactgagtatttttcagtattttcataaatttttcctgatttacgcattccggcggtatcaatcataacaaattcttggtcttcagaatcgacaaagtgtgtgtcaatcgcatcacgagttgttcctgcaattggactagcaattacgcggtcttcgccaagaatagcattaataagagatgatttcccaacgtttgggcggccaatcaagctgaacttgatgacattctcattttcttcttcaatttcattaggaagattttgaacgattgcatcaaggacatcccctgtcccaatcccgtggacggctgaaacaggataaggatcgccaagtccaagtgagtagaaatcaaagatttccattcgacgttctgggttatcgactttattgacaacaagaataactggtttatctgtacgataaagaatattagcaacggcttcatcggcatctgtaatacctgtttctccgtcaacaacagcgatgataacatctgcttcggtcatggcaatttcggcttgcgcacgaatttcagtcatgaaaggttcatctgaaagttcaatcccacctgtatcaatgatattgaatttacgggttaaccattctcctgtggcatagatacggtcacgagttacacctggaatgtcttcgacaattgagatgcgttctcctgcaatacggttgaatatcgttgattttccgacatttggacggccaacgatggctactgtaggtaagctcatatttttatttctttctttgtttacttattggataaaaaattataatagcgaaggagtttgtaatccatagactatataattttagacttgggtttcgaggttcattttagataatttcaatgccaaataggctagtaaaaaatggggcttgactaagacttatcttcatatttttagcgagttgaggtgtaacttccatgcgttcaaattgattcgtagaaaaatcaattcctgcaagtgctgtttcccaaaaatttgctgcttctaattgattttttaaaagctccacattcttaaaattacaggcagtaaagaaggtttctctagcttcattttctaaaaagcggactgactttaaggtagaacctgaaaaatttgcataagtcattagattttctgtaaactgaaggtcttgtaagtgactttcagtaaaatcagttcctagcaatttgcaggatttaaagattgagcgataaatgccaattttattgaagtttaaattggaaaaatcacatttttcaaaaaggcaatctgtaaattcactgatcgtattgtcagtaaattcaaaggttgtgtttttgaaagaacatcctgaaaaaatagttctttgattgattgtcaaagtttcatctataaattctgcttgatagatttctccatcaataaaatcttgacttgtggctacttgataggtggctggaagttttggttctaagattttctttaatttcacagtaattttttcgcctttaaattttctgttgaagctgaaatttctggttggccccactggtctacaatccgttcagaccatttgtttaagcgtctatttccagcatattcttcttgaacttggtcatatttttcaatggtttcagacgtttgctcaacatatttttctttaaaagctgttgcttccaaaggaagacgtggttttactttgttcaaacgagcggctttaccgagtgcaatgccaaaaataggataagtataatctggcaagttcaagactttagaaatttctgaggattggtctcgaattaagccaaccatcaccccgttgtagcctaaagattccgctgcaagaagcgcattttgtccagctgttgcggcatcaactgatgtaatcaataagctttcaattccttgcggttggaaattgccttgatgcaattcgactgccttttgggcacgatttaaatcgccaacaaaaactaaatatgctgcacaatttttgattgatttttgtggttgaaattcataaatcgcatctttttgagcttgtgattctacaacaatcacagaatatgattggaaatttttccatgttgatgccatttgagcagcttttaagattttttccaaatctttaggctcaattgcttcttctgtaaaatttctgaccgaagtgtgattcatcattaaatcaatcgtttcatttgtttcagtcatgacgtctattcgtcccctctaatcgcatttcttctgccaaatatttcacgcgttccataacacgttttgctggccaaatttcatcagctcgcttggtttcggctaaatgctgttctaattcttccattcttaaatttgaagtgaagaaagtcgggagattttcttgcatgcgatgttgtaaaatgacttgtaaaatactgtcacgaacccaagcgttgttttgctctgccccaatatcatccaagactaaaacttggctggcttttatttcattgacccagactttggcattgtcaaaatctaaatcagaaatgaaagtgggataatgaagtaaagttgttgaaattccttttttggctaattcgtttgccattgccgcaagcatgaaagatttcccaacaccaaaatctccataaagataaagtccttttttcttgggaaaattagtaataaaatcaactagggcttggtatggtttgattctttgaacatcatcaagggcaatatctgccaaagtgacttgttttaaatcttttggaagtccaataatattcacacgtcgcaaaaggttttgagctgcttgttgctgcgccaattcatttgtcgtttgatatgaaacatcagcatagccatgattcatgattaaaacaggttcataaccgtcagctgcccgtttttcacctttttcaaatttttcatgctcacgaacgtattcataaaacttggagtaagagcgttgaatttcgtcagaagtcatttgatgttgggcaataaaagcttgcacatcagcattttttaatacttctgcgactaatttttcaaaattttcacggatgtcttgacgttttcctaagatgtctccgatagattccattaattttgctctcctttcagttttttgagagagtcaagccttattttctcaagttttgcaagttcttcttggcttgtcttattttcataatctggatttgaccattttggtgcttcttttttgattttcattggtcgtttttcagctccagtttttgctttagcagcagctaattcttctcgttccaaaattcgttttaccgctgtttcagctgtaaatacttcatttctcatccagtcgttggctaatgcatttacaaaatttggatttaacgacgcatttttttgctgtactaaaacatagtgaatcaaaatattttggacttctgctggcaaattttggcgacttaaattagttaaaagcttatgttcttccgaactgacaaagcctccagcttgcgcttttatctgtcggatgaaatcatctggttcatgagatttactgatgacaatcaaatcggcaaatgctttaggaaaagctgaaagtgctggttgcggttggctagctcctgaaagacttctcatcaaattattcatgttcaaagttttatcagcattggctgttttttctgcttgcttgaataattcgtaccaattgagttcaaatttttctgctagtgaatagagtgttaaggagtcttgattttcattgtttaaatgatagccttgacgttccataatacttttaaaggcccccatatcaaaacgctcatttgtatttgagtggttttgttgagcttgcgagtcaaaactaactttataaacttcatgaaatttcttggaaacttcttttccttttggttccattcttttagctaaagcagctactcgattttcaccaattcttgaaatcaaaagttgtctataaaaatcatctgcaagaaaattttcaaaatttagcggactttttacttcaaaataaagactggtatgatcatcataaacgcgaactaatgataagccagataatttatctaatgcttcaataaaaggattaagaccgagatttagatattccaaaaagtgagaaattcttccagtagaaaaacttagcattaactgataaagcgcaaaggcatccgtgccaatgattggtaaatagagcagacgaaaagcctcagcgtcaaagctggtctttcctcgattaagcattgtaaatgaatctcctgctctcatttttttcctcactttttactgacagaaagttcagcaagctgatctttcttttatttgccgataaaatgctccctattcagtcgcttttaatgacagaaagttcagcgagctgatctttcttttatttgccgataaaatgctccctattcagtcgcttttaatgacagaaagttcagcgagctgatctttcttttatttgccgataaaatgctccctattcagtcgcattttactgacggatttattttttggtaatatttttaaggagctcttctaattcactgacatctttgaatgaacgatagacgctggcaaatctgatataggtgatatcatccaattcagctagttcttgcatcacaaattcaccaatgacatctgattcaacttcattactgtctagttgacgaatttttctttcaacatttgcaactgttgtttcaatatcttcacttgatactgggcgtttgtatgctgaacgaactaaaccacgaacaattttttcacgattaaagggttcacgtttgtcatcttttttgatgactaaaaggggcatttcttcgatacgttcaaaggttgtgaagcgaaaaccacatgattcacaaacacgacgacggcgaatagcatcttcggcttgtcttgaatcaacaacttttgattcttcagaagaacactttggacatctcattttattctccttaatagataataaattcttattaattttactgacagaaaattggtttagactttcttattctgtcagtaatttttttcattagttttaatgacagaaagcaacttatttacttcttgggcaaaaattttgcttctaatcgataaattacttgacctttttgtgagaatttttgctcatactcggtcattacattttgaggtgcaaattcttcgtcttggtgtaaatctaaccaaacttttttaagttccatgccatagttagctaaagaaactaaagaatattcaaacaatccacgattatcagttttgaaatgaatttcaccttcaggacgtaaaatcttttcataagttgcaagaaaagatttataagtcaaacgacgtttttcatgacgtccttttggccaagggtcagaaaagttcaaatagacttggtcaatttcaccatcagcaaaatattcactcaaagcagctccatcaacaagcatcatttgtacgtttggcaaatctgcttcaattgctttatctaaagcataagataaaactgataattgcatatcaattgcaatgtaatttatttctggatgaagagctgccattcctgtgatgaaagctccttttccacaaccaacttcaatatgaatcggatgatcatttccaaaacgttctgaccaacgtcctttaaagtccgctggattttcaactacgatatgtgcgttttcagcaagcatttcgcctgcccctttacgatttctgacgcgcatttttacctcaattttttaatttttgatagaaaatcagcaaaagtgatcttctgtttctttatttttattattcaattataagccaaaaaataggaaggtccaaaccctagcctatttttactaaaataattcacaaaatttacgaagtcccaagatttcttgatttacttctttcatttttcctctagaaagatattcagagatttggcgaagaaaagaaagttttccataccaagccactttatccataatatctgaacgaggtctaacaccagatgtcatcaaccacaaagaccagttatttggtttaatataatgtgataaaacatgtgccatatcaaccattgaatctgataaaaagacggtatcccaatctactaaataaatttttcctgaattatcatccactaaccaatttttatgattgacatcgccatgaacgactacgacctcttcatttttgatttcgggaacttgttgacgcatttcttcaatgattcctgacaaaaaatgatttgttcgtaaagcctcagtattttggacacaatcctctaataattgttcaggaagaataatttgacttcccaacttcttataagattcaaccaatttttttgagtcatgcaaatgtgctaaaatatgattaatttggcggtcttccatatcctcaggacttagtgtatgaccgtcaatccaaggttgagcagataaggtatcgccttcagccgtacgttttgtccataagacttttggcgtgattccctcaagataaatactcggcaaaaaaggactgccgttttttttaataaaaacgcgttcctgatcacttttcccaaaaaatgcattgccagagccacctttaacaggcgtcatatcccaatcggctttcatcatccttatctcctcctttcctttaaaaatctattaatcattatttgaaccatttactttattcctcaaacttatgcgtttggatagtgaattaaaatagtttgagtcaaaatgtcagcatattgatatgactcagttgttttaggaccacgagccggaatgttttcaataatgaaatgtgttgcataggcttcaatcaagttcactttatgacgattttcgcgtttacgaccaaattgtgaagtaatttcaatcgtttcacccaagtgtgcttgaactttttcacgaatgtcaacgatttttcctatttcttgattttggttatccattttttcctccaaataagacgtaaaagtcggatttctccgaacgcttaccttataaatctaattttatccttgattatatctctcttttttgattaaaagaatcaaattttataatgtattatttatcgttcatttttattaataaagagaattagacaattactcatattataacacgaattagtcaaaaaaatctagtcgccatatcggttatcaatacttgcgaatttattatgctctttaataaagagtaattcgactgttccacggcttcctgaacggtttttttcaataataacttcaactttattatcttccagaatctcttcaccgtcttcatcttcaccagttccacgttcataatagtcatctcgataaagaaatgcgacaatatcggcatcttgctcgattgacccagattcacggatatcagacaaaactggtcgtttatcttgacgttgttccactccacgtgagagctgtgaaagggcaataacaggaacttttaattctttagctaaaatttttaactgacgagaaatttcagaaacttcttgttgccgattttctcgaccagttccagaaatcaattgtaagtagtcaataacaatcaaaccaagatttcctgtttcttgggctaattttcttgaacgcgcccgaatttcagaaatctttatccctggtgtgtcatcaatataaatacttgctcttgataaagtccctgttgccatgaaataatcattccattcttggtcatttaattgtccagtacgcaagctgtgtgaatcaattgaaccttcggcagcaatcatccggctgacaagactttctgcccccatttcaagagagaaaattgcaacggttcggtcttgctttgtcccaatattttgagcaatatttaaggcaaaggctgttttaccaaccgctggacgagccgcaagaatgatcaattcttcttcatgaagacctgttgtcatgttatctaaagcaggataacctgttgcgatacctgtaatattggacttttgttgagctttttgctcaaggtcatccatgtgaatcgctaggacatcagaaattttcttgaagccgtttgtattacgtccttgttgaacgtcaattaaacttttttctgcttgagctaaaatatcatccgctggtgaatcttgttcataagctttttcgactgattcagttagacgatttatcagttgacggagtaatgatttttcagcaacaatcttggcataataggccgcatttgctgcggtgggggttgcggtggcaagttctgcaatataagcaatccctccaattgcctccagctccccttgattttcaagatgtgaacgaatggttaaaacgtcaattgcttcacgagcatcagataatttttccattgtccgaaaaattatcttgtgagcatttttatagaaatcatctgaacttaaaaattctttaatttcgactaagcgttcgctatctaaaaaaacagccccaagaacggcctgctcagcagctaggtcttgaggcggggcttttattaaatcaatttcgggcatttagtttaggcctcgctaattttgactttaaccacggctgtcacatcacggtgaagtttaactggtacatcttttgttcccaaagcttgaattttgttaatcaattgaattttgcgtttatctaacttgagattaaattgacttttaagggcttttgcgatgtctgctttatctacagcaccaaaagtgtggcctgtttgtccaaccttcattttgatttcaacaacagtgtcttctttttcaagaacttctttaagggcttttgcttctgctaaaagttctgcttcttctttttccttagctttggcttgacctttcacttcagaaagagcagctgctgtagcaacttttgccaaatttttcttaattaaaaagttttgagcatagcctgttggtacttctttaatttgacctttttttccttgtcctttaacgtcttctaagaatacaactttcatttttcgttttctctttcttttagtatttcaattaaatcttcttgcacttcatcgatatatttttcatatatttgggttgccgcattattaaaatgtccaccaccacccatttgctccataatagtttggacattaaagccatttcgagaacgagcagaaatagaaatatagccattattatgttgcgtaattgcaaatgcagcagtaatccctgccatatctaggagagtgtcagcagcttttgctgttgctatattatcatatttttgatgtttaagtccaactcctaaagcaattcctggtaaaaccatttttgcattaagaacaatttcattggccttcttatatttatcaaagtcagtagccataatcattttaattaaatcgttatcagctccacgagagcgtagataagctgctgcttcaaatgttctttcagtcgttgtttttgtaaagtttttggtgtctaattcaatccccgcaagaacaatactagcttcaatggttgacatttttctttgattattatcatggaattgaagaatttcgacagttaattcactagcagagcttgctgatgattcaatataagacagaagtgcatgttctgggaaatcatcatcacgtctgtggtggtcaatgactactaatttctcaaatgatttatagaattcaagatttaaggtttgacttgtttttgaatggtcaaccatgataagtaatgaatcttttttcttcagtttttgagcagtttctagttgaacaatatgcgtaaaaccgtcagaggactcattcattttattaattgcacgcccaacatctggcaataactgttcaggatcataaacgacaaaggcttcttttccagacatattagcaaatgctttcatagcaacggctgctccaagcgcatccatatctgtaaagcgatgtcctacaataaagacatcttctgcttcggcaataattgtccgaagtgctgttgaaatggcccgtgctcttgttctgcttttttgcgttctactttcggaattaccgccgaaataaacaggacgagcttgaggagtattttctctcagtacaacttgatctccaccacggacttgggctaattcaagattatttagagcaactttaccaataactggaaaatcattccaaccataagccacacccactgaaagagtcaaaggaatttctttttgagatgaaagttctcgaaattcttttagaacagaaaatttatcgttaatcattttttcaagaatgcgataatcacagaaaaaataatggcgactgctattaatacggcgaagataaactccgtatttgtcagcaaattcttctaaaaatgaagcgataaaactattaatggctgttcgaccgctgtcagtaattaaatctgtagcatcatcataattgtcaacagaaatcgcaccaataaccgcacgactgtcattaaattctgatttaaaagcaacttcttttgtggcatcaattaaataaataagattcttatcagaatcaagttctgcgacatatttttgcttaccaagggtgatatactggtcatcgctcgcatttttcaatatctttttaatatcgtcacgattgataactttgtcatttcccttaaaaatcatatcaatgaatggattaaaccactcaggttcaaaggtttcactattaaaacgaatgaccccaattggcatattatccaaggtagcattgagcgaattttctgcttcatcattaattttacgaataaaatcttgacgacgcaattgatagttttgagtttgtgatagtaaaatgagtgtaatcgctatgttcaaaatcaacaaataaatccaaattgaccaacgtgttgctgaaacatgaacaacaacagtctcaatgatttgaacaataaccattatgataataatagcaagcggtgaaaaccgacggacaaaattcataatattactcctatattcctctattttaacataggacagaaaaaacttaaagaatcaccgatttgtcagtgattttttcttttaaaatgtttattaagcctttatcatctttagtgatgattctgccagtaatttttgaatagctgtcagtgaatctacctttaagtcagccttctcttgattcatgccaaagcgtttgtcttcaattgcccaaacggtcgcaccagctgcttctccagcttgaattcctttttcagaatcctcaataattaaagtttcagaaggtgttacacccaatttcttcattgttgattgataaatttctggatttggtttcgtttgtttaaagtcatttcctgaaaccactacttcaaaataagaactcaattgatgtatatctaacatttgtttgatatcaaacattgacgaacttgaagcaagtgcaatttttacttctttttgacgcaaaaattctaaaatatcaggcacatcagaaaataaaagttctgcataaggcatcggatgattttctttgaattgctcatagtcttcttgcaattcactcgctttttcttcatcaaaagacccttgcaaaattcgtggccaaatatctttcatatttccaccaataaaatcactaggcgtcaagtggctaatagaaattccatgaccgccaaaaaattcttctcttctttgtaaataataacgttcggtgtcaacaagaacaccatccatatcaaaaatcactgctttaaatttcatagaaccattatagcacagtatctaagcatggttcaatagacttcattataaaagtgataagtttcaacatcacttatgaatattgatagcttttcaaaatctgtacccccccctctctttcctgtcaccacttcttttatttcgttaaattatgtattttttttatttgattaaaaaaaacaagagtcttttaattactttaatactaaaataggctataaatgagttatttattgaaaattatctgaaaattagctataataaatcaatttataatttaatttaatcttgaaggaaggtaatatttagtgaaagttgcaaaatttggaggttcgtctctcgcatcagcttcgcaaatcaaaaaagtttttgatattgttcaagccgataaacaaagaaaatttattgtggtttctgcaccaggcaaacgttcgggggctgatactaaagttaccgatgctttgattgcttattataaggcttataaatcagctgatgaaaaaggaattcactattatcagaattggattattgaaagatttcgagaaatctatgatgaacttggcttaaaaagtccagtcattaatcaaatcgcagaagatatcaaccatttagcccagttagatttagataatgtttttacttatgatacttttttagccgctggtgaaaataataatgccaaattagtcgcagattttttcaatcattctggcttaccaagtcgctatgttcatccatctgatgctggaattatggtttcatctgaccctggaaatgctcgattgcttggtggagcttatgaacatattaaatatcttaatgaacttgaagaaacgttaatcatccctggattttttggaatcacaaaagagggtgaggtttgcactttttcccgtggtggttctgatattaccggctcaattattgcggctggtgtgcgagctgagctttatgaaaactttactgacgttaatggaattttcgccgctcaccctggcatcgttaagaatccagcttatatctctgaattaacttaccgtgaaatgcgagaacttgcttattctggtttttctgttttacatgacgaagcactcgttcctgcctatcgtgcccatgttcctttagtcatcaagaatacaaataaccctgatcatcctggaacaaaaattgttgttcaaagagaaactaaaggctcacctgtcgttggaattgcctcatctagtgccttctcttctctttatgtcagtaaatatttgatgaaccgtgaagttggattcggccgaaaagtcctttctgtattggaaaatttaggtgttcgttttgagcatatgccaactggtattgatgacatgtctatcattattcgcagccgctatctaactcaacccatttcaaaagcccttatttctaatcttacagaatcgctccatccggatgaagtctatattgaccgtgatttctctattatcaccattgttggtgaagatatgaaggaacacgttggggttaccgctagagcaacagcagcactttctaaacaaggcatttcaatcgctatgctttcgcaaggttcaagcgaagtttccgtcatgtttattgtcaaagaaaaatacgaaaaagaagctctaaaagcgatttattcagccttttttgactaaaatatgttaataaaaaaaaacagctctaagagctgttttttattcttctatttttttgactttttcaagtgtctcattggaattaccacgactgctaaaattatttaataagtcagggacgtcaattcccattgttcctaggacatcaaggccctgtttaaggctttcttgtgacattccgagaatttttgacgaaccttctccaccataaatattaatagaatcaacagcttgaagattacttgatacactagcaacaacttctggaagaatttcaagtgccatgttcaatttagccgcatcattcattttttgcattgcttcggcttttttatcaattgcttcggcttcggcaagccctttaaggcgaatcgcttcggcttcagctttaccagttgcttcaatagctgtagcttcggccattgctgttacttcacgttgtttagctgtggctttggctgtagcttcaatagcggctgcttcggcctgtgctctcacttcgcgttcacgcgcatcggcttcggctttagcaatttgtgcagccttggcagcctcggcagcttttacgacattggcttcattttcttgtgctttacggagaacttcttgagtttctaagtcagtttctctttgctttttaatcaattcaacttgcatttcagcttcagttgtttcttttttagaaattgcttcttgaatcgcgtaagcttggtcagcagaggcttgggcttggtcagcttgagcttttgcttcagcagcagctattgattgttcttgctcatagtgagctaaactgattgctttttccttttgggcattggcaacttgagttgcggcaagtgcttcagctttttgggcatcttgatcagccgctgctttttgaatacgtgtttccttgtcagcatttgcaacagcaatcgctgcttcttgttgaacacgcgctacttctttagcacctaatgctttgatgtagttttggtcatcacgaatatcattaataacgaatgaaacgattgaaagtcccattttcgagagatcagtccctgcttgaccttgaacttcagctgaaaacttattacggtcttcgattagttcagatactgtcattgttccaacaatcgcccgaagatgtccacgaagaacttggtcagccattgcgtcacgttgttcatctcttttacctaaaaattgctcagcagctgtcgcaatatcttgcaaagtagaacctactttaatcatagctgtggcttcaaccgttactggaattttatctttcgagagaactttttccgttttaatatcgattgcagcagattgtaagctgaggtatctcgcattttggaagattggtaaaacaaaggtaccagaaccacgaaccacttttaatcgattcccttgtgagtctttattgacaccttttgaacctagacctgaaccataaacgataagggccgcttgaggtcctgattttttgtagtttgcagcgataattcctaatagaattaagataataacaatcaccacaattgccaaaatataaagtagtggcataatgtctcctttgtataataaatttttatttatttgagcaatttttaggatctctattgctaataaatcgtttgttgataaggaataacgtaagcaattcctgccttactctcgataatcagaacttgtgctcctgattcaatttgctcgatattatccttatttggtagataaatttttgcaggcattgttttacgtgattcattgacaaaggtcgtcataacttcgccagtcgcctcttttgaactgatggctgttgtcagaattcctgtcagtaaatctttttcatccgcattatacttttgatctgacattttgttaaaaaatgccattcctgggagtaataagattgttaaaaagatgatgagtacaatgataatcaaagtaatgataataaatagcatcccttattctccttgaaagccttttgttacgctttcttaatattataccattttatgaagaagcttatcagtaacaaattgttattttcttatttattttcgtgttttttagcggctactcttttttgtcgttctagttctttttttatttttccttctggagcaaatttttcttcccaatcttctggttttaagactttgtgtgtgatcggatcaaagtgtggacgtccatctggaaaaattttccccatatttgctcgatgaacagcattgaaaatttcataagggtcaattcctgaaaggacaagcgagccataagtgaaatagagcaaatcaatcatagcatctacttggccagtcaagctgtcttcattatgctcttttaaagtcactttatttgctgccttatcgactgcttggtgtaaattattcacaagttctgtaaatttctcttggttaccgtcagcagaggcgtaaagaaattcgacaatttcttcgactttgaaatcagcccggaaacttgcttctgttggcgaaaaggctttaggaatttcttgtgtttttccatccattaatcggtggaaatcttttactttattgaagttttggtctttagaaacaaagtctttttcaacagaataatgaattaagccatagtaagctaatgctttggcgattccatcttgattattggtatctgtaatataagtcgcaatctttttcacttctggtacagcattgcccatcgcaatcccataaccaactccagaaatcatcgtcaaatcattttccgaatcgccaaaacacatgacttggtctaaagtaaagccatagtgttctcctaatctttgaattcctggtaattttcctcctgattttgaaattaagtcaacagaataaggattgcttcgtgttaccagtaattctggaaatgcctcttgtaggcgagccgtttcgtttcttgttgcaaccatcatcgcctgataaattacttcttcttcattatcagctaaatttgaattttgcggtaaaactctgcgaataatgtgtttaaaactgtttcttgccacccctgaagtacctgagggcaaaacacctgacaaaaaactggctaaacgtgtctcgccaaattttaaaaggccagagccatttaccccgtgggctgttcccaaagagatgtcagaatggttttcagtggcataatttatcaggttttttaaggagttttgttctaaaggattttggaaaatcacttcttttggtgtgaaaatatactgaccgttgtagcttacagcaaagtctaaatctaaatcttctaataatggcatgacaaaagctgggcctcgcccggtggcaatcccgacaaaaatatctttttgacgtagctcttgtattgctttacgagtacttgttgctactcctcgtgttgaagtaaacagggttccatctaaatcaaaaaatactgcttttatatccatctctcaaatcttttctagctttggcaaagctttcatttattaactaaattatacagtaattttaattctatttcatttattagttatttttttctggactaaattttgatataatgctaatgctggcttttattcggagtctttaaaattaaatatttaattattgtttattatagatagataaggaaataatgatgaaaaaaatcttaattctccacactggtggaacaatttcgatggcggaagatgaaaatggtcatgtttccccaaatgcagtcaatccaatgaatgctgtgagcatgcagtttgatgaagtgaacttagtgacagaggatatttttaacttacctagtccacatgtcactttatcagatatgttggttttgaaaaatcgaatcaaaacagcttttattgctgaggattttgatggagtggtcattacacatggaactgacacacttgaagaaacagcttttttccttgacactactctttcgcgtggtaaaccaattgttttaactggtgccatgcgctcaagtaatgaattaggaactgacggaatttataatttactgacagctattcgcgtcgctgctgacagtaattcaagtgaccgtggcgtacttgttgtcatgaatgacgagattcattctgctcgttatgtcactaaaacacacacgactaatgtttcaacttttcaaacacctacacatggtcctgtcggtttactgacaaaaaataaaattatttatttccataaagatagtgaaaatcaacatttagatgttgcaactgttcatggaaaggtgccaattgtcaaagcttttgctgggatgactggggaaattttagatttactcaatttggaacaattagatggtcttgtcattgaagcattaggtgcgggaaatctcccacctattgctagtcaatcgcttcaaagattattagatgctaaggttcctgtcgttcttgtttctcgttgttttaacggaattgctgaacctgtctattcctatcaaggcggtggttcacaactttatgaagctggcgtgatgtttgctgatgaagtcaattctcaaaaagcgcgtattaaattgattattgcattgaatgctggcttgaaagatttatcagaattacggcctttcttggagaattaaaaaaaattactgacaaaaaagaatcatcagctgactgatgattctttttttccgatttaaagcttattaatcaatcgctactgacagaatcgtcagctctgctgacaattcctttatttgccgatttaaagctcattaatcaatcgctttaaactgtcagtaaatttattctaaattatcttgtaattcttgccaaatttgttgattttcttctaaagaataggaattggctccagaagctagtgcatggcctccgccatcatgtcttttagcaatttcattaattggctttacttttgaacgcattcttactcggaaatgtccatcggcttgttccacaaatattgcccaagattcaattcctcgaatatttcccggtgtagaaacaatacttgaagtttctgcgtcacgtaaatcaaattttttcaaaatttcttgagttaataaaacacgtgcagctcctttttctgaaacttccatattttcataaacaaatccttgtaagcgagcaactttcatatcaaatgacgacatttctcgtcctaaagctggacggtcaaatggaaattctgctaattttgaagctacttttaaggtattcggcgaagtggctggatacaagaaacgtccagtatctccaataattcccgcataaaggaggcgggcggcttctgcattcaatttaagacctgtttcaaaggcaaaatcggcaacaatttctgatgctgagctacgttcaggctccactagcaacaaatctccataagcatcatcatttggatggtggtcaattttaattagaaaatcagcatttttgtagcggtcatcgtcaattcgtggtgtatttgctgtgtcacaaacaatagaaagatatttttcatcttctctaagttcgaccaaatccatttcagctaaataggttaaggtcggttcgtcataaccaactgcataaattcttttttcggggaaattttctctcagaattgctcggagtcctgcttgagaaccaatggcgtctgggtctggatttttatgtctgtgaatgagaataagctcataggcttttattttttctaaaatttcgttcattttttcctcttttattttttatgttaattgtacattgactagaactttagctacgatgttattgacatgataaatttcacaatcaaccattgcaccaattcgtgtttctccaatcacctttggataaatctctagcacattgtcaatagcggcagctcccatcatatgcatatttaatgcttcaatgatgatattccgtcgtctttttttggcaaaaacacgttgaacaacttgcgtaataagttctgcaaaaacaccattagcgattgttcccacgctatttatcataaatggttcgaccgtcacggtgtaggctgagcctttttctaccaaagaattagcaatattatcactgaaagtgtgagccacctgactttcttcctgagctttttgtaagctttggagaaggtctgatttggtaataattcctgcgtaagtataattttcgtaaacgacaggcatcatatcatagccttcataaatcatcttttgcgaaacgctcgccaccgtcatgcttgctcttgcaacattggctcttgtcatcactttattgagcggagtatcgtttttcttatttgtaacgtcccgcatggcaactacacccacaacaacattgtaagtgttgacgacggcaaaacgactgtcattcgtttttttaactaaatctaaaaaatctttgactgtatcttcttcacgtaaggttgcccttttttgatgaaagacatctccgaccgtaataatatcttttttgataagttcattggccaaagcgtgactgatacgattggcaacggtaaaggtatcataggatgtccgtaaaagtggaatacctaattgattagcatagttgacaacttcttggtccacgtcaaagcccccagtaactaaaacagcattctgctctctgagggctagattttgaatctcttttcggtcaccaacgataactagaccattgggcgagaggtagcgcttgaaggattctctttgcatggctgaaatgacaaatttgctgaattcgacttctaatccagcaagtccacctaaaacatcagcattagctatttctgcaagtttaccaaaggttaatcgattggccactttttgtcctttaactgccaccctaacggttccagaacggtcatttacggctaccaaacctagtatttctgcttctttgattgcgcgatatgctgttccgtcagcaactttcattcgattggcaatcccacgtacactgacttgtttaccaatttccaaaccttcaatataatttaatatttcttcgtgctttgacataaaacttcaaatttccccaatctctgaatttttttgataaatttcatcgtcactttttccaagttcatattgttcaaaatctctaatttttttgctgtattgatttgtccctttaaattttttaactaagtgatagcctgatttaagggcaacttttttagacggaatattttctttatcaatcaataaaatcaactttttaagcccaaattgttcaaaagaaaattctgtcagtacttttaatgcttctgtcagtaacccttgattccaataattttgatttaaaacataaccaatttccgcagactgatttttatcagaaattttcacaaaatgaatatctccaatcagccgatgttcagatttcaactcaattgcccatttccctaaaggacttttcataaaatcgttagcaattgaaaaacgtgtttctgaaagtgacagatgcggagcaaaaacaaattttagattttcaggattacctgaatagtcaaacatgtcctcagcatcttttaaatcaaagggacgcaaaagcaatcgctttgtttcaataatgctaaactcagctaatttgacataaatattcatggcactcctttttgaatgttttcatgattttaattatatcatagtttttaacactaaatttaatcattaagacctgataaaaatacaagcctatctgtaagtgctaaagcgccaacagctatgctttgacgaagcgaatcttcgcaactacatcgctggcacggccagcgaagatacgaacaatgagcattatatcagaaagtctatgaaaaatgaatgaagatttgtaattttagggctcattattcctctactatgctgagctatgttataatttttatggtagaaaaaatgaattatataaaaatcaatttaaaattaaataaccccttagctttctgggcgaacttttcagaaagtgagcgtttcttttggtttgaccctcaaaaagaaacttttgtcattggctgtgagcgtttgaaagccattgaccttgaacatgataagttttctgactatccctatctctttcatagtcagactttttttgatgacattaaaggagaactttgggaaaatttcggtggcgaaaccattgcttttaaacattatttcgttgtcaataaggaaaattcttacaccctcacttgtgatagcccacgagtaattcctgaaatcactattccaaaatttaagcatcaactcactgaaaaagcttctgatttttcggcttggcaagaacttttttatgccattcaaaaaaattttgctgacggaaagagtcgaaaaattgtcgcttcaagagaacttgaatttacaagtcaaacctcttttgaactcgaaagtatcatccaaaatttattagataataatccaaatgcttttatttttgcttatcaaaaaggaaaaagaattttccttggagcatcgcctgaaattttagttcaaaaagaaaatgaccaactccttagttatgccttagctggaacttttccaaaaacaatggaaaatgcggggcaaaaattgctgacagaccccaaaaatcttttagagcatgatattgttgtccaaaaaataaaaagaaatctgcttgaaaaagccgagacagttaaggttggaacaaccgaattaatggagttgaaaaatgtttatcatcttcggacaattttaagtgctaaaaattctgagctttcacttattgattggacaaaacagcttcacccaacgcctgctcttggaggagaacctcgtcatgaagccctcgaattcctcagaaagcatgaaaatcatgagcgaggactatatgctgcacctcttggcttaattgacagcaaaggaaatggcacaatgattgtcgggattcgttctgctttgattgtggacaagaaactttatgcttatgcagggtgtggaattatcccttcttccgatgctttagaagaatttagggaaaccaaggtaaaattaaaaaccattttagaagctttgtaactttttaaaatattttacgattttagatttttaaattagaaatggagatagtcatgaccaatgaatatttagctccctttgttgatgaacttttcaatttaggggtacgtgaagctgtttttagtccaggttcacgttcaacggctttagccatgctctttgaggaatacaaaaaatacgatacttatgtcaacattgatgaacgttcggctgctttttttgctctgggaattgctaaagcgaaaaaacgtcctgttgttttagtttgtacttcaggttctgctgcggctcatcatttcccagctgtccttgaagcaaaaatgagtcgagttccccttattattttaacggcggacagaccggctgagcttcaattcgttggagctcctcaaacagtcgaccagaccagattttttggaaattttgttaatcattttgaaaatcttgaagctccacatattcaaacccagtctcagacagaaaacttttggacctatccacgtaaagtcgcacaacgagctgtcttatcagctgtttcccctctttcgggtcctgtgcaaatcaatgttcccttgcgtgatcctttagttccagaattaaaaagtgaaaattacgaaaaaggacgttctaagcacgcctttaaattctataagggacaagtacaagtaaggcttccatttgatgaagcattactttctggaaaaacattaattttagccggtgccaattttgacaaagattattctgaagcacttttaaaacttgcggaacaattaaaagctccaattttagcggatccactttctaatctgcgtaatcataatcatcctttggtcatagactcttatgatgcttttttagcaaataatgatttaaaaactcaattaaaagcggatgctattctgctttttggacaaatgcctgtttctaaacgtttgcaacaattcgttgttttcaataacgaagctgaatttattcaagttgaccctgctcttgattatcgcaaccctagtttgacaacgacaacgatggttcagtctgatgttctcccttttgcttcttcaattaaaaaagtaaattctgatagttcttatttggaaaaatggcaaaatgctcaagaaaaaatgcgccaacttcttgaaaaagtgacttatgaagaaagtccttttgaaggacgttatgtccaagaactacaaaaacatttggaagcactggatgctcaacttcttgtttcaaatagtatggaaatcagagatattgattattggtggaaaaaagcggatgccaaagttagaattctaggaaatcgtggtgtgaatggcattgacgggactgaatcaactgcactcggaattgctacaacgggtaaaccgacggttttattgactggggatttgtcaatgctacacgatttaaatggtttaattgtcggtaaaacacatgaacttaatctgactattgtgctatttaataatgacggtggtgggatttttcatcatttagctcaaaaaggcgtaccgaattttgattatcttttttcaactccacatggtttaaattttgctggactggctgagttgactggtttagattatcatttggtcagtggctatgctgattttggtcagcaatttgaggcttctcttcatcaatctggcattcatcttttggaaattaaaacggataaagatttaagtcttgctttacatcaaaaatatacgacttatgaaaattgataaaaaaataattactattgatggttttgattatgctgtccgtatttgggggactggagaggtcctatttgcactgcatggtttttctgaaagttctaatacttggcgaaatcttcatttggccggctacaaaattgttgctatcgatttgttaggtcacggttcatcagcaaaaccaaaggaacttgccccttataaacttgaggcgattttgaaaaatctgcactcgctatttgcgcaatttactgacggaaatgctttttcacttcttggctattcaatgggcggacgattggcgcttcgttattgccttgcttatccgtcagctcctgttaaatatttgattttagaatcaactggtcctgggcttttatctagtgaagaccgcaaaaaaagacgactggctgacgaagaattaggacagaagattttgttaaatgggtctgcttggtttgctgacttttgggctaatatttcactttttgaatcacaaaaaaagctgtcagtaaaaattcaacaggaaatttgggaaagccgtgcaagcaattcacccttagctcttgcccaaactttgaatggaacaggtcaaggccaactcccctatgttggcgataaaatttctttaataaaatccagcattctctacctatctggtgatttagacgaaaaatattcaaaaattgctaaagaaatttttgctccaaatccgaatgtcacttggatttctgttgctacttctggtcacaacattcatctagaaaatccggtcacctatcaaaaaatactagaggaatttttaccttagtcaaaatgctttatgatataattgaacagtaatgcctatatcacttctgtcagtaaaactgatgaattagttttactgacagaaataaatacaataaaaataatttttctaagtggacttatgaaagttaatgaaaataatagaacttcataacttctaaacactcaacgacaatctaacatcaaagatatcagtttgttgctgtccctgaagtctaagcgctaaagcgtacagaccctagggaccctcacatcttaattttaactgagttcaccctctctgaagtgaatgaaaaaagataaaattttgaaccttcacttcgtgaagaagctaaaattttcctatctacgctttgctgcgctgtccgttttgacgatgtcgctaaagcgacagccaaaaaggcatttttcctcacttcaaaacggtcgtcctcacatcttaattttaattgagttcggactcgtagaagttgatgaaaatagataaaatggaacttgggctatgcccagaaccgcatttttctaattttcataacttctagcgctcgtcctcacatcttaaaggagaatcatgtcaaaatttaactgggttgctctcaaccgtaactacgaagatattatttatgaaacttatgatggaattgctaaaattaccatcaatcgtcctgaagtccgcaatgccttccgtcccaaaaccgtcgttgaaatgattgatgcttttagtgtagctcgtgatgataccaatgttggcgtgattattttgactggtgcaaatcatggaaaaggtgaagataaagaagccttttgttctggtggtgaccaaaaagtacgtggaaatggtggatatgttggtgaagaccaaattcctcgtttgaacgttttagatttgcaacatttgattcggattacaccaaaacctgtcattgctatggtaaatggttttgccattggtggaggtcacgttttacatattgtttgtgatttgacgatcgcttctgaaaacgcaaaatttgggcaaactggtccgcgtgttggttcttttgatgctggttatggtgctggtttacttgccgctatggttgggcaaaagaaagcacgtgaaatctggttcctctgccgtcaatatactgcccaagaagcaatggacatgggaatggttaatactgttgttccatttgaccgtcttgaagaagaaaccgttcaatgggcccaagagatgcttgccctctcaccaatggcgcttcgtatgctcaaagggtcaatgaatgctgcaactgacggactcgctggactgcaacaatttgcaggagatgcaacacttatgttctatacgacggatgaagccaaagaaggacgcgatgcttttaaagaaaaacgcaaacctgattttgaccaattcccaaaattcccataaaaatttcccaaattgctgacaaagcgtctttttgacgctttttgtgatttaaaagttactgacaggatttctgtcagtaaaaaatacacagaaaggagaaaatcgagttcgctcacaccttaaataatgaaatggttaaaaaaacaggcggaactttatccccaaaaacaatttttaaatgactatacttttgcccaaatcaatcaggaagtcaacaagatggctgaacatttggctcctcttattgacaatcaatcacgggttgcgctcctttcagaaaactctgttgaaatggcagtcgttttgtttgccttgctcggtttgtcaaaagaggttcttctattaaatacacacttgaccgaatatgaactagctgaccaaatcaaggaactcgagattgagacagtcttcacatcggattcactgacagaaaaaattgctgacagcatttctttttcggaaatttggactagtaacccttgccctgtaagtctgtcagcagattttcctgatgaaaaaattgccgtcatcatgaacacttccgctactaccggaaaatttaaatctgtccctattacttggggcatgatttcaaatcacgtcaaagcctcaaaggaaacgcttagcgcttatgacaatgataattggctggtcatcttacccatgtttcatgtctctggactttccattattatgcgtactttatataatgcaacatcagcgaccattgttgataaatttgatgaaaaccaacttcttgaaatggtcaattctgggaaaatcaacatggtttcactcgtcccaaccctccttacaagaattgctgacaaattgtctgccaataacttacgtttaatcctgcttggcggcgaatttattccccaacctttaatcaaaaaatgccaagaattaggtcttcctatttataaaacttatggcatgactgaaagtttttcacagtctgtcacttttaatattttagatttccctgataaaacaagctctgtcgggcgatctttaccaggcgttgaaatagaaattcgtcaagctgaccttgctggtgttggtgaaatttggttaaaatctcccatgttgatgaaagcttacctcggccaaaagccttacggcactgcttttgaaacaggcgatatcggttaccttgatgcggacggttttctctatctgctcaatcgcagaaaagatatcattatttctggcggtgaaaatatttaccccaaagaaatcgaagatttagtttattctcttcctgaaatcaaggaatgtgcccttgttgctaagccagatgccaagtggggacaagtgccaattctcttcgtttcaggcaatatttcccaagaaaaattagaaaactttctcactgaaaaactggcaaaatacaaacgcccccaatccatcactttcatggatgaattgcccaaaaatgcttctggaaaaatcttgagaaaagagcttaaaggatgataattgaaaaaattacaatgtttcatgttcaactccctatgaaatttaattttaagaccgccaaaggttccttaaatctccgcgatacaattattataaaagttgaaagccctaacggactttcgggatttggtgaagttgttgctttcacaactcctttttatacctcagaaacttttgctgattcttggaaaatcttggaagaaacttacctgccagaaattttgcaaaaagacttctcacacccttttgaaatacatgaattttttagaaatcccttaccgatggccctggctggactagaaaatgcccttctagatttgtattttaaagaaagaaataaaaatttgattgctggtcttttccaagaaaaattagctgataaaattccacgtggtgcggtgcttggacaaatgtctgatgagcaaaccattaaggaaattgaccaacttattaacagtggcgtcaaaagaattaaattaaaaattagtccacaaattgggactgacttgattaaaaagctggtaaaaagatatccacaaattacatttgctcttgatgccaatcgaagttttcaactgacagactggccagtcatcaaagagctagacgaacttggtctggcttgtatcgaagaaccttttgatatcaaagatttatccgaattaaaattactgacagaaaacttcttaacaccaatttgcttcgacgaatctgttcaagatttggaaagtctaaaaatactgacagaacttccttttcaaacgatgctcaacgtaaaaattggtcgtttaggtggactttatcaaacgcaaaaagctatcgaattttgcagacagcatcagattggcttttggattggcagtatggttgagtctggcatctcaaaaatactccatgtccaactcgccgcgctttctggaaatgctatggccggtgatttatccgattctaagcattattttgacatagacctcattcaaccagaaattgcctttccaaacggttggatgaccgttccgactggaattggtatcggtctgtcagttaatgaaacgctactcaaaggttatactgtagctaaattgattatgacctactttagatgaacgaaacaagaaaaaaactggaacctctacttacaagtaaattttacttcgcaaatttcatccacaaccttgaagctctgcttcaagcagaaccacttttttcctacatccgctccgttgtctcttttggcaaggtcgctagctacattatcggttccagctaagtacagttcttcgctacgctcgaatgtctatgctaaagcgcaacgagaatcgcaagtacttgctggcagggcaagcgtcagccaaaaaagcaattttcatcatttcaagacagtcagcgacaaaatgcttgtcgctgtccccgaagctcgtgcactaaagtgctaaggccctagggcggtatcacatcttattaaggagattttccaatgaacatgattgaccaactcaatatcacagattttcaagtttttactgacgagaattctgacaagtctgtcagtaaaatttataaattctcaagtaaaatgattctcagcgattttcatgctcaaccacacggctttttaaatggaggtgcaagtcttgctctcgctgaaatcacagctggtatggcaagtaatgcaatcggctccggtcaatattttgcccttggtcaaagcattaacgccaaccatctcaatccaaaaaaatgcgaaggtttcgtaaatgcccgcggtattctcctcaaaaatggcaaacacaaccatgtctgggaaatcaaaatcactgacgaaaatgaaacgctcatttctcaaatcacagtggtcaatgctttggtaccacaaaaaaactctgacaaatagtcagagtttttttagacgacgtaagttaaccattttctcttataaaataaacctcaaattcatcagcaaccttatcacttcctgaaggaagaattctcatttttactttatttttatcaatcactttataacggaaaaaagcttcttctcctctttcattaatatttattttcactggtcgaaaaccatctttgtcgagttcattcaatgggcaataaacagaattttctcttacaaattccccatcaatattccctcgaccatttttcaattctctaaatattaactccacttgttctttaccatacttaaaatgaggctcattatccaaattggctcgataaaattgtaccttgagctctttagacattggtaatcttacatttgaaatccaagcgccatgcaaaaaatgaattgaatcttttttatttttcttctcattttgacttttaaccgaactctggcaagatttaaaaattgtcaaaggaatcaaaattaccactaaaactaaaattacccatttcatatttttccaattttcatttttcatttttcataaactcctcctttgtcatctttataatgatactttacccataaataaggatacaaaaaaagagcacataagctccatacttagtgctgctaccgtcaggtcctgacacgcttcgtaagaaacttattgctccgaaaactattataacacaatttatttttttcgtctatttttaaagaaatcttgcatgatttttgcacactcatcttctaaaatccccgattctacttggactcgatgattcagtcgcttgtcttctaaaatctgataaagactgaccgttcctccaaatttaggatttgtcgctccaaagtaaacttgtggaatccgcgctaacccaattgctccggcacacatgacacaaggttcaatggtaacaaagagggcgcaatcaagaagtcgccaatttcccactgcctgatttgccgcttcaatcgcacaaacttcagcatgatgtgtcgcccgaccatcaagctctcgcctattgaaatcacgcgcaataatttcgccgtctttgacaatgacaactccaatcggaacttcctcattttcagctgctttctgcgcttctttgagtgctttcttcataaaaaattctttttcttcttctgtaaaattcatttatcctaaaaatttctcttgttcaagacaatatattttgactggaactgcttcaaattgttctaatgtcccattgacaattgtattatctaaacaaatatagtttcgatgtttcccaaataaaaaaccactcacatgaccaacaaagacctgaacatcagtgtttggtacccccacagctttagcaacactatttcgccgttcaaaagaatcacctggcaaatgttcccaaaacaaatcttttgtcttctctttttcataagaaaggctcatttttgcactatgagagagtgccacccacttatttccaattttttcaatcaactgttctggctgaccaaagttatttttcatttctgtcagtaaaaattgtctgtcagtaactgacagctttttccagttttcaattgaatactgccagccatttggcggagccccttcataaatatcaatcgttacaattgcatttgaaagttgctcttcatccgttttaccatcacttgcaagctctgaccacatttgttcgtgatttcccatcatgactgtcacatgatagccagcatctggcaaagttttcaacaaataaagtaaggcatcaaagccaaatcggccatgatcaatgctatctcccaagacaaaaagccggtcatttttactaaaatgaatctctgtcagcgttttcttcaagccagataagcgtccatgaatgtcagaaacaaataaatttcgctgataatgcttatcatcactgacaaacctcgttttagaactgtcagcactttttttaaccaattgttcaatctgacttttcgtttttggtggattgtaattaagcacacaattttggatactgacaaaaccaaagaaaattcctgtcagtaaaatgataaatgaaatgaggaaaattagctttttaaaagggtttatcaaagttgccattttttatgcggaactgctaaatcagtaatgacagtatctcccgctgcttcttttgcttccgtcagtaaaatatccaaatcaccaaattgtggcagatgagtcaaaattaattttttaacctttgcatccttagcaatttgaccggcttcaattgatgataagtgattaggcatttttgctttatctttaaagaaataaacatcagcaagaagaaggtcagcctctttggcaaagtcagtcaattcatcaaaataaccagtatctccagtataaattaaaacttgtcccgttctgcgttcaacaatgcgcatggcataattaaccacaggatgaactgtttttagaaaagtaatatcaaaaggaccaacttttgttccattttcgatatcataaagatgaccttcagaaaccttatccaaagttaatttagaaaattcatattcattttccccatggccataaataggcaacatcattccatcccaaccatcttgacccaatggataaagctgacgatattggcgaagagcccccaaatctgcaatatggtcttcatgataatgactcaaaataactgcatcaagttgagttggttgcaattcatgttcaagttctgtcaccgcgcgtgaaccacaatctaaaagcatgttaaaacctgattctgattgtaaaagataagaggttgttccggcatcgcgcgtaggatatccgccccaaacacctagtgctgttaatttcatattttttctcgctttctttatttttttgcttaagtctattataacaaagcaaagctaatttagcttatgcgccatttaatctttactgacaaacaaaaaaagtggtagaatccaccacttttattttatttccaaattttatccacaatctttttaatatgtgctaatttagcccattcttcttcttcagtcaaatcgtttccttcttctgtagaagcaaatccacattgtgttgaaagtgccaaattttcaagtggaatcgattcaagcgcctcgtctaagcgagctttaatgtcttcatacttttcaagttctggatgtttagaagtgaaaagtcctagcacaagcaagacatcttttcgttgattccagatttctgctaagggagcaaaagaacctgagcgagcatcatcgtattctaaaaagaaagtatcataattaagctgacctaagtattttgccacaggctcataagaaccctcaaataaataagttgatttgaaatttcctcgacaaatatgagttgaaactctcaagtcctcaggcaaatccttcaagagtttattaacaagatagacaatgtcttcacacatcttaacatacttttcatgattttctggatcatctaataatctggcaataagataagcccaagtcgtatcgtccagttgaatataacgcgcacccaattcataaaaatggagcaaagtttcatgataagcttgagccaaatcatctaagaattcttcccaacttccataaaattctggccaacggtctgaacgaccatcacgatttggaattaacgaaggtgaaggaatagtaactttaggttcaactccttctggtaaaagactttttaaatagttaaaatccgcaaaaaagggatgttctgggttaaaagctactttaccagtcaattcaatattagttgtccttgtttttgcaccatggaatttataagaatcctcttgttcataagtcccaactccattaagcccccagaggaaatctaagtgccaccacgaacgattaaattctccatctgtcaccgctttaaggccaacgttcacttcttctttcactaatctcttaatttcagattcttgaatttttttaaagtcacttaatggaagttgcccttctgaataagccaaacgtgcttcttttaaagcttggggacgaagaaaacttccaacgtggtcaaaatgataatgcttataagtttttgtcatgaaattacctagattctattagtttaactcattccattgtagcaaagcgtcatttctttggtcttagaaattttcaatgacatgatgtaaatatttaatattaaattcaagtgattgacttaggagtcagactggtataaacttttacttataagagaggtagaaagatgaaagcaattggaactattgattctagcaagaattttattgactttgaaatagaaaagccaatcttaagaccccatgatttattgataaaagtcgaggcaatctcaatcaatccagttgatacaaaggttagaaaagggattaaaggaaatttagcagaaccaaaaattctaggttgggatggtttaggaactgtcgtcgaacttgggagtgaaactaaactttttaaggttggggataaagtgttttgggctggtgatgttactcgttcaggttcaaatgctgaattccaagccgttgatgaacgaattgttggttttgctcctaaaaatttgaccaaagaaaaagcagtcgctatgcctctaacaagtctgactgcctatgaacttctctttgaaaaactagaagtgactgatgaatctaaaggaaaatcactcctcattattaatggtgcaggtggtgttggctcagtagcaatccaaatggccaaaaatgctggattgacagtgattgctacggcatcaaatcctcaagccattgaatgggtcaaaaattttggcgccgattataccgtcaatcatcatgaaaatttggttcctcaagttcatgaacttggctttaagtttgtagattatattttaattttaaatgctgttgttgaacatatgccaacagtaaatgagttaattgcgccccaaggttcgattgcaaatattgttgaaccagggcaagctattaatttagatcaactagctcataaatctgcacgttttaactttgaatggatgtttacaaaagtcgtctcaaatacatctgatttacaaagtcaacatgatattttaaataaagtttctgaatggctagataatggcgttctaaaaagtacaatgactcagaatctcggaccaattactgctgagaatgtgaaaaaagctcatgaactcattgaagaaaatcatacaatcggaaaaattatcctatcttaacgattaaaaaaatcctcttatttgaggatttttatatttcatcaaaacgaacaattagataaacggcccctatcatgaaagtagagcccatcattgtccaacttccaaaccaatttccagcaagtgttgcaatagctgctccagcaaagaaaatactgataagcgcggcatatataccaactgaccggagtttttgtttatctctggtaatgatatactgagcaagatttgccgacatggacttcatattacctgtcataaagatacttccgtaagcacgaccatgaacttttgtaaaagtgtcatattgtatcgccataaagtaagagaaaattccaacataaaaggaaacaggaatttttaagcccagaccataagccaaggcaaaaattgtcacccctaaccattgaaccaataacaaatatgaggcatcaaaacggcgacgtttcatcaaatagtgagaataaaagcctcgagtcattactcctaatataaagaagataatcggaattgcaaaatcccaaaacctagcaaaatctcctttagcaatattaatccccgcctgaataacattccctgattgtgcaccaataaaacggtcattaaaatgaaagaatgagaaaccatccataaaccctgcatttaatgcaaaaattaatgcaatacgcagtttttctttaacttgtctatccataattagaattatatcacaaagattattttcattgtttttcaataatggtttgaatttcacttttttatttattattctggatttaagtaatatattaaatagtgaagcggattcaaaagactaaaagaatcaacttttttgagttataatggatttaaataattaagaagacaagcgttttttcactttattaacgaggaggagttaaaatgaacggttatcaacaacaatacacttgtatcaaatgtggcaatcataattttgaagaagatcaacttcaagcaaccggtggaaatttttcaaagatttttgatgttcaaaataagaaatttattactatttcttgttctcaatgtggttatacagaactctacaaagcacaaacgagtacgggaatgaatattttagattttttactgaacggttagcttaggtagtcaataaatttgaaaataagacttaggtcttatttttatttaagaaaattaagttataatgtaaagtacatactttaagaaaaggaagagagtctttatggccgttttggaattaaaaaatattaggaaatcctattttcttggaaaagaagaatttcctgtcctcaaaggaatcaacctagagtttgaacgtggtgatttcgtcagtctcctaggagaatccgggggaggtaagtcaactctgatgaatatcattggaggacttgaccgtaaatatgagggggatgtcatcgttgacggccttgctcaaaaaacaaaaaaagaaaaagatatggatgcttaccgtcgagatactatcggtttcatcttccaatctttcaatcttgttagctatttgagtgtattagataacattttaattagtcttaaaatgacaagcttatctgataaagagcgtcatgaaagagcgattgagctcacaaaacaagttggtctttacgaacaccgtaagaaaaatccatcacaactttctggaggacaaaaacaaagagtcgcaatcgcgcgtgccctagcatctgaccctgaaattattcttgctgatgaacctaccggtgctcttgactcacaaaacacgaaagaagttttagcactcttacgtcaaattgctcaatctggtaaaacagtaatcgtcgttactcactcacaagaagttgctgattacggtacaagaattatccgtttggccgatggacaaatcacaggtgacgaacgtctaaaagaaccctatcctgttgaatcacatcaacggatgaactcaaaagcgttgtcatatcgtgatacttttagaacagcctttaaacactttactcactcttggaaaattaatttattaattgcaatcggaacagcaatcggcctgttctcagtcatctttttcttaggactaggaaatggtgcaaccaaatatatgaatgacaccattacttcaagtgtcaatccgaatgtggtcaccatcttcaagcggacaacaactgataataaattaggaaatgagcaagcactccaacaaacgcaacaagaacttggaaatgctgctactaaccttgacagtactcatctttcaaaattgaaaaaagttgataacgtcaaaaaagttgagccaacttattcaatttctggcttaggaacacttactgccagtgataaatctaaatctggtttaatgactcttgatacttggactcaatcaaatatcaatgatgattacgttgctggttctaaacctgctgatggcgaaatcgcaatctatgctagtgatgctaaagaattaaataaagattataaatcattagttggcaagaaaattactttaaaaattccagctaaaacagctgctggaacaagtgttgaagttacaaaagaattcactgtatctggtattttgaaaaatcctcaaggcccagcaagctcttctagcagcctaattgccacttacaatactgtcaaagctgctctcgaatctgctaatgcagatagtgatgccacttatgcagtagttacagttaataaagtagacaatgtcaaatcaacaacttctgacattcaaaacttgaaaattgatggaacaaaagcatttgttacatatagtgttacttcattcctcgatgtcatcactaatattacaaatatcgtcagctatgttcttgccgctattgccggaatcagtttgattgtctcaatctttatgattgttgttactacttacatgtctgttgctgaacggacaaaagaaattggtgttatccgcgcactcggtggacgtaagaaagatatttctcgtctcttcaccgctgaaagcttgattcttggtctgtcatcagccgctatcgctattggatttgcctaccttggacaattcctcatcaataaagctctaagtagtttccttgacggggcaagtatcgttcaaatttctggtggacacattatctttgcgattatcgttgctgtattaattgctctcctagcaagtttagctccaagtggacgtgcagcacgtttgaacacaattgaagccctcgcttctgaataacatacaaattcttctgtcagtaatttcaaatgactgacagaacttgtagatgaagtttatctactgacagcctctgtcagtaaacctatgatttcaaaaaatagaccttgccaaaagacaaagcctattttttgtactttatattgtttggtgcccttccagccttatgttagaattaaagtaatagacaaataaaaggagtattaatgcaagaaataattatccaagtcatgaaccaatttggctactttggtgttgcctttctcattatgatcgagaacatcttcccaccaattccttccgaagtaatcttaactttcggtggtttcatgactacttatagcgaactggggattatcggcatgattatcgcagccactattggttctgtgcttggtgcattgatactctacttcgtcggtcgtcttttaagcgttgaacgcttagaaaaactagtttctggacgtttaggaaaagtacttcgtcttaaaccagaggacatcacaaaagctgaaaaatggtttttaaaaagaggatatgcaacaatcttcttctgtcgattcattcctttaattagaagtctaatttcaatccctgctggttctgctaaaatgaaactcccaagttttcttattttaacaaccttgggaacacttatttggaacattgttctagtgtgccttggagccgctcttggtgataactgggagatgattgctggaattcttgattcttactcttcagttgtggttgtgattttagggattattttcatccttgcgattcttatctttgtcaagaaacgatttttccccaaaagtaaaaactattcatctgatacagaaaaataagctttaatgcttatttttttataaaatttcattaacttttgttataattggtaatacaaatgatattttatggtatctaaagggagtttatccggttttattgatgcaattattgcagtaataatgactattatgttattagaattcgaattacctaaaacaggtggaattcttgattttttgaaagataatctcgtctatctgattgcttatcttttgagttttatctatgttacaatttcttggtttaatcaacaatatatgctttcacaggctgagaaaatcactcgtcgaatctatcatagttgcatgatttgggtactctcattatcaatgcttcctgtactttctgcttgggctggacgcacaatggacttctttcatgatttcggaatccactcaccaaaagcacctgccctactctttatcgtgatgatttatatttggggatttgcatatagttatatgaccgattgttttattgctgacaatcctaaagaaaaggctgaactaatcgctcaaatggaagtttatcactatttacggaatcctttttggaagattggaatggtcattagcttcattatcacttttttctatcccccttttgtattcatttatacagcaggagaaatgattattgcgacaataagaagtcaaaataaaaaaagctcaacttaaatcgttgagctttttagtttattgaccaacagtcaattgttctgaaacatacttagcatagagtggatgtgcggcaacaagttcattatgtttgccactccctgtgatttgacctttttcaatgaagtaaatcttatccgcatcaacaattgttgaaagtctatgcgcaattacgagcgtagtgcgacctttcatcaaactatctaaagccttttgaaccattgattctgattcactatccaaactagccgttgcttcatcaagcatcaggatttttggatttctcaagaaagcacgagcaattgctaaacgttgtctttgaccaccagatattttcacacctcgttcaccaacttccgtattaagttgatcagccatattttcaacaaagcttcttgcaaaagctaagtcaagaacttgccaaaggtcttcatctgtatagtctccttcaagtccataagttaaattttcacgaatggttccagccatgattgctgaatcttgactgacaaaaccaatttgactccgccaattttccaaagaaatattatcaatcggttgaccatcaattgtaatttctcctgccgttggtcgataaaaacgttctaaaagagagaaaattgttgatttaccaccacctgaaggtccggcaaaggcaataattgaattaggttgagcttcaaaagagatatcacgtaaaatttgttcagaatcatcataagcaaagtcaacatggcgagctgagagggtttttccttccaaatcaagactttctccttgatgaagtacttcttgttcttcatcaagtaattcggtcaaacgacctgttgatcctgaagctttagcaagttctgtaaagaaagttgccacagttggtacggctccgattaagttcatcaaatacatcatcattccaagcaaagtcccaagactcatgactcctgttgagatgagataaattccgtaagcaagaagtccaaagatcatcagcatcattgataacatcataactggtgacatcaaaccatcaaagatggcttcttttaccccaattttataaagtgcattgacatcattttctgcttttttagaggcttgtttttcagcatttgaagattttaccaagcgaatttctgataatgattcactagcaatcccttggaaatttgctaaagaatcttgtctagttcgcccaattttttgaccaaaagtcataattgggaacataatgagcataactactggaacagcaataatcatggcaagggtcaaacgccattgcatctgaagcatgaagacaattgaaccaaccaaaagtaaaatagacgtaaaagcttgtggaatactgtttgcaattaaatttttaacttgggtggtatcgttggctaaacgagaactcatttctcctgttttaacttcatcaaaatattttactggcagatgaatcattttatcccagacacgcgtccttagattttttacaactgattcaccaaatatcccaaggacaattgctgcaatagccgaaacagcagctgaaccaatataaagagcgataactaaggcaactttgccaccgtttactccatgtccaaaactattaacaagtggttgaaccattttggggacttgtaattgaattagtgttccaacgattcctgctagaatcccaatgataaagaaaagataacgtggctttgcagcacgaatcaatttgacgaaatgtttaatggatgttttgtcaaccgcttttccttcgatacgattggccatttgtggacctctttccattgtttgcttacttcctttttctaattattgaatttcaagacgaaaagaaatgatttcaattacttttcgtcttgaattattttttattcttccaaataaactttgaggttttctaagacaagttgatagcccgctggatttagatgcgctccatcaaaagttaattcttttttcaaattgccattttcatcagataaaccatcattaacatcaataaagtgaaaatgatggttatctgcaagtttttttattttatctgaagctttttgaaacttttcattacttctcgtttcaaataaagttttttcatctgagtcttgaccaaaatcaaccgtattaatcggatagtagcgcatcacataaacttgcgtttgaggtaatttactttctatttgagaaagaatttgatcatagttattcaaaaactcttcttctggaatctcaaaaccgatatcattcgttccaatattaataaagatttttgaaggttccaaattaaaaatttgactctctatgtgttctaataaaaatgaggtcgtcgtggctctaaccgcccgattgtagatatagtgtgaaaaagtaacttctccagcttcctcccacttctcaataggaaatatctccattaatgatgagccaacaaataaagtttgtcccttttttgctgataggtttgccttgtcatagtttttaagaagttcttcttgaaaagctgcaagctgagggtttatcgtaagagctttggtttcttttgacattatcttctcctataaatttagctattttaaatccactctactttgtttaattgagccacaaactgtttctcagcttccggaaaaaactcaatcgggtgttttttagactctagctttatcattgattttgcaataattttatcgtgccagttaaaaggggtcaaattatttacctcccctccaaagtttgcgatagctacagcttttttgcgcaaaggttcggcgatttcttttttaatcactttcgtaaaactatcatattcaaccattgtaacgaatgccgcaaaaggtttcgtttgcaaaatttcttgatatttttttaagaaactgcctactgaacgttcaaatttatgactataaacagggctggcaacaatcacagcatcaaaatctttaggatttactactccagcatttaaatccacaagtgtgacctgatttaaatgtatcgctagctttctagcgcacttggcagtatttcctgtcttatcagcgtaagcgatgagtgttctcattttccgctccttatctattcaatccttagaaatcatcccagttttctggttttttaggttctttatttttgtttgtctttggtttagaatcaaaatcaccaaaacgatttttcatttcatctgaaaagtgatcccaatgttcattaaaatcggcttgatctcttccaccaaaattatttttaaagctatctttgagctgcttaccaaaggctttccaatcttcaccaaacggagcttgtgagcgttcgtcacgacgcatacgattttgtccacgtttcatttcttgagatgaacgacgtatttcacgttgccaattttgcatttcgcggcgcatgtgattcccaaatgcatgacggtcatgagcattcatcatattttccataaatggatttccgaaaaattgtgccatttgttggaaatcttgatcattacgtgcgtcgttattttctactaatttttccattagaaaggctaattgttcttgttcttcatctgttagattaccaaaaattatttctgaaatatcattatgcattgtatcacgtgtttcttgagcttcacgacctttatcagtcaagaaaatgcggctgacacgtttatcattctcatcttgtttacgaataaccatttccgcttcttctaattgtttaacctgagctgttacacttgaaggtttaatatcaagaagttcggcaatttctgcattggttagaccatctttattccataattcaacgagtaaaccttgagctccattgcggttaccgcgatttttcatttgttttgaaatcccatctactcttaaagcaaaaagaatgtttggattgtgcaatagttttgaaaatagattcaataagttgtttgtttgttctgacattatgtattctccttatatcaaattctttgtaattcgtcatcaaaagcatagattagtcgttcatctgggccttcaataagtctgatgaaccaattcaatttttgaattattatttttatcatcttaatcattggttctcctttactatcttttagtttcttgaaaagtttaaattaattagttagtttattttttatttacctaacaaaaaagattataaaacatttaattagttttgtcaacacaaaaactaactaaattaaaaaaatcagccatagactgatttttaatattattcatttcctaaatcaagttgataaagttctttaaatgttgggttattctccagtaatgacgcgggtttcccatcaaatttaatcgagccattttctaaaaatagaactcggtccatatgatgaacacctaataaatgatgagtaataaaaataattgatttatcacggagccgttcaaaaaagagacttaagagttgattttctgtgattgggtcaagtgatacagttggttcatcaagaattacaacatcaacatctgataaaagaacccgtgccaaggctaagcgttgacgttctccaccagagaatcgttctcccgcttcatctactggtgtcagaagtttttgaggtaatgattcaaccattttacggaggccaactaattcaagagcttcccaaatttcagcatcactggcattgagtttcgccaaagtcaaattagaacgaaggcttgtcgcaaaaagataaggggattgattaatgacaccaattttttcttcaacatttttggctttagatgggtcaacaccagaaaattgaatacttccactttggggaactaaatctcccctgattaagccggcaagtgttgatttacccacgcctgaacgtcccaatagagcgatatgctctccttgtttaacttctaaattaaaattatcaaagatttttttattttcttcaaatgaaaattggagattattgatgactaaatctgtagaaacaatttcctcagtccttacttcttcatcttggtctggtaagtcatttaaacgattgattgaatcgccataacgttgcgtttcaaccaccgcatcagacaaaggagaaaaagcatcaaataaagggaaggcagcgagactaactgccgcaatataattaggcgcgtctcctaatcttaaggcaccagaagaccaaatcatcaaatagatcactaatgcgccatagacaatttgtaaaaataaatttcttctacgtccgaaagctaatagtttggcttgaatttttctagcagataattcagaacctcgataagctgtcagaaaatcttcctttcttcctgaaagcacccaatcttgtaatcctaaaatatcatctgtcaaatgagaaaaaagttgattgcgataaattttgagttcttcatctaattttactgtaaatttcaaagaaattaatggcaagataacaatcaaaaatcctaagaagagcgctaaacctaaggcaaaccaaagtgagaaaaatcctccagcaataattagagcaatcgataaacttccagcaattaaaactggaaataatgttctcaaaaagaggtcttgtagatttccaatatcttcattaagaacccccaataagtcacctaaacggtaacgatctgctaatgtaacggccgttttttccagtcgcaaatagagtttttttcgtaagagacttgtgatttttaaaatccaattatgagaagttaatctttcgacataatgcatcactggtcgtccaatcccaaaaatacgtacaaagagaactggaacataaatcattaagatattttctggttttgttgctgatttagaaatgacatatcctgagctgaacatcaaaagtcccgccatcgaaattgtaatcgttcctaagaaaatagatagaataaagcctgaacgattttttttcaaaaatggagaaatccagtcattaccaaacaaaatattttttaatttcattatttctgacctccattatctgatgaagcttggctgacagagctgtcagtagatttatcatttactgacgaaaagtttgacctctcagatactttttcttcttggtcctttactgatttgctcgtttcattgtctaataaatttttgtcatcatcaaccccacgcatctgactaagtaatttttgatagtaagtattttcagataatagttgttcaggagttccaattcctgcgacctgtccctcgtttaatacaatgaccaaatccattgatgaaagccaatgaagacgatgagtagcaatgaaaacaagtttattttcaagtaaaggtaaaatatttgctttaatttctaattcggtttcaatgtccagatgagctgtcggttcatcaagaaacaaaatattgcgggtatgacttaaaaatgctctggctaatgcaacacgttgagcctgtccccctgaaattgtacggccactggccccaatttgtccatcaagaccaatttcatcgataagactttctaaaccagcaagttttgctgctgctttgatttcgtcatcagtagaatcaggttcgtaaaaagctaaattttcacgaaaagttcctgcaaaaatataagtcttttgtggaatgaattgaactgactgacgatagttttcgtcagttaaagaagtcaaactttgctcatttagtttaatttcaccagctgttggttttagaaatccagccagcattgagagcaatgttgatttaccagaacctgaatttccgacaatggcaatttttttaaagccatttactgacagattaacatttgagattccacgccctgtgtcgtaaatttttcctaactctgtcagttgaagttgtgaatttgcactccaagttactttttctgtaagtactgacaaagtattttcctcagttgaaagaacttcattaacagctgccaaagcattttttccattgagcgtcgcatgataatcacttgcaaaatcacgcagaggaaggaaatattctggtgctaaaattagggccgctaaagctggaaaaagtaaaatatcaccgctcattaaccgaagtcccaaaaacagtgcgacaacagcaaccgaaagacttgcaaaaaaatcaagggcaaatgttgaaagcatagcgattctcaatgcgcccatcgtttctttacgaaagtcttcagaagttttataaattgaatttgagtaatctttagacaatccaaaatatttcaatgtagaaattccacgcaatgaatctaaaaaatgatttgataaatattggaaagttttgtattgacgttcagcacgcccttgtgctgcgtatcccaatagaatcataaaaataattgcaaaaggaaatgtcaaagttaacacaattccactttgccaatcaagaaaatacactggaatcaaaattaacattgggatgatcatcatatttaagactttggataggaccaatttaatataattttcaacctgatcaattcctgtgattactgttgttgcagctgagcccgaacctaaattagcaatagcaactggaccaagtcggaaaaatttatccaacatatccccccgcaattttgttgctaattggtaagcaagtttatccagagcctttgaacgaccaaaattaataatttcacggctcaaaaagcaagcaaaaaagcccaaaacccaaggaatggtatgagaaaataattgtccttgccaaagcttagtaatcgcagtagctagaaataaagcttgaccggcaattgcaatgaattgaaaaactgccagaatccccaatatcggaaacattcttcttacacctggcagttcaaaaagagatttatcaatcatgtttaaagttactgatgagataatattttactgatagaacttaccaacaaagctgacagttccttcatttaccgattgaatgacttcctctgggagcattcaactgacagaacttatcagcaaggtcggcagtttctaaaatctgctcatagaatttctgtcagtaaaataaaattcctcagttcctttctaaaaaatttaggtcagaaaaaattttcctgaccataatatgtagttgtcttaattaattatatcaatttacaaactaatctgaaaataactggttcaaccagttattttcatgttttattttttaattctttttctgaaaatgaaataggtccagcccatatagatgagtacaaatggtaagataaccagagtaatgatcgtcattgttttcaaagtatagcctgttgaactagcatttttaatcaaaatactgtgagcagggttagttgcaatcattacacgtgggaaaatcccttggaaaatcaatgcaacaagggcaatgaaagtcaaacctgaagctaagaaagcagacatttcttttcctgcacgaacagataaatgtgccacaagagttagaataacaatcaaagcaagtaaaactaaagttccaataaaatgtttttcaaagaaatcagtgaaaatagctagcaatacagcaaatacaacttcaccagcataaagaacaaaatagaggatattagcaatctttgcagctctctcacgcaaagctccctctgttttcaaagctaaataatttaagccatgaagccaagctaagagcattacagcaacaccaccaacgactgacaaaaagttaacgtaagtagtaaaagtagcagtcacatttcctttagcatccattggaacgccttgaatcatacttgtaaacatcaatccaaagagaaatggaatagcaaaacttgcaacgcccaaaacttttgtccagagcatttttcctttttccgtatgtgagtgatgacgaaattcaaatgttactccccggaaaatcaaacctactaaaatcaaaaatagaataagatagaaaccagagaacaatgaagcataccaataagggaatgaagcaaacattgccccaccggcagttaataaccaaacttcattcaaatcccaaactgggccaattgatccgatagcttgttcaacctcacgtttgtccttggcaattgtgattgcactcattcctacaccgtagtcaaaaccttcgaggaagaaaaagccactaaataatactccaacaataataaaccaaaaaagttgtaatccagtcattatttatccacccctttctcatcagtttctttttgaatttcactatcttcttttgatgaagaagcaaaattttcttgactaaatgaatctaaagaaacataagctgtttccgctccttctactccttgtttcattctttgaagcgtaaagtaaaccatcacagcaccaaggaaacagaaaaggaagaaatagacgatatttgagaataaaagtgaaccgacagaaacatttggtgaaactgaatctttgattgtaaataaaccataaacggtccaaggataacgaccaagttcagtaactaaccaacctgaggtaatcgcaaggaaaggtgcaaatagcatccaacgataaacttgtaagccaaacttattttcatatagacttggttttttctttctagtccaaaatagccccagagcagaaagtaaaatcattagcattgatagaccggccataatccggaaagtccagaagagaaccgttactggtgggaagaaattaccgccaatttctttagctacatcaggatatttcttttgaagttgagcgttaatttcattcatcccttcaaccgaaccgcttggacggtgataagtcagaattgaaagcatataaggaatttgaattccaaatacttctttgtggtcagcttcattaaagaaggcaaccatatcccaagccgcagggtcaggtgttgtttcataaacaccttcagttgcagcaaatttcataggttgagagtttttaacttcaatcatttgttggtcaccagcaacaaagttaccaactgcaccgattagagctactaaaagtcctaaacgtaaaactggtttaaacatatcaatttcacgatttttaagaatttgataagctgaaataccagcaaccacaaaaccaccagttacaaggaaacctgttgccacgtggctaaattccaaaatagtttgaggatttgtcaaaagggcagagaaacttgttaatgttgctcgtccacctttaacttcatatcccactggattttgcatccatgagtttgccgctaaaatccataaagatgataagaaggtcccaacaaatacaatccaaagtgttgcattgtgcaatttcttacccaatttatcccaaccaaacatccatactccaaggaatgtagattccaagaagaaggcaagtaaggcctcaacggctaaaggtgcgccaaatatatcaccaacatagcgagaataatctgaccagttcattccaaattgaaattcttggataataccagttacgacccctactgcaaaggataagagcataattgatccaaaaaatttcgtccgttttttccatttttcatcaccagttttcacatagatagtttccatgatcgctgtcatgagaaccattccgacagaaagtggtacaaagaaaaagtggaagattgtcgtcatcgcaaactgaaagcgtgcgagagtttcaatggtaaacattgtttacctccttatttttatttactatatatcaaatagatatagactaattttaaaaatatttttatctaagactagttttggtccttggtttaataaaaatatttattttattaataaataaaataagagaatttttaaagttaacaagattttttaataataattaataattaaaaatatcagttctaatcgtaaatctataacttttcactatttcttatcaatttatttattaatttagcaacagaaaaacaataattattttttctacaggcctcttctcagtatcttttcaaacacaaaatgttcaaagtttttagtaaactcatatttcttagtcaaccacttttaatggatgaccgtgcttgagtatccttactttgaattttatatttttaataacagagtaactgcgagttttcgaataaaaatagctttgcttctcacctctatcctctataagttttatttgtaaataagtgatttcatactttattttagcatttgtgaatgtctttggccttttaaccaaagccactaacatctgcaaataatttaaaatcacgttacactatattttatcataatgtaagcgcagataaaaacgattgatttgtaaaagacttttaacaagcgtaacttttcagacacttctatagtttttaaaacacaaaaaacctatcattaaagataggttttattaattactaattaacgaacatctcccattaatttcaaaataggttttttgataataaggaggataattcccacgataataccaataataccagtaatcgcaaagaagtgaacttctgttgctgctttaaagagtggtgtaatttgagcattaattgcttgtgaagttgaatctgccaagaaccacatcgccatcatttgtgattggaaagcaactggagctaattttgttgaaactgataatccaactggtgaaacaagtaattcacctgccatttggacagcaaacatcaatactaaccaaagagcacttgcacgaccagaagttccgttcaagagacctggaagtgtcataatcaaataagagatccctgtcaacatcaaaccaagaccaaattttacaattgttgaaggttgacgttcacccaatttattccaaagacgaacaaagataggtgacaagagaacgatgaagagcgggttcaataattgataccaagaagggtcaatatggaaagtaattccaaaccaagttgggtccaaattagaacgtgattctccccaaaccgcaataattgtagaactttgttcttcaattgcccaaaagacaatagcagaaaggaacaaaggaatatatgctgttaatttacgacgttcatctgattctacctttttagaggtaaacatcattacgaaataaataattggaacaacaataccgataattgataaaacattaatgaagttattaatgaaattcgctggacttgcttgataaagtaagaagaaaccaataatagcgacaataacaacaattgtcaatgtaataagaaaattacgtcttgcttttgaatccattggatttgaaggttcgcgtccaatttctgggaagtgacgaagacgtccataccaataagcaaataatgcaaaaatcataccgatagctgcaagtgagaatcctaagtgataattcacaccttgtccaactgtcccaacaatcaatggagcaatcagagaacccatgttaattccgacaacaaagatattgaatccagtgtcacgacgtgagtcatctttagaataaaggtgtccaaccatatttgaaatattcggtttaagcatccctgttcccaagataattaagaataatgccacgaacagtgaagataaaccaaatggtgttgctaaagcgatgtgtcccaaagtgattaaaactccaccaaggaagattgtgcgcgaagcgcccaacaagcggtcagcaacccaccctccaacaattgttgaaagatagacaagtgcaccatagatacttacaatcgccattgcttgagctttaggaagtcctaagcctgcgttgtcagcagttgtcaatgcatagaggtaataaaccagaatggcacgcatcccatagtaagaaaaacgctcccagaactcagtctgaaaaagcgtcaataggccgcgaggttgaccgaaaaatgttttttctgttttgtttaagttttgcatagattatattataaagttttctatacaacttgtcaagttgtcaaacaattttgcctatacagattctttgaaaaatgcgggaaaaagagggacaataacaaaatttcatagatatttatttatattttcttcttttctaaaataagaattagctaaaaaatatagtttttatcattttttactgacaaataaatctgtcagtaaaaaaacttgcatcagcaagttttatattttcatctttaattctaaatttgtttttccactaatcactttttctgtcagtaatttttttaattctggtaagaatttcagattttgtaaaaaagtaatttcttgaacttctatattaagctcatcttcactcggattaatgagttcaacaaaaacttctgaatctgtatatcgcaatattcctaacaagctgtcagtaaaaaaagttgaaaactctccatatttcaagctattttctgacagacgtttttgcgtccaacttttataagcgttgtaaattttgggtgaaatgttatcccaaggaaaatatttacgattctcagggtcctttccacctgacaatcctgcttcatctccatagtaaatacaaggaattcctggtaatacaaaaagcattgccaacgctactgacaaattcttttctccaaccattgtcaaaattcgttcagtatcatgagttcctaaattatttaaattattataaaaaatatctttaggataattctcttgcaaagtcatcaattgatacgcaacatcttgactagaacgatgaccatttaataaattaataattaaatcgcgaaatggataattcatagcagcttgcaaacttccaccaagaatgtaatttcttctttttccataagaaattttgttggaagcatcttcccaaatttcaccaatcaagatcttatctgaataagagtcaagattttctcgaattcctttaataaatgaatcagggagttcatcagcaacatccagacgccaaccatcaatacccaagtcattccatttagctaaaacagaatttttctcaccataaataaaattgcgaaaagaatcattatctttgtctatttcaggtaaatctttaattccccaccaagatttatactcaaaaggataattttcaaatttaaaccaatcaaaataaggtgaatcaggattttttgctgctccttcatcatcgccataatcaccattaatattgaaataaagcgagttttttcctacatgagaaaaaacaccatccaaaaccaaatgcattttttcttgatgaagcaactgaatcaattcttcaaaatcttcctgcctacccagcattgaatcaatttttaggtaatcattcgtatcatagcgatggttacttgtaccagaaaaaattggattaagataaatcgcattgattcccagttcttttaagtagggaatttttttaataattcctcttaaatttccaccgaaaaaatcccaacgtgcaatatcaccattttcttctttaacatagaaaggactatccgtttttcttccatagataaatgaattgggttttgggtgattgatttgaccattttcattcccattatagaaacgatctgggaaaatttgatagaaaactgcttcacgataccagctgggagcttgatcttctttttcaaatacagtcagctgataaggtttaacgtcattttcatcagtatatagaagtccctctcctcctatgccagaacaaccataaaatcgcctagtttctcccaaatccgaagactcgactatttcaaaatgataaaaataaagtcctggctcttcatcaaaaggaatggtaactctaaaatccccacctgaatctttggtcatagaaaattcataacgttttccaaaatcacgtcgaattacacatgtcacaagtacagaaggttggtcagttgtaaatctcaagctcattgagtttccaaccttgatggccccaaaaggttgtttataatctaaattccacggattataataatacatctaattctcatttcctttattaacacttaaggctaaaggctcctaaaatctattctatcagtaacaaaaatatctgtcagtaaatttcttcattcttttttagcctttatataccaaatgtcatcagcatattccctaactgttcggtcagaactaaaacgtcccacattggcaatattcattaaacttgcttgagtccatgctttttggtcacggtaaagtttttcaagttcagcttgtgcccgaacataatcattaaaatcacgaagtacaaaatattcatcattataaacggtaagcgaatcaaaaatttcgcgaccttcacttttaatatttggcaccgttccgtcaattaaggcattcaaaattcgattaactactggattttgctcataaatgtcacgcgcattataattaccattgcgataatattcataaacttcatccttagtcagcccaaaaacaaaattatttccatcccctgccgcttcaaaaatttcaatatttgcgccatcaagtgttccaatggttaaagcaccatttagcataaacttcatatttgaagttccagatgcttctttagaggccaaagaaatttgttctccaacattggctgctgggataatcacttccgccaaacttacattataattttccataaagacaactttgagtttatctttaatcgtttgatcattattaatcatatttgctatttcgttaattactttaatgatagatttagcataatgatatgaaggagccgcttttgccccgaaaataaatactcgaggaaccatatctaattccggattatctttcaaatcaaaatataattttagaatatgcaaagcatttaacaattgtcgcttataagcatgcagccgttttacttgaacatcaaaaatcgcatcaggattaaccgtaattccattttgttctttaatcaccgcagccaatcgtagcttatcatcaaatttagctttttgaatttgttcaagtgttttttcatcatttttaaaatttttcagcagcttcaattcatctaaatcatgacgccatgatttaccaattgtttcatcaataattccagacaagcgttcatttgcaatctgaatccaacgacggtcagcaattccatttgtcttattattaaaacgttcaggataaatttcatagaaatcatgaagttcaacatcctttaataaatcagaatgtaatttggctacgccattggttgaatgtgaaccaatgattgacaagttggccatatgaatttgtccatctttgataattctcgtattatgcaccagcgttgcacccactttaggaagcaactcagccgtacgtctccggtcaatttccacaataatttgataaattcgaggcaaaagttgtttaatcatctcttctggccacttttccaaagcttccgataaaattgtatgattggtataagacattaccttaagggttgtatcccaagctcgattccagcccacaccatattcatcaactaaaaggcgcatgaattctggaacacaaagtgcaggatgcgtatcattaatatggacagcaatataatccccaatttttcgaatatcttttttttgtgttcctttatagtggtgcaaaattcgttgaagccccgcagaaacaaagaaatattcttgcttcaaacgtaaaagtcgcccatcataattagaatcaactggataaagttcagcagagagcatcgaagtttgtcgcatataatccaaattttgaaatttagggtctaattcctctggcacttctgagcgccacagacacatattattgaccgttgtattttcaaaaccaaccatgggcgtatcatatggaacagctagaacacgttcctggtccttataatgaggaataagatttccttttccatcatcttctaaccaaacttcaccaccaaatgttacttcaactgctttgtctgctctacgtacttcccaaggattcccattatttagccaagaatcaggtaattctacttggtaaccatctactattttttgtttgaataatccataccgatagcgaatgccatttccatttcctggaagccccgttgaagctaaagaatccatgaaacagctagctaagcgccccaaacctccatttccaatggccatatctggttctatcttagcaacctcatccagtttaattccaaaatcatttaacccttctcgaacggtatttaaaatacctaagttaagtaaatttgatttaagcatttttcctggtaaaaattcaatcgaaaaataatatgcttgtttttttccagtttcatccttatattgattatcggctacccaaatattagcatagtaatgtttcacaacagatgccaatgcatcataaatttcttgataacctgcttttgtcaggtcagtcgcaaattttgaagttagacgctcttcgaaatcttgcttaaattgttttttagaaagtttcaatcgtcgctcctttattattctcaaacatcttttattttaaaatgaattctaccacaatttaatcacaagcgcaatcgtttgcgagattttataattcttgatagagttcaatatattgttgagccttcgttccccaagaaaaatctttactcattgctgataaaaccattttatttaagacttttggttcttttccataaacatcaagtgcacgattaatcgtctccaataaaatctgtccttcaaaatcaacaaaaccaaatcctgttccttctttgcttataggattaaatggaatcacagtatctttcaaaccaccaatttcatgaacgattggtaaagttccatatctcattgcaatcatctgtgataggccacaaggttcaaaagcagatggcatcaagaagaaatcagaaccagcataaatttcctgagcaaattgaaggtcaaatgcaatatttgctgacaacttatctggatatttttgagaaaaatatctaaaaccttcttcaatttcagggaaacctgttcctaataggacaatttgcacattttcttccaatactttttccaactgactcaaaactaaatcaaatcctttttgattcgttaaacgggagaccatcccaatcaatggaacatttggattcaatggtaatcctgttcgcttttggagctctgctttcatttgacctttaccagaaagctcttcctcgctgaaatggtaaggaattaatatatcattttcgggattataaatatcataatctatcccatttaaaattccagaaacttttccatctacatattgcaaaatcgattctaaaccacaaccaaattctgaggtctgtatttccttagcgtaagttggcgaaactgtattaacccgatccgcatataaaattcctgtttttaacatatttagcataccattatgacggaccactccttcaaaatagcgttccattcccatcccaaaaagctcacttaaagcatctccatgcatcaagccttgaaattcaatattatgaatggtcagtactgttttaattttttcataggccttaatccagttgtatttttctttaagtaaaaagggaaccattgcagtctgccaatcattgacatgcaaaacatctggaatgaaatctaacttttctaagagttggcaaagagccaagtcaaaaaaggcaaagcgctctccatcatcgtcataaccatagagttgtcctctaccaaaataatgttcattatctagaaaatagtacttcacaccctctttttctagacttttaactccaacatattcgtgtcgccaaccaacatcaacaaaatcataaaattcatcttttaaaagtgaacgatattcttctttcatttcattcttaaaataaggaagaatcacagcaactgagtctatctcactttttttagccaattctttgggcagtgctccagctacatctccaagtcctcccgtcttaaaaaagggggcacattcacttgatgcaaataaaactttcatttttctctctttcatttcctctttaaaataaaatccttttatctttgaattttattcaagaacgccgataaatattatcagcgtcatttgtcttctataagatatctgcagtaacaactgttcctttaggaatcactactggtttttctgaactaccaataattttgacattattttcgacaaccactcctttatcaatgatggcaaatttaacttgagcgccacttttaacttcagagttggtaaaaactaatgattcttcaattaaggcatcatcttgaatcttaactccacgagaaatgagagaattttttactttaccattgataatacaaccagaacctaattgactattctccactttactattctcagaaaaataagtgggaacttcatttttaatcttagtataaacaggttggctactatataaaagagaggtaaaattttgggggtcgagcatgaccatattggcatcataaaaagacttaatattagtgatattactcatataacctgtgtattcataagtattcacatcatagttcttcatataaacacgaatgagacgggcaattgaggttaattctcccatatcttgcatctcttttataaaattaatcaaccaatcggtgttcacgataaagagattcaaacaaagagcttctttttcttggggattttctaattgattaacataacagttactcattttccctgattcatcaaaacgaagaattgtatcatactcacttgctaaatctggagaaacttttttataaacggtggttatttccttacctgccaatttatgtattttaagaacagccgttaaatcgacattacaaataaatttactgcccaaaagaaccgtatatggtgctttagatttacgcaaaaaatttaactgttgagcaaaataatctttgccttgttccctcaaacggtcaaaatcttgttgaatatagacaaagtaacgactattaaagccatccaaaccccattcgccacctgaccctagatggtcaaaaacagattgtgtttctccttcattaaaggtcataaaaatattatctacatgggcatttgataatgatgacaatggaaaatcaatcaaacgatatttacaatcaaaaggaagagtagcaatcggacgaacctctgttaaggggcttaagtgtttgcttgaagaaatatttgagaggattgctgccattttattactattgttcatttttattttctcctttaatttctccgtgaccaatcactgcgacttcattttcaccgattatttctacattatcaccaatttttgcattttccccaatgattgcatttttgattgtaacgttttccccaataaatgtcccagacataatgaaactgtcctcaatcactgttccttcttgaacatggacattctgtgaaaggattgaatgaacaactgttccatcaacgtaacagccatcaccaacaagtgcattttttacattggatttttctgtgataaactgtggagctgaaatatcattatgtgaataaatccgccaagatttatctgtaatatttagttcattatttaaatcaagaaattccatactggattgatgaagagaatcaatggttccaacgtctttccaatatcccttaaagcggtaagcgaacacattttccccagcttcaatataagccgggataacatctccaccgaaatcttccattggatttcctttcgagtaaccattcacaagaacttcgcgaagccttttccaattgaaaatatagattcccattgaagcaagatttgattttggttctttaggtttttcttcaaattcaataattcgctcattatcatcggtgttcatgattccaaaacggcttgcttcttcaagcggaacttccattaccgaaactgttaaactagcttcacgttctttgtggctttctaacatggcttcataatccattttataaatatgatctcccgagagaatgagaacatattctggattttgctggtcaatataagagatattttgataaacagcgtgagaggttccttcaaaccatttagaaccttcttgtgaagaatagggttggagaatagtgactccactattgattccatttaacccccatggtgctccatttccaatatgagcatttagagttaaaggttggtactgagtaatgacgccaacattttttacattggaatttgcacaatttgataaggcaaaatcaatgatacgataacgacctccaaaaggaacagcaggttttgcaacatcttttgtcaatttacctaaacgcgtcccttgaccaccagcaagaataagaccaagcatttcaattgccataatgaaacctccatttttttcacaaaatttttgtttttttacatatttattattattttataatttatactttctaattcaaaatgatttactttgaaatttaataggctcttttactttctttgataaatttctttaaaaattcagtccaatcctgattatcaatcaatgtttcaagttgacaatgcaatcggtaattccagtaatggtatggatttgctggaatattaatttgttcggattttgcatcttcttttcgcaattgttcactcattgctaaccaatcttgaataggtaagataaccatcatcgcattggagtttaaatgtcttttaactatctcttggataatttctgcacttgcataataaggagcttcgccataccaacccatgacttcattgtagtaacgttgaatttcctcatgattttcttcccaccaagctcttagtggacttgtatcgtgacttgaagtcgttaggaccgataaatagggaacttcgtttaaaggactgacaaatcgattatctgaaggcattctctcaattatcaaacgtagaatattaagatgattcatgacatctggtacattggcgggaaccattcctaaatcttcaccacaagccaacatattcgtagcatcttttaaaactggtaatttttcataggccttttctttccaaaattcataatttcttccataaaaatagtcattataaagtttttcaatccgtcctttatagtcatcaccaaattctcgaaagctgattgtttgcattaaagaaatacgtggatgatatttctctggattctcatcatcttttaataatattatattttcatgtaatttataaagtccttctcgcacccaatcttctaattgagctttttctacttttttctggttattatactcattttgaaatgtataatttccattacccatataatccataaatgtttgaataatccaatctcgattatctcggccaaaaatttcatcaattacccaatccttgatgaaaggattaataaaccgctcgaggccccattgtcttaatggaataccatagttattttcaatttcttctgctgacaaggcaatagctggtgaaaattggcccaataaacctcttacggaatcctctggcatctgccatattctaaagaaaccaagaatatggtccagccgataagcatcaaaataattagacatggctgttaaccgttttttccaccatgcataaccatcttcggccatttttttccaattgtaggttggaaagccccaattttgtccatttacagcaaaaatatcaggaggagcgccagcttgtttatcaagatgaaaaagttctggatgagtccaagcgtctacggaatcatgagcaattccaattgcgatatctccttttagtgcgattcctaattgatgacaatagtcaacggcttctgaaagttgataatgcaaaaggtactgcacaaagatatataaatccaattggttactttctgaagttaacttttcaaagaaatcttcactataagtggcatactttccccaattcataaaattagcactttgattgatatctcttaaatacgaaaatgccgcataggcctttaaccaatcctcattttgctgataaaattgctgataatctttgcttgctttaaatttatgagctgagttttgataaataatctcagcatattcccattttaaggctaatgctttttcataatctattttttctaaagcatttaattctaattccgcgatgagaagcttttcttgttgaatttttgtgtaagaatcccaaaagatatgaatatctaaataaattggatgcaatgcaaaaacagaaatggcacgataaggatatgaatcgcgccagtccataaaagtactggtatcattaattggtaataattgaatgatgtccatgccagaatgatgggcaaaatcggctaactctttcaaatctgaaaattgccctaccccactagaattttcagttcttagtgaaaaaactggcactgctatccccgtatggtaagctttttctccgtaaggttcaattgaaaaattattggtgagcatttttactccttaattctctaaaaatagtgtagaatcgcaaaagaaaatgttttcttttattatatatctttttaaaaaaatataccaatatttagtgtgatttttcagaaaattaataagtaatgttaaataagataactcattaattacaaaagctagaaaagcgtaataaaaaaagttacagataaaattatcggtaacttttttattaattttattttaagaagttggttaatacaccattaatgaatcggcttgatttttcatcactaaagtcttttgaaagctcaactgcttcattgaccgcaacaacatcaggtgtttctgtatataatatttcataactagaaacttgaaggattgcttgttcaacaagagtcaaacgtgaaaatgaccaagtttttgccaaatatttagaaatatttgcttccaaatcttcttttttatctaaaactccatcaacaagttgtgtaaagtattcaggagcttcaagatcttctggacggtcgttatcataattgagaacaaagcgttttgtatttttcaaaagctctgacaattgtgattgagcattattttctgcttgtgctaattgttcatcaagttcttcttttaaagtacttggagtgaataaatcacttgtatatttttcaagaacattttcatgaaggaatgaaaaggttttttggaaagtttcaagagattgttcagctgtcgcattttctggaagatttttgaaaaattctagaacttttggcgcaacaggttcttcatcaagttcaatttggaacaaacgaatcaatttcaaatttgccatgacaccaacaaataaatttgttgcttcatattcattcattttcttagcgtaaccaccaaaatctcgcatgaaagcaagagctttagcaaccgttgttttctcgatatctttaagtccaagaatttcataaatttcataaatggcttctaaaggttgagaaagtccttttggaaatttacgaacagtaattcgttcatcacgaaaatcaacgtcaaaacgaacagtttgagaaagttcttcttctaatttttcaacgttttctctaaaagagcttacgacatttgttgccatttctttttggacagcataagaaaataagacctggaccgctcgttgacgaatttggtgttgagtgagcgtcttaggcatcaaaaaatccctcatcaaacaagtcttcaagcgctggttttggttgtttttcagtcataattccgacaacgtggatattgacttcatcaacaataatctcagtagcttgggcaactgcttctttcacttctttttggatttttgtagcaacggttggtaggcttacaccgtaagtaaggtacacatagatatcaacagctactttatcgtcttttgagtcaatataaacaccacggccttcatttttcttaccaaggcggtctgaaaaacgtttgttacgaagggcgtgtaccccatcgattttggctgttgtaataccgataattacttcaagaacttcaggggcaatgacgatatccccaagttcttcagaatgtacagttttttctgccattttgatttctccttttgtctttgcaaatttttccaattggaaaaatttcacttacaaaatgaattttctttactgacgaagtctttaaacttcataaagttactgacaaaaggctgtcagtaacttttttcagtaatcgtacttaattaagcacgtttcaagtattcacctgtttgtgtgttgatttcaagttttgttccagcttcaacgaaatcaggaacgttaacaacaagaccagtttccatagttgctggcttaccagaacctgttactgttgcacctttaatagatggttgtgtttcagtaacttcaagaacaactgttgttggaagttgaataccaattacttctgtaccgtagaattgaattttaacatctgtattttcaagaacataaagaagttcatctttaacttgttctactggaatttcatattgttcgtaagtttcattgttcatgaaattagcaataccatccattgagtagaggtattgtgctgttacagtttcaataacagcttgttcaaacttatcttcaggacggtaagtgtcatcaaaagttgaacctgagcgtacgtctttaagtttcatacgcatgattgtattccctttacctggtttgtgatgacttgcttccataacgcggagaagtttttccccattcaaaaatgtcatgcctgatttaaggtcttttgctaaaaccatgtttatgtttctcctagtatttataaatttagatattctgtcatttttcttttgtcagcaatttttctgtacacaaaagaagtgaaatgacaggatttaacatcttattttatcacaagttattgcttttttcaaataacgataagctcttttggggcttttgttaagacttcacagccattttctgtcactaataagtcatcttcaattctgactccaccaaattcaggaatataaattcctggctcatctgtaataaccatcccagcttccaagtgattttctgtcattgattgattaaaataaggaatttcatgaacatctaaaccaagtccatgtccaattccatgcgtaaaatactgaccaaaatcggcttcttcaatgacggtacgcggaaccttatcatattcggcataagtcattcccgctttgacttctttgataagtgcttcattagccttacgcacggtttcataaattgttcgcatcttgtcgtctacagaacccacgaaaattgttctggtcatatcgctagcataatgttcataataacaaccaaaatcaatggtcactggatcaccaaattgaatcattttactggtcgcaacgccatgaggcaagctacttctcttccctgaggcaacaatggtttcgaaagaaattccgctcgcctctaaatcacgcattttgaaatcaagaaaattagcaacttcaatttcagttcggcccggctcaatgaattttaaagctgacataaacgcttcatcagcaattgcacaggctttttttatcaaatcaatctctgtgtcatctttaaattggcgcaattccaaaataaaattacttgtggctaaaagttctaatcctggagtggcgtcagaaagtcttttaaagaaagcatagtcaactgtttcttcaaaagctatatttttaattgattcacttgctgacaggtctgtcagtaaacttattggatctcttgtttcgataatttcaaaatcactaatcaatccacgcgccatttcactataacggctgtctgtcataaaaatatttcgcttcgctgtcaaaaaaactgtgcccgcggttccagaaaatcctgtcagataaaagatattcttcatatcagtaatcaataaactatcaatattttctgtcagcatttttgcttttaatttttcaattctcattttattctcctttaaattaagaattaaactttaaaatatttcttcattttcttacatgataacacaaaaacgctaacatgagttaacgtttccttttaatttattttttaagcggaagtagggcatcagctaatttagcaaattcttcaatagataaggcttcaccacgaattgttggcgatatttctgcttgtgccaataatttttcaatttcaggtttactttctttaccaaaagctgcttgtaaattattcatcaatgttttacggcgatgaacaaaactgctgtgcatcgttttaaagaaccattcttcatcttctacttcaaccaatggctcttcacgacgaaccattttcaaaatggctgaatcaacatttggtgctggaataaagaccgttcgaggtacgataaaggctacacttgcttccatataatattgaacagcaattgataatgagccgtaagctttcgttttaggacttgcagcaattcggtctgccacttctttttgcatcatcaccacaaattctgaaaatggaattttgctttcaatcaaatgcatcaaaatcggtgttgtgatgtaataaggtaaattcgcaaccactttgattggtaaatttggatttttaaatttttgaatttccgaaagtaaatcaactttcaaaatatcagccgaaaccaaagtaaaattatcgtaaggcgccatcgtttcttttaaaattggaatcaaagatttgtcaatttcaaaagccatcacttcagctgcttcttccaataaatattgggtcaaagaaccaatacctgggccaatttcaatgacatttacttcttttgaaagttcagcagtttgagtgatttttgtcagaatattatggtctgtcaggaaattttgtccaaattttttcttaaaattaaactcatggcgacgtaaaatgtcctgagtacggataatattggaaatgcggtctatgttgttttctgtcattttttctttcttttactttttatgtattttaaaactgatattaagtttctgtcagtaaattttactgacagaaaccattgatgtattctatcggcgatatttatcttctgtcagtaattcttcattacattttcaatttgttcttttgtaattttaaacatgttaagtcgtttcttaatttgttttccattcgcataaccaattctgagttgctcacaaagaaattctcgacgttttctactgtcagcagccataactaagccaaagctcattaaatcagtttgtgtcagttctgtcagcaattcttttttactgacagaacttctgtcagaggatggtccttgcgttttagcacttccaaattcatcagcaactttttctccaccaaatacttctgccaaagcctgattcagtgcttcaaaatttgcatgctcaactcctaaagaaccttttcctttaggtcttgcttcatcgcgatttaaaaacgcatgtttagcatttggaacggcttgcattatgattttacgaattcgttctccttggaaatctggatcagtaaaaacaataattcctcgcttatcttctaacctctttagtcgttctaaatctctgtcatcaatagatgaacctcctgtttcataggtctcacagtcaaaataacgcttaagattcgctgtgtcatctcgtccctctaccacaattacttcattaattttttgcttttctaccataatttgctaaatatttctctttatcttttcgatttttaaggataataactttattttcaacattaaattcttttattttttgctcaatctgtggaaactctttttcaggaaaggtccaaacaaatttcaaaaattccagatattccttgtcccatttttctttaaactcttcagcaatatctggacgatttttaccaaaaacacgactcttaatcgagcgcttaatcacccgaaacgttgtttttaaacggggcgtcttcaaccagattacttcatcagcaaaaggtaatcgctcatctaaagttgaaccgtaatttccatcaataatcacattctcattttgaaaaataaaaattcttgtcgcctcacgtaacttttctctggcaatttcacttggatatttatgaaaaaccttatctaaatgcaaaataggataacttgtaatttttcctagttctcttgcaaaagttgatttaccacttcctgaactaccaataatcataattttcataaaaatagctcctatccaaatcaaaataaatacaaatttattttttcaaaccaaaaattctcaaagcattttctgttgtcgctttagccacttcatcagcagaaatttcacgtaactcagcaattttctcaacaataaattttgtgtaagctggtctattttcttttccacgatatggcattggtgttaaataaggagcatcagtttccactaaaattttatccaagggaactgtagccgcagcctcctgaacatcaagagctttcttaaaagtgactacacctgaaaaagaaatcatcattccaagctctacaaatttgagtgcctcatcggctgtcccagaaaacgaatgcataatcgcaccagcaggaccaacaccttctgatttaataatttcataagtatcatcaagagcatcacgtgtatgtacttgaaaaggcagactcatttccttagaaatttggatttgtcttctaaaagctcgttcttgttcttctttcggacggatcatccagtgataatccaaaccaatttctccaagagcaataactttttttgctgacagcttggtcagtaaataattttcagcttggtcatcaaattcagcagcatcatcaggatgccagccaattgttgcgtagcattcttcaaatttctcagccaacaaaagtgctgcatcatttaattcataattacttccaacattattaattcttgtcactccaaatgtttgagcttggactaattcatcttgaattcgtccttcaaattcactagtatttagatgtgtatgtgtatcaaaaatttccattatatttttatttatacttccttattcttcctcaaaagtctctaacaatagtttttagaagaatttcaaaaattgatattccctaatcttccttatgattctctttgctttggttagttcttggttagtctcttggttagttattttacagattaatctggttcaatttttgactaatttcatttttaattgtaccacttatatgagaataaatcctcagagtaattgactcgtctctatgaccaacccgttccataattgctttaattggcactccaagttccacgagtaatgatacatgagaatgtctcaataaatgaataccatattttctttcactccctaatactttttgacaattatcacaaataaacttataaaatacaggttgtctgaaaattccaccaaccgcatttacaaaaacaaacttatcatctaaacagtttttttggaaataatcaataatttccaagcaacgattacttaaactaatagtgcggattgaacctaccgttttaggtgtttgaataactcgatcatcatattttgcaacacgatattctaaagtgtggtcaattcttagtaacttatttttgaaatcaatatcttgataacgaatagaagcaaattcaccgaatctacatcctgttagaaaaataaattccatagctaaagtgtaccttatatcttttttataagatttgcaaaatatcaaaacggaactcatttcttctttacttaaaaatttttcatttgcccgttctaatgtttcaatttctaacgttactttaggtaatactactttgtcagctggatttgaatcaatatacccgatgttttcagcatatctgaacaaaattcgaatgtaaattctacgattttttcttgttgaatttgcaatatctaattccatcaaatagctttgtatatctgcagtccttacttctgagactttatattttgaaaatttttcgataaatcctcttaaagaaatttgctccgctacaaaactcgctggcttaacgtcttgttttctaattacaatccactcttcataaatttcttgtaccgtcttattttgaacgatttgtttctgaagctcgttagcagttggtactttttttgattgttcaatttttcttgctaatctatttttagcttctgattgagcaacccttgattttgattttaaagtgaccgttacttgtcgccatttattcctcttttcatcaaagtatttttcaaagtatctatattttccactatcaagttgcttataaaacatatttcctccttttaccaaagataaaagaaagctatacagcacttatattatatcatatctgtatattacttttatctttttttaaattgtactttctcttaatttttgcttatattcaagaaaagatttataaccctcgacatttatataaacacgtttatgacttggtcgtaatatataaacattaaactctgtccgtctcatttcagttaaatcattattaagtgtttttataggtacatcaaataattctgaaattccccgtttatctttataattttcttccattttttcctccaacaaaaaatagagcaagatttttcttgctctttacttaaactttaaatatctctaatatatccatgacttgtttttgaataattatcaatcgctaaatctcgaccataagcaacaaagttaaaatatctttgtaatgtttctatacttagaacttctaaaccacccatttgttcaattaattcctgtgctaaatcttcatcattttctgcttccacaaagtccaaatcatctttattatcgataatatcatcaatactataaatttcaagaaaatcttttaaatgatctatatcagaaatttcttctaatttttccgcatactcattaagttcctgaatgacaaactaatatctctggtcaatgactggtggggagggattgaatgaaacaagaattaggatatacacagtataaatttaattatattactgattatgcaaaacaaattgatgaatcagcaacacgcatggaatttatctggcagaatagagaatcatttaaagacaatgttgatattgaagtagctcttgaaaatgctcttaaaaatattgaacgtcagattgaagaatttaaaggttatctgaaaccttttgataaggaggacaaccaatgaaacttttgtgtaagctgttcgggcataagtgggaaccagtgccatttacaatgactagagattactgtgagagatgttttatcgaaaaagaaaatcctcacggttgtattattggcaatttcaaccgctcagaccttgacgagtctgagaacgtgttccctgaaaaatggcttgataaacacatggattgaacgcaaaaaaagcccaaatcaaagataagggcttcgggggattaacaaaaattaacgtgaggatgtgtccatgcaagataaacaaggtctaacctggagtgatggatatatttctttaacatattccatagcatcaaggtcattttcaaattgtttattaataagatacgaatcagtgactgtcggacgattggggcaagcacctttgtgtacttcatgataaccgctaaagtcgccagttttatttacaacataactcatgattaaatcctccttcaaatagttatattctattattttaaaacttttattagtctagcacaagcaatatgatttaaataaaaggaaatataaaaatgcccaagctgaccaagcttgagcgaaatacgatttacaacaacttattatattactttcagtcagttatattatatcatacagaccaataatttattccaaaataaaaatgcccgaactgaccaaattcgagcttaatagaacaatgtttcatggataatttttatggtctaacaaattatatcatactgagctaggaactcgctaaactcaactggagggaaaataatgaaagacaataaacaagtatcattaattcaaagaacactgctagaagttgcacaatttaaaaaacataagctaaatgaatttttgataggggaaacggactggtggtattctcctatcaatgatattgtaatggctatgactaatggagaaaaacctggtccttttaaatatgctgaagtagaaacaaacgattggttatgggttatgtcaacaatagacggaaaccttgtattggatggaaaaggcggaatcggaatcgaggtcgaatagaatgaaatttgaattttatggtgaaaaaactccttgcggtaatggttttacacaacctgttattacgaaggaatgtactttcgaagatgctttgagatatttggaaaacggagttgtttttgatgatgaattaagtagaggattaaaaatagtggaatttaagaaagttgaggttgaatagaatgtttaatagatataaaaagttagaatatcgaattaacgacttgcaaaaggcaaatgataagtttagagatgaactttataagttaaagaatactgttgatagccattataaatttaaggttttatataagccaagatatgattgggcttttacgtttaatcctgaagttattgaaaaatactttttcgataaagaaacagcaattgaattcgtcaaagataatttatctaataaagatgagccaattatattagatttaaagactggtaaaacgattgattttattcaattaaaggagaaaaaatgaagcaatggacagatgaattatctcaaaagcttagatataaacgttctgatttaaaacttaatcgtggtgagctttgtaaaatattaaaaataggtagccatacattaaaaaatttagaggaaggttattgcgaaattaaacaatcaacttatattaaattgcttgaatggttagttgattaaataaacaaaaaagcccacggcaatgggcttcggcatctgaatttctaacttaattataccacaaaaggagattttgatgaatggcagataagttagatagaattattggagattacgtgaatggcagacttgaagccagaataaaatcaatcgaaagcagatatctttataagcaaaaagtagataacttaggcattcgtacagcttattctggtggttcggaacctgaaagccacgtcttgaataaagaagcacttgaaaatgatgaggaatacatcaaactcaaagacctgatgtaccaattcagcttgtggtacgaacctttaatcaaggaggaaaaagaaataatcaagctaaaacactgtggttatggtggctttacatggtacagagtaatgatggaacttgataatgaaggtattgagatttcagaaaagaaagcgaagtttatttactaccgattcagaaaagatataaaccctcatattggctatttcatttgaaagcatgggtcaaattgggataaaaacgacacgaaaaaggcacgaaattggagtgttgctccttgtttttgctgatatacttgtatcatgaagtaaaaggcaaaagcaaaaaacaacaactaattcggtttggatatacttcataacgttgctggacgataaaaccagcgtagcaagtgactggcagatattgggcatgatatctttgcgaggttcgactcctcgtcttgctatatccaacattgtttggggatgataatactagtacagtttccgaataatattaataagtcagtgcggttggagctgacagcaaggacaaggaacgacttcgctattagaagttatagagttcgagcctctatcttgctattatattttattacaggttgtccaatgggcagccttttattgttgatgagaggagatgctatcttgccaatgaccggacgctgtcgtgagcctaactgccacgctatggttattagaccactacattattgtactaagcacgctgataaagaagcagcatatcaagcaagcagagaacgatgggctaatcgtactgataatactaaaagatataaggactataacaaacgtaagcgtgagtatagcgacattaaagtagagcagaataagttctatcaaagcaagcaatggaagtctatacgtgatgtagtaagacgtagagataacttcctttgtcagtactgcaaagcacacaacagagtaagaactggtaagatagtggaccacatcgtacctgttgagtttgacttgaatggtaagaccatcatggataacttggctttctgttgtagcaaatgccacacaaggaaaactaagtgggaacaaatttattatggaactggttacggaaataaaattaaaaacgtaatccccataaaaaatgtaaaagatgttcctgactttcaaaaaaatgaacgataaattttaataaccctcccccctatatctttacagggaaagcacacacataggtatcatcttgcgtgaaaacccatttttcaaaatttttatatagggggggtcaaaacactaaaagaaaggagaaaaaatgacagctaagaagttcaaagacagtaatgacgggaagttgtcctatcgtgcacctaagcacctttctcctctcgcaagtgcttgttggcgtaaaactgttccctttcttgaggaacaaaagccagttgataagattgattcgtttttagttgaaatgtactgtactcagtatgaaatttatagaaattcatatgaacatctaaaaaaacatggtgaggtccaagaaatttataaaccagttcaagatatgactggtgaaattattgaccgacaatttcaaggtttcaaacgtaatccaatgactcaaatttactcggatgcaataaaaaatcttacaaagattggttctgaattagggttatctccaaaatctcgttctgaattgatggaacttaatatgcaaacaaacgaaaatgaagatgatggaatgggggatttcttcgatgaagattgatttaactcaaacccatgatgttatcggtacatatcattcgctaaattatgaagatattagagaagaatatcaagaccctgctacaaaatatgcttttgatgtcttagatgaaaagtacacaacaggatatttaatgcaattagcatgttttaggcatttacaggacttaaaaaggataggaaatgaagattttccttttaattacgaagtaaaacatgtaaaaaggttaatgaaattctctaaaatggctccaaacgtagatactatggaaccgactaaattaatggagtggcagaagtttatgctatctttattaataggttggagaaataaagaaggtggtaaacgtttcagtcgtgcaattatatctgtaggacgtggtcaagggaaaacttatatgttagccatattaatggcctattcattttttatagaaagtcgtggtttaagtaaccaggactttttagtttcatccattaatgcaaaacaaacaggtaaattatatggctatttgaaatcgatgattaatgtccttagaacaattaatccatggaaaaatatagctgataaaaccgacctaagcttacaagctgacaaaattattatgagaaaccataataatgtgattcgcccaatctctcatgaagctggacagtatgattcatatcactttacaactgctatctttgatgaaataggcgaagtaaaaagccgtgagaagatttctaagattgtatcagggcaagttaaagttcctaaccgtcaatttgttcaaatttcaacagcatatcctgaccctacagttccctttcatgaagatgagaagatgctgcaacaagcaatggaacaagactttttaagagatgctgatacttatctatgtttaatttggagtaatgatagtttagatgaaacttataagcctgatacttgggttaaatcaaaccctttattagatttagcttcagaacatgataatctcatgcaaggactacttgataagcgtgataatgatgtacttacaggtgctgttcatgatttccaatgtaagaatcttaatatgtggctttcatcagatatagacagttatttaaacctagcagatgttgaaaaagcgattgttcctgaatttaatatctatggtcaacgctgttatgttggtgttgactattctatgtcatcagataatacagcagttgcttttgtttacccttatgtaagtgaagaagggcaagcgaaatggcacgttgaacaacattcgtttattccttttcaagctgcaggctcaattgaagccaaagaaaaacaagatggtattaactatagagaacttgaaaagaaagggttctgtacaatcacaagtcatcaacaaggattaatcaatgacgatgaattctatgagtggattgtaaattatatagaagaaaattcacttgacgttttattttttggatatgatgcaatgggagtgactaaagttattcaaatgctgcttaataatactggatttaatttgcaacctattaggcaacggacaggagaactggcaaagcccactaaattcttacaaaagatatttgttgaaggaacaattagccgtctggatgacaaaataatggaaaaagcattattaaatgctgtattgcgtgaagattcagttggtattcaagtagataagcgaaaagctacacttaaaattgacgttgttgatgcaattatagatgctctatatcaaggtatgaatcattttgaagattatggaatggcaaatgatagaagctggcaagttgagcatatgacaccagaacaagtaaaagaatgggttactagccaagaatctggcttattagaccttggcgacgaaatagatgatgattggggatttgatgaagatttttaaagcgttttttaaaaaaatatgggatgtttttgatgttctatgcttctctttagcagctattacgttaaatatcacagtttttctaatgaacttatttgctggtggaattacattaacagtaacatttattatttttggagttggttcttggtttattagttccaaaattacgaagggaggtgattgattttgccaatattaaactttatcaaccaaacaaatgatccgccagaagttggtagtgttcaaagctattttccagatggaaatgatgctcaaataatggaaagtttgcttggtgataataacgaatgggtttcagctcgtgcagcattaagaaattcagacttattttctattatcttgcaactatctagtgatttagcaatagttaaaatcaatgctgaaaagaaaaagaatcaaggaatcattgataatccaagtactaatgctaataaacatgggttttggcaatcaatgtttgcacagttgcttttaggaggcgaagcattcgcttatcgttggagaaatgctaatggcgctgatatgaaatgggaatatttaaggccatctcaagtaaatacttattatttcgagtatgaaaacggaatgtattataacatcacttttgatgaccctaaaatagagcctattttacaagctccacagagcgatttgattcatatgaaactactatcaattgatggtggtaaaactggaattagtccactttactctttgagacgtgaatcgaaaatccaaagagcctctgatagattaacaattagttcattgaatagttcattaaatgttcctggtgtacttactgttaaaggtggtggacttcttagtgataaagataaagcatctcgttctcgttcgtttatgaaacgttcaagaagtggtggtcctgtagtattagatgaccttgaagaatttactgcactagaaattaaatcaaatgtagctcaattattatcacaaacagattggacttctaagcaatacgccaaagtatatgggcttcctgacagctatattggtggacaaggtgaccaacaatcctcaattcaacaaataagtggaatgtacgcaagtgcattaaatcgctatttaagacctgctataagtgaattggagtataagttaagcgaccacataagcgttaacatgagaccagctattgaccctcttggtgataattacttatctactattagtactgctacaagatggggtgctgtagctgaaaatcaagctacatatatcttgcaagaagcaggatatattcctaaagacctaccagcccctgaaaatacaaataaaaagacaactggccaaagtaatgagccagtaccataggaaaggaggtggtcatggtgattattcttagaaaggaggtaaatgatgacagtaatcgacattaaaggagatgtagttgataatagttacggaatgatgtatgactggtttggaatcgattatacaagtccatctaaagttaatgatgccttagtaaatgctgatgatgaagaaattgttttaaatatcgcttctaatggcggagatgtatttgcagcttctgagatttatactgctattaagatgaatggtaaacctgtaactgtaaatattcaagggttggcagcatctgcagcttcagtaattgcaatggctggagatacggtaaatatttctcctacagcccaattgatgattcataaggctatgagtggtagccaaggaaatgctgacgactttgaaaaagaagctaaagttttaaatggcgttgaccaatctattgctgcagcttatgaattaaaaactggtatgaaacaatctgatttgttgcagttgatgtctaacgaaacatggatgacagctcaagatgcagtggataaaggatttgcagacaatattatgtttgtagatgctaataaaccagtattttctaactcaatcggcaatattccaactgctgataaacttaatgaatttatgaatttcatgaatttcaaaaatcggaataaccctccgaaagaagaaccaattatagaaaacaaacaagccgatttacgttctcgtaagttggctattttattagaaaaataaaggagactcaaatgggagttaaattaacagtaaatcaattgaacgaagcatggattgcttcaggagataaagtcacagactttaatgaccaaatcaacatggctcttaatgatgataatttttcagcagaagctatgtcagaattaaaaaataaacgtgataatgaaaaagttcgacgtgacgcattgagagaacaacttgttgaagctcaagctgagcaagtagttaatatgcgtgaagatgaaaaagttccattgaacaaaagcgaaactgaactcaaagacaaatttgttaaagatttcgtgaatatggttcgtaaccctatggcgtttatgaatactgtatcttcaaatacagacaatgggtctgatggaaacgacagcgctgctggtcttactattccgcaagatattcgtacagctatcaatactttggttcgtcaatatgattcattgcaacaatatgtacgtgttgaaaatgtgacaactcttagcggtagtcgtgtatatgaaaaatggactgatgttactccattgaaagtgatggatgcagaagacggagaaattcctgatcttgataatccacgtttgacaattattaaatacttgattaaacgttatgcgggaatcatcaccgcaactaatacattgcttaaagatacagcagaaaatattcttgcatggttatcaagttggattgctaagaaagtggttgtgactcgtaaccaagcgattattgcagtaatgcaagcagtacctaaaaaaccaacaatcgctaattttgatgatgtcatcgatatggccaacacttctgttgaccctgctattttgtcaacatcattcttcttgaccaatgtgtctggttgcaatgcacttcataaggtaaaggacgcaacgggtaactacttgttgcaaccagacccttcacaaccacaacgcatgttgattcaaggtaagcaagttgttatggtggctgaccgctggttgccaagtggtggaactgcttcagctccactatacccactctattatggggatatttcacaagcgattacgttatttgaccgcgaaaacatgtctcttcttccaacaaatatcggtgctggcgcttttgaaacagatactactaaaattcgtgtaatcgatcgcttcgatgttaaagccactgactcagaagctttagttgctggttcatttactgcaattgcagaccaagtagggaacttcaaaactacagcaccagccgcaggttaatcaggaggtatttaaatgagcgtaactgttgatgacttactagatcagctatcagaagatgatgatcgcaaaccacaacttcaaatttattttgatacagcaacagcatatgtgaaaaatgcagtgagttctgatacagttgatgctccatttttcagtgtagaaaatgtttctccgatttatgatgtagctgttcttagttattcaatggatttgtggattaatcgttctacgactatgcctcctactacggctgtagatcatatggttggacagttgagaggcctttactcttcgtggaaggaggcgcaagatggtcaaaacgtacaaaccgaatgattttaacagaaaatgtcagattggagttactaaaacagtaacggctccaagtggaggcaagattgaaaaaattgacccagcaacggttttaaatgttcgatttgcggctaaaatgagatcacttgcgcttcaatttcagataattggtacaactacggctgatacattcgacattgcaattagacataataagctagttacaaagaaaatgtgtgttcaaatagatggtgttctttataacattattaatatttcttcagatgaatctgcaaagcttattaaatttgatattttgactcttcaagcgaagaagaagggggcttaatatggtttcgttttatgatgcgatgcagcttattgtcgatagagctgaagaattaagtacaaagatgagtgtagaagataaggcggaagttactaaagctggtgctaaagtttttgaacaagcattagcttatgaagttagaaacaggcactaccgccatcgtgatactggagaagacccacatttagcggatagtattgttatgaaaaataagaatattgacggagttaaagatggtcaaagtgttgtaggatgggaaagaagtacggaaaaaggtactcatacaaaaggttatatcgctaatattattaataacggtagtcgttttcctcagtttacaacacgttctggaagaaagtacaaaaagcccggtgaagttgcggttcatgcagatcattttattgaagaaacaagaaaaaatcctattgttcagcaaggaatattaaaagcagaagctgaggcaatgaggaaaataattaatagaaaaaagaaggagagtaacttatgaaaagaccagttgaaattgttcaagacataattgcagctagtggctttccatacagcgaaatctttcttgattctattcctagtgaaaaattagattctagtaatgaaacgcaagttttacttacagaatcagataatggacctaatgattatggtaactcagattttatttcactcatgtatggtgtttatattcaaatcttttactcgaacgctgaagattcgggtataaatattgttcaaagcgaaattaatctgatgaaatcatttataaataatgattggcttattgcacagtcaaaaagtcactatatagaccctgacacaggtcaaattattaaaaatttaacggtgcaacgcatcatgacgttaagcgagatagcaaatagctaactcgttttttatttaagaaaggaaattaaaatggcaacaaaaggtttgaaaatggtaactctcgctcttttagatgatactggagcgattgtaaaaggagctggcggtttatcaactgatggtactttcccaatcactaatgaaatgttaggtacaaagactgcaaatatcaccaatgtatcaagtgctccaacaatgatttatggtaatgatggtcaagtagatgcagatattgcaaaaggtactccttctgtagcattcgacttcaatggtttgccttttgatatcaaacaaaaactccttggacgagttaatgatactaaaggtggatatactcaaggtcctgttcctaaagttgcggctttgattcaaacgacaacaattggttcagcctctcctcaatatattggctttgctgcaggtaaaatgaatgaaaccgcattgaacttgcaaacaaataccaatgcggttgtacgtgtggatgatgcattgacatttactgcattctctgtaagccgttggggtggagaagctatcaaattctatgatggtggagatgctaaatttactgaagctgcaatgttagcagatgtatttaacggttatactgctccgactactggcggttcaggttcaggaactggtggacaataataattaaaggcggagcaatccgctttttatatgggatagatagaaggtctattatattaggttcgatacctgactattccgttacaaaaagtaaaatagaggagatatacaatgaaattatcattaccagaaattagagaagaatcatttgaagttaaaacttcaattaagaatattaaaaaaatgcatgcctatcaattggaattagcgaaaagccaagaaaaactcgcttcagttcaggatggaacactagaagaattaaccaaagcaatcgctcttgatgatatgtcagtaattaataatgctgaaaaatttattactgaaattctaggtttaaataaaaaagaagtagataaattagaagaatttgaccgtggccaatttatgaatttgcaatctaaacttgttctttcacttcaagggtatgatgacgaacaaatcgatactatgttcactgaggaggttgattctgccgaaaaaaaagttcaagcattgaagaacgaaaagtctaccaccacaaccaattaatagatttacaattatttgaaaaaaatattatcgaaaattggcactggacattagagcaagtagataatcatgactattatgacttaattgatgtgtttaaagctaatgaagataataaaatggcttcatttgatgatttgaagaaaatgtttgggcaataataattattctcttgtaatatgcagtatataggggtataatttacttattaaaaatcaggagaaattcatgaaatattgccctaattgtggaaaagaaattataagttcatctaatttttgctcaaattgtggttttgattttaaccataaaaatgatattaaacaagaatctggtgctattaatgtacctaaaaaaagtgttgaagaattcaaaaatgcttacttagctaatattattttagctgtaataactggtatttacgttgttttaaaatttttacaaatttttggaacatatactattaacttgaaaattttcccattcataattttagcttgtgctatctatgcaaatgttgttaataaaaagttgaagttaacttatacagcttcaattattatttatatttttagtatattttcaatatttttctcagggtttctatctcttggactcatgttctattttgctttaatattgatagtagtaccatatggagcatcggctgtcctaagtgcaactttagcatacggaataaagcaaaatattttaaagtgataaaaaactcaattcaataaaaataaaacgtctaaataaattaggcgtttttttatactcaaaaacaggaaaggagtaaaaatggcagatataatggttgattcagtcaccacagggattgacttgaatgagacaaaggctgttgaggctatcaaccgcttaaaatcagcagttaaagatagtactcgtgaatggcagattaatgaagcacaggctaaatctgctggagatgctgtttctgcatcaaaatatcgctatgaaggtcttagtgaagcaatggaaaagcaaaaagcttatattgctaacctatcagaaggtatgaagacaatcaatagagatactgatgctggcgagaaagcttatcaaaaatataatgctcagttaaccacagcagaacgttctcttgcctcaatgacagggcaattaaaccgtgcaaaatcagcttatgagtatcaacaaactggtattgatgatttaaataaatctcttagtgctaatgataaactcatgcaatctcaaattgatttatatgagaagacccgtaataaaatgggagctgctaaagccgaagtttctggtctatctacttcatacgcaaagcaaactgagatttatagagcccaagtaactgagcttaaacgattagaagctgctgagggtacaagttcagaaactcttgtcaaacaaaaaacaagggtaaatgaagctgcttcgtcagtattgaactacagaaataagcttttagaagctaacttggcagttacaaagatgcagccgtttaattccgagtctctcattggtaaaggtttaaatactgtttatcaaacaactgagaaagctaccgatgtaatggcagcaggatatcaaaaagtaaagagtgcagcttatcaaagtgcttttgggattgctgcaattggtgcagctgcagttaagggcgcacaaatggcctctgaacttcaaaaccaatataaaacaacttttaacttattagtaactggtggtgaacaagctaaagaagctcaagaaaatgttaacaaaatgcaagagcagggttctgaactttctgttaagtatggtaaaactcaaaaagaaatagcagatggatatcaagaacttgtaaaacgtggatatacgagtgctcaagctcttggtgctttgcctacaatgttgcaagcttcagtagcttctggggatgattttactgatgttgtacataactcaacagcagcgcttgaaagttttggtaaacgagctgatgatgttactggaatgacaaaaaatacaaaagaagttgttaaccagatggcctatgcagcagatatgacagcaactgatttccaaagcatgggtgtagcaatggaatatgtaggggcatcggctcatcaaagcaagttaagcttgtcagaaacagcctctgcaattggtattctttctaataatggtcttgaagctgacaaagcaggtactggacttagaaaagtgattgtttcgctacaatctcctagtgatgcagcagcaggagccttaactaaaattgggctaagcacaaaagattttgtagaccaaaacggaaatatgaagtcaatgacggaaattttcggattgttaaaccaacatacggaaaaactaagttcatttgaacaaggacaaattttccatgctttatttggaactactggtcaacaagcgggtgcaattctttctgaaaacgttaagcagttaggcgaacttgatgataaggtaaaaaaatcagctgatggtcaagggtatgttgttaatcttgcaaataagaatatgcaatctactcaaaatgaattaaaacaatttaaagcagccggagaggctgttttaattatgattggtcaaaagttcttgccagttttatctgatgcagcaacgtcaatggctaaggcatttaattctaaagaaggtaaacaaggacttgaagaaatagctggttggattgctaagattttccaaggtatcgttgatactgtcaaattcattggtactcataaagatgaggtaataacctttggtaaaatctttgctggaatttgggccactaagaaaattggagatgttattgtatggcttgaaaaattgaaaaaatctttacttgaaattcaagccattgatgcattatcaggaggtttaggaacaggaggaattaaatcttctgtaggtaaaggtgtcgctgctgaagctggaacagttgcttcaacagtaactaaaggtggcgtagctgctgaaggtgaagcacttgttgcctctggcggtttatcaaaagctacttccttaattccaagattattaggaattattggctctgttggtggaagcacagtcttgtctggcggaataaatgcaggagctgaattactcagtaaagataataccgctcagaaaactggaggagttgctggctcactcggtggagcagcggcaggcgcagctattggttctctttttcttcctggtcttgggacagtcgttggtgcagcactaggtgggatgggtggtaaaaacttaggtaaaaaacttggggatttgattaatgacggattaaaagaatcttcactaaaaagtgaaaaactaccagttgttaagttcgatcctaaagcaccaactaaagatatgaaagaattctccaaggactaccaaggtttcttggataaaattaataaggcatcaaatgttgatattgtcgatgaaaaatcacttgaaaaagctaagaaagcaactgctgatgcttatgcgaagatgtccaaagatattgataagttttatcaaaatcaagaaaaggattctaaaaagcaagttgaccttctagttaaaaatggtgtaattactcaagctcaagcagacaaaatgaccaaaggtcaaaaagattcagacgataagcagaaggcagctcagaaaaagaatcttgatgagatgaagaagaatactgataaatattattcggatgtggcaaaatctcaaaaaaattatgacacacaatctcaaaaggatgctatcaatcacgctaacctgatgaaaaaaattaaatctggtaatacttctgaacttcttaaaatagaaaaaacttatggcaaaaattctcctgaatatcaacaagaaatgaataaagaaattgctaaagaaaatagtgatttcaataaagctcaacaggctgcaaaaaagaaacataatgaagcaatggataagcttgaaaaagattatgcaaaaacgcaaaccaaatccgaagagcagatgaatagtcaaatcaacactgctaccaaaattgctcaaaacaagcaaatggatcttttagaagatttaaagaataaaaaaggtaaattaaatcaaaaacaattaattgatacgctcgaaaaggctgacgatgaatataaaggtgttaaggataaggctcaaaagcaaaaagatgaagctgttaaagcagctaacgaaaaatacaagaagacagtagcagcagcggacaaagaacgtgcagaaaatgggtcaatgtctaaagcccaatatgatgaaattgtaaaaaatgctcaaaaacaacgtgatggagcaatttcagcagctaaaaagcaacaagaagaggttactgataaagccaaaaagactcatgacaaaactgtggaattagctaatgataaagctgataaaaatgttaaagctgcagctaaagagcaaggagaaacagttgaccaatatagtaaaggctttaggaattcacgagatttaatcaattcatttattgatggaattaatggagttcttaacttcttacataaaggttgggggaatattggtcatgtaagcctcaaggggtttgcgacaggtactcgtggattagctcaagatgaaacagccttagttggtgaagaaggatttgaacttgctcaccatccaaaccgtggtatttttgcggttggtcaacaaggtcctgaaattcgtaatctgaaagctggaacttcaattctccctcactcaatgtcaaaagagtttctttcattaacagctaatttgccagctcatgctgacggagtatctggtttcttatcagatgcgcttggatgggttaaatcaacctataaagatgtcacaagtgttatttcgaaagggccaaaaggggttgtagaagctatttataatggattaggattagataatttagaaaacgactttcctccggttgttactaggatggcaaaaggttctgctcaaacagcacaagataattttataaaattcttacaatcattcttcaaaaaagctgaatcggatgcagggggttcacaaggttcgccatctggttctggtgttcaacgttgggctggacaagttaaacaggcgcttgcagctaacggcttgagtacaagccaagacatgattgaccgtgtacttcgccaaatcgcaacagaatcaagcggtaatgaaaaggcagtacaaggaaatatcggagatattaacaatatcactggtgaccttgcaaaaggattaatgcaaacaatttcctcaactttcaatgctaataaattccccggtcatggggatatctttaatggatatgataacttattggccgctcttaattatgctaaaaatcgttatggttcaagtttatcattcttaggaaatggccatggctatgaaaatggtggaatcataaatgcacatggattttatgaaatagctgaaggaaatcgtcctgaaatggtaataccacttgaccctcaaaagaagtcaagagcgactcaacttttgaaccaagcaaatagaactattaacgctaataattatgaaaaaaattctaatagtaatatggaattagctttaactcaagctgttaatctactttctcaagtattaggggccactaaagaacaaacgacagctcttaaaaatcaacctgcaccaattattgatgaaaatagtttctttaaaggtgcagctccaacaattaaaaaaacacaggattcataccaaaatagaaaaaatagattaggaggtattatgatttgacatttacgataagttttaatggtcaaaatatttccgacttggtagatggatttacttcaatcgaacgaaattttggctcaacatggacaaataatcttggaccagaaggaactacaagatatggtcaagaatttgttaataattatattaatgcgaaaacaattacaatttctttcattaaagatggtattccgaaagattgggttaatattcgccaacaaattgctagtgttttagatgtttcaactccttcaccgttaatttttagtgatgagccaaataaggtttggtatgcattgcctgatcagttacctactttttctgaagatatatcttctttaagggcaacaggaactttaacatttattgtaccatcaggtgttgctatctcaagctatacacaagaattgaattcaaataattcaggaggaacaaatggttccattacagttaattcagataactcagttgatgtcttgattaataaccaagggactattcctgcatatcctacgtttaaatttactcataaatctgataatgcatttataggtattgcaggtcaaaatggagttattggattgggaagtcaggatcaaactttgattgactcaaaaacaactgaaacaacaagagtagaatctcaatggcttttaaacccatctggtataagccaaaatagtaattttagtggacattttaatgtggctaatgatgttggcaaccctcaaaacggtcaattattaactgcaggaaatcttgtttttaaaaaagatggattaagattacaagatggaggttttcctccgtctggcggaacatggtcaatgcaaggggctatgcaagtctataatgttccagctgataaaataggaaatgttggaacagctaattttacttcaacatttaatatttgggcgcaagcaacaaaaatggggcaaactgggctgatgcaagttttattttgtgattctaacaataaacttatggctggattaggaatatataaagatgatacaagaggaaatagctttagaactcaactttatattggtggtaatcatcccagaacatggaaaacatttggaccaggaggacaagaattaaataatggtggtcatggagatgggaaagttcataatccaaacttatattttaattctacaactggatattttactattcaaaagaaagatagagttttcaattttacatttggcaatagaggaggaaattaccctattactattccagagcttggaagtactaaatgtacaaaagtatttgtatatatggggcaattaaaaggaagagatgtcaacacacaatatataacaaatctatcacttagaatgtttaattttcaaaagaatgatgttaccaaaacaattgatagcaatacagatgttacaacatttattccagcagataatcatcattatggtaatagtgaagttgttgtagtaaatatgagtagttcaaaaatatatagaagagaaggacttacaattgctaatgatgagatgattactggttcagaaccattttcagttcctccaggtctatcaattgttaattgctcatttggagataatgcagttcctccagatattgatataacttggaaagaaaggtatctataatgcaattaaatattcatgactcaacattaaaaagaattggttttatcaataatgatctaccagatgcacttcactattttaatgataattggcatcgttatttagcggagggaacatctacttttgacttttctgttaataaggtaaatcctgattatgccttgttgactttacaaagctatataagctttagttacgatgatgaagattatttatttaatataattaatatccaacaagatcattccaccatgcaaatccaatgtgagaatctaaacttggaattgattagtgaagaagttggtgcttatagcaatacgaagcgccatagtattgtttggtatttacgtaatgcagctaaaattactgacaatgtattggaaattggtaataatcctttttcaactattgatgaagatatatctaatccaatactctcttttgatagtaccgaaacaaaactagctcgtataatttctatttgtaatagttttaaggctgaatttcaatttaaaacaaatctaaaagatgacggaacacttcaaaatataacattagatttatatcaaactggaggagttgggcaattaagaaaagatgtaacgttatattatggtaaaaatattgatggtataacctctactggtgatagaacatctacattttttaattcaactaccgttactgattcaaataacaaatataattggttatcaatagagggaaaatattataattctgatggccaattagaattttataaagatgctgctagtaatacagcatatgctcctttatcaagagatatgtttccttctcaaatcctatctacatcttcagatcaatatactaataaaaatattcaaacatccgcaagttcaaatgatgatttatgggattatgctgtaagccagtttaaactatatgcttatcctcaaatgacttatgaagtagtagtatcagtaaatgctgttacaagtgctcttggaaatgacaaaaagctaaatattggagatacaataattgttcaagactcaacttttgacaagtcagatggtggattaattttatcagcaagagtatctgaacaagaaataagttttactaatccattaaataataaaattacttttactaattttgttaaattaaaaagtgcaatatcagctgacctgttaaataaaatgcaagaaatcgctaaacaaaatgctccatatcgttcagagatagatacctcaaatggagtccaatttgttaatggtgtgggttctacaacacttactgcgcgaatatatcttggggctgacccaaacgaaacgattgctgatagctaccaatggtctaaagatgggactcttgtagcaaatgctcaagaaataacggtggatgcgagtggtatatctgaaaaggccgtttatacatatcaagctttgataaatggaaatgtagtggctagtcagtcggtgactatcactaatgttaatgacggaacagcaggtaagcccggtgctgacggaaaaacatcatacactcacacagcgtggtcttacagcgcagacggcacagatagattcactactgtttatccaaatttaaatttaattgacgggactaaagattttagcggtacttggacaaattcagatagttggataactgatggaacatataaaggtttaactgttaaaaaacggactgggcaatgggaaggcatatataaaacatttactgcacctaaagacggaacttacaccttctcagcttatattaaaagttcaggaaatactgcaaatgtctatagatatggtggcgtaaatggtcaagacccaggcacgttaataggtaataactttgactggactagagataacgtaactttaaatttaaaagctaatgatagagtgtggtttaaatacgaaatatcaggcttaggtgcagattcaattttatggactgctggtcataagtgggaacaaggctcaaccgcaactccatacatgctatcatctagcgaagtcacaactgctgactggccaagatacattggtcagtatactgactttacgcaagctgacagtactaatccatcaaattacacttggattctgatacgagggaatgacgggaaagatggaccacaaggccctgctggaagtgatggtaatcccggtaaaatcgtttccgatactgaaccaaccacaaaattcaagggcttagcatggaaatattccggagtagtggacatgacacttggtgatggtacaaaaatattagctggaacggagtactactggaatgggacggtttgggctttatatgaaatcaatgctcataacatcaacggagataatctatcagtaactaatggtacattcaaagatgggaagatagagagtatttggggtaaaaatggagtaaatggtacgactactattgagggtaaccatttacaaattcactctacaaattcggtaactaacactgaaaatacagtagctcttgataatgaacaaggatatgctcaagtttatactgaccgtaatacagggagagtcataagtgttcaagcctctgttcaaggtttctttgtttctgatagtacgggaccatatgtgagagtaacccctaatggaattagcacctcgtctgacaagtattatagtagtttacaaattggagcaggtataacaataaacttagaacgaagaggagatatagttgaagctacattgtcaggttctataaattccccattatcatccaatactagatttggagttggaattattccttttggatatagacctaatagaacagcgtatattatggtacatatgacctcaactaataatagttcacatatagatgttgaacctaatggcatctgtacttggtgggggacttcgtataatgccggcgcaccacgaggtcaccaactatggtttactaatgattcattacaaaactagaaataaggagaaaaaatgaaaaagaacaaacagactcaagaagctaccgacattattattgataataatacagttgctaaccttacctttacagcttatgaaacaggagctttagaagcacagctaacaattaataaccctcaagattttcataattcagaagaagcaaaaaatgagctaaacgaattagtatcagaagcttttgaggcttcaaaaaataaactggatacttatgaagtgacagaaaattagaaagcaggggttatggaattaaaacagctcgtagagcagcatgagactaaactcaaacaacatgacaaggaactatctcgactcaacgacatgtcggttgaaatgcaaaaacaaatgagtgaaggacttgctcgtgtagatgaatccaatcgctttttaagggaacagaatactcgtcaatcagaacagaatgcgcaaattttgcaagccgtcatcaaaggcaatgaaagttcagatgaacgacagtttcagttgaagttgcttgataaaacaaacttttggaaattgattttcggaattggcggagcttcggctgccatatatacgattatcatggaaattataaaattaattagataaaagaggaaaaataaaatggatcaaaatttaatgacaatctttagcggtgttttaactttagtaggaacagtagtgtcttacttcatctcacaggctgctaaaaaacatagcaatgtgaaaaatatcgatgctttagcaaaattggctaatcaagcagtaagttgggcagaaaaaaacttcaacgagaaccctgagaagttatctgaagccattaattatgtgacaaaagaagctaaaaatctaaaaatcaagactaatccagctcagattgaagctcaaattgaagcttctttggctcaattgaaaaagaattttacttctgacccagttaaaactgttaaagaggttactgaaaaagcggttgaagttactggccaagttgcacaagccactcaaaaagcagctgatattgtctttccaattattgaagaagtagaaaaatcagaaccaacagaacaaggagaatgatatgaacggaattgacatttccagctatcaagcagaattaaacgctggaattgttccctcagatttcgtcattataaaggccacagagggaactaactatataaatccaacttgggaagagcaagctggacaagtaattcaaacaaataagcttctgggtttctaccattttgccagtgtaggaaatccaatcgcagaagctgatttctttatcagcgttgttaaaaattatattggcaaagcaattcttgttttagactttgaagctggggcaattaatgcatggggaaatgttggtgcccgtcaatttctgaatcgagtaaaagaaaaaactggaatcaatccgatgatttacatgtcagtagaagttactcgccagtttaactggagcataatttcaagtactaaccctttatgggttgcgcaatatgcctctatgaatcctacaggttatcaatctgaaccgtggactgacggaaaagggtacggtgcttggagttcagcggctatccaccagtatagttcagctggttcacttgctaattggagcggtaatcttgatataaatcttgcttatatcaatgccaatcaatggaaatcactagcaggaagcgcaagcactagcaattcaataactacagaagatattaatataaataatacaatagaatatgaggaagaagaaatgcactttattcaaacagttgatacaaagcgaatctatatgattaatgctggaatgtattcgtggattacagacccaggaatgtggactaattatcaaaaagcattccctaaagcaccagttattccactatatcaagcacaaatggaaaaactatatcgtaaaaatgtgtaaattaaaatcctgacttcggtcagggctttttttgttaataaatgttacttcgtcattttattgatattgttataatgatggaatcatgaatgctattccaattacaaatacaaatagctaagtgtttatgaagagataaagcgtccttttccaaagcgagggcgtttttctttacaatggaaacagtaaattgtataataattttatccttttacataaggttataaataactccgagaacatcgttttgactaagtgacggtgttttttatttgaaaactaatacaaaaagtagtagaatgaattcatcttacctatataagataacgtctgcccttaaacagggctttttgttctagttaaggaagtagatatatactatatttacccaaaaatatataatttttcataaatttactccgagcgtccctctcctaactggggcgctttttttgtgctataatatagtcgggatgtttgtgagatttcatcctattcctagagtcaagccattcttcggagcggctttttttatttgtttcatatgatataacgaaactcttaaacatgggtgtcagcaattttctggcatttttcatattattttgtaaatgagaaaaaagaagtaaataaatgtataatcaaaatttttcataaagttttagtcctaatatccctctgaacaaggggcattttttgaattgtctatataattcttgacaaaataaaatgataagagtaaactaagaaaatcaagatctaatcttgatatctcctaatctaagagttctaaaactcttaacaaattatttaacgccctttatagggtgttttttcataaatttatgcacaaaaaaagctctagctggatgacttcaaggagtccaactagaggatgatgagtgttagtacaaattcagaaaaagtttcgtgtgtacaaaaaataagaggtactaacaatttaaatattatcaatttttcagacaattgtcaattatttatagtagtgtattataatagttttagtggatgagaaaaacattcaattacacacacttgataatcttcagttccatccacacagatcttatataataaccaagatatgtgctgcagattgtcatattttggttctttagctcagttggtcagagctaacggctcataaccgttcggtcgctggttcgagtccagcaagaaccataaaaatgtatattaaaatagtagaaacttctaaaaggagtttttttagttacgttaatcaaaataaaaaactgtatatcttagatatacagcctcttgcccgacaaaaattagttacgtttttagttacgttgttagaagtaactcataggtattcattagtacaataatttttataaatcccacaaaacaaggtttagcggtatctattgacatttattgacacagtatgccataatagctctatgacaaaaaatgcaagacaaaccgcactcgatgtattgaatgacatttttggcaatgatgcttatgccaatatttcattggatcgaaatttgcgagattctgaactatccacagttgataaagcttttgtgactgcccttgtatatggagtggtttctaaaaaagatttattggagtggcatattactcccttcttgaaaaaagaaccaaaaccttgggcaaaaatgctcctattacttacagtttatcaaatcttatttatggataaggtcccaacttcggcagcagtagatgaagcagtcaaaatcgctaaacgtcgtgatggccaagcaacggctaactttatcaatgctgtgttacgcaatttcatgcgttctgaacatcgaaatgaagaaccaaaggattgggaaacaaaatattcaatgcccaaacttttattggataaaatggttcgtcaatttggtggaaaaagaacaggagaaattttagaaagtcttgaaaagccaagtcacgttagcttacgaagaattgacccaaccgtagaaattgcaggatcgcgtgcttctctactgacagaaagtgctctaattgctgacagtggaaattttgcaatgacagaagaatttcaatctggcagaattacgattcaagatgaaacaagtcaattagttgcccctcaacttgatttagaaggaacagaagaagttcttgacgcttgtgcagctcctggtggtaaaagtactcatatggctcaatatttaacaagtggccatatcacagcactagatttatatgatcataaacttgatttaattaatcaaaatgcagagcgtcaacatgttgcggataaaattactactcaaaaagccgatgcgacaatgatttttgaagaatttggttcagataaatttgaccgaattcttgtggacgctccgtgttcaggtattggattaattcgacgcaaaccagatattcgctatagaaaagaaagttcggattttgtcgatttacaaaaaattcagctagaaattctgaacagcgcctcgaaaagcctgaaaaaaagtggtataatggtatatagtacttgtacaatttttgatgaagagaactttgacgttgttcgtcaatttctagaaagtcatcctaattttgaacaagttgaaatttctagcgataaggcagatatgattaaagaaggatgtatttttattactccagaaatgtatcatacagatggctttttcatcgcgaaatttaagaaaataggcgaataactgctgacaaatatttttttaattctgtcagtaatttttagacctaaaaataaaactttattcttgttaaggagaaaaagtggaatacagtattttatcagatatcggttcaaaacgtagtactaatcaagactatgccggtacttatgtcaaccgtgcaggttatcagctttttttattagctgatggcatgggagggcacaaagcaggtaatgtcgcaagtaaacttaccgtagaagatctcggcaaactttggtcagagacattttttgatgcgggaacaccagaagcaactcttgagatttggctaaaaaaccaagttcgtaatgaaaatgaaaatattgccagccttggaaaacttgatgaataccaaggaatgggaacaactcttgaagccttggttattaaagcaggaatgctcgtttctgcccatgtaggtgatagtcgaacttatttaatgcgcgatggtgaattaaataaaataaccacagaccattctttagttcaagagcttgtagatgcaggacaaattaccgaagaggaagctgaagttcatccgaataaaaatatcattactcgttcacttgggcaaactagtgaagttcaagcagatattcaagttttagaacttcaagttggggacattattttgatgaactccgatggtttaacaaacatggtttcaactaccgaaattatggaagttttagagcgtgaagatttaactttagataataaatctgaagctttagttcgtttagccaatgaacatggaggtttggataatattaccgtcgttttgattaagtatgatgaaacgacagaaagcgaaacaccagcgcaggaggttagttgatgattcaaatcggtaaaatctttgccgatcgttatcggattatcaaagaaatcggacgcggcggaatggcgaatgtttatcaaggtgaggatacttttcttggtgaccgcttggttgcaataaaagtgctacgttcaaattttgaaaatgatgacatcgcgattgctcgttttcagcgagaagcattcgccatggcagaactttcacatccaaatatcgtaggtatttctgatgttggtgaatttgaaagtcaacaatacattgtcatggaatttgttgacggcatgacacttaaacaatacatcaatcaaaatgcacctttagccaatgatgaagctattgaaattattactgaaattttatcagcaatggacatggcccattcacatggtattattcaccgggatttaaaaccacaaaatgttttagtttccagtagtggaactgtaaaagtaacggattttggaattgcgaaagcactctctgaaacttcacttactcaaacaaatacaatgtttggttcagttcattatttatcaccagagcaagcgcgtggctcaaatgcaactgttcaatcagatatttatgcgattggaattattttatttgaacttttaacaggtcaaattccctttgatggagattctgcagttgctattgctctaaaacatttccaagagagtattccaagcatcattaatctcaatccagaagttccgcaagctttggaaaatgttgtcattaaagctacagcgaaagatattaaaaatcgctatactgatgtagaagaaatgatgactgatgtggcaacttcaacgagtcttgaccgtcgtggggaagaaaaattagttttcaataaggatcatgatgaaacaaaaattatgcctgccaatctaattaatccttatgacaccaagcctctgattgataaaaaagaagataatgattcacaaacagatgaaaaagctgcaagctcagaagtaggaaataaaaacaaaaaatctaaaaaaggcttgattattggtcttgttatccttcttttagttgttggcggtgctactttggcttgggttgtctcaacaccaactaatgttaagatacctaatgtgacaaactcgacacttagccaagcaaaaagcaaaattaaagatgcaaaacttaaagtaggaacagttcataaacaacaaagttcaacgattgctgaaggaaatgttatcaagactgacctaactagtggaacaaccgtgagatctaatagctccgttgatatttatgtttctacgggaaatgaagatatcatcaaaatgaaggactttgtcggtgaaaagattgatgaggcgatggcaacattacttaaggattatggtattgatgaaagccaagtcactcaaacttccgttcctagtgattcttacccagcaggtacaatcattaaacaaagccctaaaaaaggttctagttttgataccaaagggagtgaaaaaattacctttgaagtttcaagtggaaaacaagttgaagttccggattataaaccgaacggtcaatatatgacttattcacagtatcaagctgctttaaaagctgcaggattcactaatattacactagaccctcaagcaacaacgagtcaacaagctgacggttatgtatattctgtttatccgactgttggagcgtctgttgatccaactcaagaaattgtagtcacttatagcgtctatactgctccaagttcaagttcaacaacttctgaatcaacaacgacgcctgaaacttcgtcaagcacaacttcaagtacttcaagctctacaacaagtcagccgtcaacagataacaacaatagcaacaaagaatcttcaacaacgtcatcaagtagttgagaaaaatagactaggaatctcgtgttcctagttttttgataaataagttaatttacaagaagcttgtaaaattaggcaaaaaagtgtatcatggtagagtagttttttacaacccgttcttggtttcatgcttgccaagctgtcactcggactgggcaatacaaataaaggagaaaaactcatggcaatttcaaaagaaaaaaaacaagaaatcatcgctcaatacgctcgtaaagaaggcgatactggttcacctgaagtacaaatcgctgtattgacttgggaaattaaccaccttaacgaccacatcaaatctcataaaaaagaccacgcaactcaacgtggtttgatgaaaaaaatcggtcaccgtcgtaaccttcttggataccttcgtgaaaaagacgttcaacgttaccgtgaacttatcgcttcattgggacttcgtcgttaataaaaaatgccatatggcattttttattttataaaataaaaactaaaaggagcattttccttctagtttttttatttttaaagatttttttctttttcgatagtagcgctaatagcatcaataactgttccgataaaatggttttgttctaaactcactacaccagcgacagtagttccaccaggacttgagactttatcaactaatgaccaaggattttcactactttggagaatcatttcagctgaagcgcgaaccgtttcggcaacaattgctgtggcttgatctttaggaataccatgcaatacaccggcacgtgccatggcatcaatgaacatataaataaaagcagggcttgaaccggcaattgctgcaaatgttgaaaaatctttttcagcaatttcatggacagaaccagttgatttaaaaatttcttgaactgtagcataagcagaatcatcaacaaattcatttttgacaatggctgatgttgactgaccgatttgtgcattgatatttggcatcactcggatgatcggttgattttctgaatcagccagatgtttcaagtcagataaagtgagtcccgcagcaattgaaattaatgttttatctttagttaaatgattgattaatttacttaaaacagagggaagtacttgaggtttaactgatagaatgataaaatcagattcttgaacaagttcttcatgattacttgcagccgtaacattaagagtttccgcttgatttcgagtttttgttaaattgtgtccggaaataatgattttgaatttatttttgtcaagtccagaaataatagctgttgccatttttccaactccaataaaacctattgttttcataaataaaatcccttcttttcttttcgtccattttatcataaaaagtaataataaatcactttagtagcatcgtaaaataaatcagattttttttaaatcttagtactagcctgtatatttagcgcatattgagaggatttgaattaaaaagataacgaaaatgccccttgattatggtataattaggtaaacattttattttatttgtaataataaaggagaaatctatgaataaattcgcaattgtcctagcggctggtaaaggaactcgtatgaaatcagcacttccgaaggtcttacatcaagtggctggaaaatcaatgcttgctcatgttcttacaagtgtttctgaagtagaaattgctaaaaatgtagtgattgttggtcatgaagcggctcgtgtaattgcaactttaccaaaagggactcaatttgtgaaacaagttgagcaattgggaacgggtcatgccgttcggattgctgcggatttattagcaaatgaagatggagcaactcttgttattgctggtgatacaccattaattactggacaaacgttagaagcactttttgattatcactttgcacaaaatgcaacagcaactatcttgacagcaattgcaccaaatccaacaggatatggacgaattattcgtgatgaaaatggctcagtagaaaagattgttgagcaaaaagatgcgaatgattttgaaaaatcaattaccgaaattaatactggaacttacatttttgataataagtcacttttcaaagccttgaatgaaatcacaactgataatgcccaaggagagtattatttaacagatgtcattgaaattttcaaaaaagctggtcaaacggtagcggctcatattcttgatgattttgacgaaagtttaggagttaatgaccgtgttgccctttcacaagctgagttgacgatgcgcaaacgaatcaatcatcaacatatggtcaatggtgtaacgcttattgaccctgcgacaacttatattgacagtgaagttaagattggtgaagaaactgtgattgaagcaaatgtaacaataaaaggaaatacctttattggtaaaaatgttttgattacaaatggtagccgtattgaaaattcagaaattcattcaaattgtgagattcgtaattcaacggttgaagaaagcagaatgagtgttggaagtaatgtagggccttatgctcacttgcgtcccggaactgttttgagcgaagaagttcatgttggaaactttgtcgaaattaaaggttcaacgcttggtaaaggtacaaaagctggtcacttaacttatattggaaatgcaacggttggtgagaaagtgaactttggtgctggaacaattacagcaaactttgatggtaaaaataaattcaatactgaaattgatgactttgcctttattggttcgaattcaacaattattgctccattgcatatcggtaaaaatgccttaacagcagcaggctctgttgtaacagaagatgtaccagatgaagcagttgaaattggacgtggaaaacaagtgaataaacttggacgtgctaaaaaaatgccacattatcgtggtcaataattaacaaataaaagaaagagtttctcctgaagctctttccttcgattttgatgagaaaactattctttaaattctttaaagaagttttcggaagaaaggacacaatgttaaattttgatgataaaaaatttgaagaaaaaactttagctagagaagaaatttttagtgggaagatttttcatgttgtaaaagatgtagtttctttgtatgatgggcaagagagttttagagaacttgtttttcataatggaggaacagcgattgcacctgttcacaacaataagatgattttagttggtcaatatcgtaaagcattggaaaaatttatttttgaaattccggcaggaaaacttgaaaaaggtgaagaaaaagatcccaaagctgcggccttaagagagctcgaagaagagactggatatctggcgcaagatttgacagaaattacagctttttatgggacacccggtttttcatcagagaaaacatttgtctatttctcatcaaatttaacaaaagtggaacatccaaaacccgctgatgatggtgaatttttggaacaaattgaagtcactttaagcgaagcaaaaaaaatgattgaacttgaacaaattgcggatgcaaaaacaattatggctatttggtattgggaaatgcaatatttgaaaaaggagcttgaaaataatgcctaaacctcttttaacagatgaagtaattgaacaagcaaaacaggataagaaaaatcttgaacgcagattgcaaagagagcttgaagaagatactgaaatcgctgaaaaatacgatagtattgagaaaaatttaagcaaaaatgctgtttataaaagtcgaagaattgaaaatgccaaggctcaaaaacgtgggaaagtaattaataaatggcttttcatcgttacattaattgttgttctattggcagtagctttctttttgtactacttttagagagtaaaaagattagaaaaaaggtaaaaaaatgaaaataggaattatttgtgcgatggatgaagaaattcgcatacttgttgaaaacttagaaaatgcagaaaaacatactcgtcatagtttagtttttcatacaggttcaattggccggcatgaagtggtccttgtccaatctggaattggtaaagtgatgtctgctttggcagttggatttttggttgacatttttgatgtcgacgccattatcaataccggctcagcgggagcagttgctcaaggtttagcaattggtgatgttgtggttgctgataaacttgcttatcatgatgttgatgttactgcttttggttatgcttatgggcaaatggctcaacaacctttatactttgaatcaagtaagtattttgtttctgaattgaaaaaagttttagaaaatgtgcatgttggattgattactagttcggatagttttatcagtagctctagtaaaattgctgagattaaagagcattttccagatgttttagccgttgaaatggaaggggcttctattgctcaagctgcaacagcacttggaaaaccatttgtaattattcgtgcgatgtctgatactgctgaccatgatgctaatgttaattttgataaatttattattgaagcagggaaaaaatcagctgagggcttgattcgtttactcgaagaaatggtataaaattggaatctatcttttgatagatttttctttttatgagaactaagaggaagtgaaatgggaaaaatcaaggataaaaggttagaactcttaattgaggaagttaatatttttttgaataatgaccaattgtttgagcactgtttggcagtagcaaagacggctgaggcactgacagaagaattaactgattctaatgaaagacgttcgcaagcttttattgcaggacttttacatgatattggtggaatttatccaaatgatcaaagagtagaaaaagcagaaatttttaatatcgaattactgacagaagagcgtgaatttccattaattattcatcagaaactttctaagtatttggcgagccaacattttaaaattactgatgaacaagttctgtcagcaattgaatgtcatactaccctaagaaaaaattttacagaattggacttgattgtttttcttgctgacaaaattagctgggatggtggagataatgcgccatttaggcagggattactgacagctctgtcagtaaatttgcaaagtgcggcactttattatattaatttcattattgatgatggattgaaagttgcccacccatggcttttagaagcaaagaaagatttagaaaatcagctttactagctgatttttttgataatttagattataatagaagaatataaaaaataatagaatatcattattaaaaattgataatgattatttttatcgaaacttttgtcagaagtttcgatttattgggaggtattatgacagtaacatcagatttcacacaaaaactatacgaaaattttgcagaaaatacaaaattgcgtgcggtagaaaatgccgtgactaaaaatggtttgctttcatcactcgaagtccgtggttcgcatgctgcaaatttgcctgagttttcaattgacttgacaaaagaccctgtaacgaatcaaaaacaatctggacgttgctggatgtttgctgctttgaacactttccgtcataaatttatcaatgaatttaaaacagaggattttgagttttcacaagcttacactttcttctgggataaatatgaaaaatcaaactggttcatggaacaaattattggtgatattgaaatggacgatcgtcgtttgaaattccttttacaaacaccacaacaagatggcggccaatgggatatgatggttgcaatttttgaaaaatatggaattgttcccaaagctgtttatcctgaatcacaagcttcaagtagctcacgtgaattgaatcaatacttgaataaactactccgtcaagatgctgaaattttgcgttatacaattgagcaaggtggagatgttaaagcagttaaagaagaacttttacaagaagtctttaatttccttgcggtaactttaggtttgccaccacaaaattttgaatttgcttttcgtaataaagataatgaatacaaaaaatttgttggtagtccaaaagaattttacaatgaatatgttggaattgatttgaataattatgtgtcagtaatcaatgctccaactgctgacaaaccttataataagagctacacagttgagtttcttggaaatgttatcggtggtaaagaagtgaaacatttgaatgttgaaatggaccgctttaaaaaattggccattgcccaaatgcaagctggtgaaacagtttggtttggttgtgacgtgggtcaagaatcaaatcgttcagcaggacttttgacaatggattcttatgatttcaaatcttcattggatattgaatttactcaaagcaaagcaggacgtcttgattatggtgagtcgttgatgacgcatgccatggttttagcgggtgttgatttagatgctgacggaaattcaactaaatggaaagttgaaaattcatggggtaaagatgccggtcaaaaaggatattttgttgcctctgatgaatggatggatgaatatacttatcaaattgttgtccgtaaagaccttttaactgaagaagaattggctgcttacgaagagaaacctcaagtacttctaccatgggacccaatgggtgctttagcttaatttgcaaacaaagaacatttaactttaggttaaatgtttttttattgacttaaagttcacttcaagtgttaaaataaaagaatgaatataaaaaaagctgctgaattatcggggataaaaacagataatataaggtattatgaaagaattgggctgattcctaaaattacacggacagaatctggaataagaaattttacagaagctaatattagaactttgaaatttgtcaaacacatgcgagatgcaggtgtgcaagttgaacctttgacccgttatatggcattagtgaatgagggaaatcccgaaacgaaagaagaaagaattgaaattttgaagaaccaggttgaacaattgagaacagaaattattgaaaagcaatctgccttggattatttgacattcaaaattgaaaattatgatgaagtgatgttgccaaatgaaattaatttgaaccaaagttcaaaagaaacaatcaagatttaaataggaaaagaataaatggaacttcgattattaaaatatttttggacagttgcaactgctggaacagtatccaaagctgctgaacagttatatattacgcagccaacattatctagacaaattaaagaacttgaacgcgaactagatacacaactttttatgcgtgatgggaaaaaactgatcttaactgaagatggacaatttcttaaaattaaggctgaggaaattttacagctgaccagtaaaacagtacaagtttttgaagaccgaaaaaatgcagaattatctggtcatctgacgattggtgctttagaaggttggacaacttccagtatcgctaaaacgctccaaagactgacaaataaatatccatcaattacttttacaattttgtcagggaatgctgatgatatcaaatggaagattgacaacggactagttgatgttggttttttgttagagccaacatcaactgaaaaatataatgttgaaaaaattggctttcctgaacgttggatgatgctcactcaatccgattcagaacttgcagaattagatgaagtaagtccagaaatatttaaaaagcaaagaatattaatttcagaacgaccagaagttcgtcaatttatagccgattgggcagactgccaagtgagtgatttagaaattattggcggctttaatctcggttttcatctttttgaaattgctcgtgcaggaattggcgaagcagttgttacagaaggggcgcttattcgagattatcctgatttaaaagctattccattgagtccggaagtgaaaactttaagtgtgcttgcttggaaaaaaaatattccactgactcctcttacaagagcatttattaagcaatatcttcaagataatgaataaaaagttactgacagaaattagagcatatttgtaaagactaaagtgtcaacagctattctcagacagctctgtcagtaacttttttgtcagtattatgcttacaaagcataataagaactaaaataagcatttctaatcagtgaatttttattttaaaataaatctatgaaaaataaaaaaacatttggtcttatcctttttattattttgttttcctatttccttattttaatggataactcaataatatttacaagtagcttaaaaatttctcaagatttaaaaatgaatgaatcaactttatcttgggtttctaatgcttatacgattacgtttggtggttttcttttattagcaggatgcctgggtgatttattagggcgaaaaataattttccttcttggacttttcatttttggattttctagtttagttgtcggtttgtcaacttcttcagaaatgatgattattgccagagcagttcaagggattggttcggctattcttgctccaacaagtttagctttattaatggatacatataaaggggatttaagagttagagctatctcatattatggagcaactgcgggaattggctcaagttttggacttattctaggtggctggctcacttcggctctttcatggcgtgttggctttttattaaatgttccttttagtttattattaattatcctaactcttgttaatgttcatcaaagcgatatcaaagctagcaaaattgactttttgggaagttttctgtcagtccttatctcagtcctatttgttttcggaattacggtaagtaatttgttcatcattatcctctcattcattttaattatcttatttatactttgggaaaaaaagttaacttatgcattaattcctttagaattatttaaaaataaagtacggtcgggttcgtatgttgcacgctttgcctttatgatggcaatgttgacttactggtttattctgccacagattatgcaaaaaatgtatcatttttcaccattgcaatccggacttgcttttcttcctttaacaatcgtaaattttatcgcggctctttttcttcctagattaactagagcattaggaaatagtaaagtaatgatcctaggacaagtgattttactgacaggaatgattttgtcattagtttcgcaaccagaatggggatatttctatgcgatgatttttcaaatgatgattattggattagggcaaggttggcttcttgctccgctgacggcagcgggagtagaagaggtcagtccagaattatcaggagctgcatcaggtttgacaaatatgatgcatcaacttggaggacctgttggtttatctattgttgtgttatttagctcaaatattgttgacttaagtgcttattatcatttggtcatgggattcatcaccgcttttctgtcagtaggccttcttgtcttaatttttactagaccagacaataataaaaaataaaaggagaaaaaatgcaaacaaaattaacattaaatgatggcaatgtcattccccaattcggtttgggactttatcagcttccagaaggaacagaaacgcaaaatattgtaaaaactgccttggaattaggttatcgtcatctggatacggcacacgcttatcaaaatgaagcttctgtcggtcaagcaattcaagactcagaaattttaaattctgaaatctggattacaagcaagctttggccttctgattatgagcaagcacaagaagcaattgagcgaatgttaaaacgtctaaaagttgaacaaattgatttactcttattgcatcaacaggttggaaattatcgaaaagcatggattgctttagaaaatgctgtaaaagagggaaaggcgaaatcaattggaatttcaaattttgatggagaaagattaattgatttatttaattttgctgatatcaaaccgagtgtcattcaagtagaaactcatccttatcatcaacaagtggaattacgggaatttttgaaaccttatggtacaaaaattgaaagttggtatcctctgggacatggcgataaaaacttacttgaagaaaaaatatttaaaaaaatggctaaaaaatataataaaacagtcgcacaaatcattttgcgttggcatattcaagagggaattattgtttttccacgctcaacgcaaaaagaacatttagcagaaaatataaatatttttgattttgaattatcttgctccgaaataaaagaaattcgtaagttaaataaaaaacaaccttattttacgatgacctatgaggagcaagaaaaaaactttttgtcatggaaactagaagactaaagcacagattctcatgcttttatgcaaaagtgatatactttagagagttagaacttttaaaacaaaaaataaaatcaagcctagatggtcttgattttttctatatttcattgaaaaaaggagaatgtgatgaaaaaaattgcaattattggtggcggaataatcggtatgaccttagccaattatttagatactgataaatttgatattagtctttttgatgatgaaaaaaatcaggcaactaaagcaagtgctgggattatttctccttggctttctaaaagaagaaataaaaaatggtatcaattggcaaaagatggtgcagctttttttgaaaaaatgaaaaatgattttgagttaactgaagatgtttatgaaaaatgtggcactctttttttgcgacaaaaatcagacttaattgagttagaaaagttggcaattgaaagaaaaaaagaagctcccgagatgggtgagattaagagactctcggaggaagaaactgttgctttatttccattattaaaaccaagagaaagtttgtatctttcaggaggtgcaagattagatggaaaagcttacttatcgtcattaaaaaagcgagctcaaaaaagaggggtcaaattttattcagagcgggcaacaattgctcgagcgttagataaatggcaagtcattcatgaaggtgtgacggaagtggtagatgatttagttttatgcccggggccagctttaaaagaacttttggaatcaattggcacacaagtggatgtcaagccacaaaaaggacaattaatttcatttcaaacggattttgaaacaaaaaattggccagttttatttttagaaggggctgcagatatcattccctttcaacatggtcaagttcttttgggagcaacccatgaaaatgaagagggttgggatttgtcagagagtcaggaagcttttgaaagtttgacagagggggtcaaatcttacttatcggatacaaaactaattgactttccatatcattatcgtgtgggaacacgtgcttattcttctgacttttcgcctttttttggtccgcaccctgacttttcttcattagcttttgctagcgctttggggtcatctggattaactactggtccttacatcgcctatttacttgcccaatattttaatcatccagaaatttcttgggatagttcaaattatcaaaaagacataaaaaattatattaatatagaaaaaacgagcaattaaaaggcttattatcacactaaaaaattatgtaaatcatcagaagaagaacttttggtgttttacataatttttttgtcagatacataatgagccaaagtaacgaattgagtcaggtttttttgtctaaaaatgatataatgatttcatggaaaatacagatttgatttacggactacatgcggtcacggaagctttaaatggagaccttgtcaacaaactttacgttcaagaagatttgcgtggtaaaaatgttgaaaaaataaaagaattagcacgactaaaaaaagttaatatttcatggacacccaaaacagaattaaataaattaacagaaaacggtgttcaccaaggctttatggcaagagtgtccgaatttgcttatgcagatttagaaaagattctcccagcattagccgagaaatctgatgccacaattttaattttagatgagttaacagatcctcataatttagggtcaattgctcggacagctgatgctacaggagtcgatgcaattattattcctaaacaccgtgcagttggaattactccgacggctgtcaaagcttcaactggtgctttacaacacgtccctattgtccgtgttactaatctttctcagaccatggataaacttaaagctgctaatttctgggtttttggaacggacatggacggcacagtttacagtaagtggaataccaaaggtaaagttgccttgattatcggaaacgaagggcatggaattggtcaaaatcttaaaaaacaagttgacgaaatgattacaattccaatgacaggacacgttcaaagtttaaatgcatcagtagcagcaagtattttgatgtacgaaatttttagaaatcgactataaaaattactgatgaaagctttagcgcttggaatcattaaagcccaaacgtatgactaatctgtcagtaaattcaagaaattatcagcaagttgaaacagcagaaaggattattatgacttttcaaatcatgacagactcaacagcagacctgagtccgtattatattaaaaaacatcatcttacagttttgggaatgactgtaactgttggagaagaaacttatgaaactataggtgaagccgcattagataattccacgcttcttgcagcaataaaaaaaggagctactgtccacacgtcccaaattaattcaggacaatttttagaagtttttaaaaaatttgcatctgcagatgaagaactcctttaccttgctttttcgtcaggactttctgggacttatcaatcagctctgattgctcaagatatggttttagaagaattcccttctgcaaaaatcactgttgttgatacactggcagcagcttctggagaaggttttcttgttgaagagactgtaaagttgcgtgactctggaaaaacactgacagaaacgcttgaagttttgtcagatattattccacgtttacaaagtcgcttcatggttgacgacttaaaccatttggcaagaggtggaagaattcctaaagctgttgctctcgttggaacaatggcaaatatcaaacctcttcttgatgttgaccctgagggaagacttcggcaagtgaccaaagttcgaggaaagaaaaaagcaattaatcaactccttgaaaagagtcttgatgagatggatacagcctatccccgcctacttatctcttattctggaacagatgaaatagcacaagaaattaaaaaacaagccatgcaaaaaaaggggattagtgatgtcgatgttcgtccacttagtccaacaattgtaactcatacaggtgacgggacaatcgcaattttttcaataagtagaaaaagtagagaataattcaataaaaaacgaaaaaaatcacagctaaactcttgttttactgtgattttatgttaaaataattaatgagtgtaattgtatacaaaattatctgtacacttacctaatttattaaaaaaatatgaatcgtgatgtgtgagggaaaggagtcgcttttatggccaaaagtggactttatacaggcgtagatatcgggacaaacacaataaaggtgcttgttgctgaatacgtctcaggtgaaatgaatataatcggtgtcggaaatgcaaaatccgatggccttaaaaatggaattattgtagatattgagaaggtggcacaagcattgcgtaaagctgtaaatgctgccgaagaacgcgcaggaatcacgattgacagaattaacgtgagcatcccagcgaattccctcgaaatggaaccttgccaaggaatggttcctattgtcagtgatactaaagaaatcacggataacgatgttattcaagttgttcaaaatgctttgatgcgtgggattgttcctgaaagagaaattatcgctgttgaaacgaaagagtttacagttgatggatttacaggtatttcagaccctcgtggaatgtttggtgtacgtcttgagattcgtggggtcgtttacactggacctaaaactcttgttcataatgttcgcaaagttgttgaacgcgcaggattgctcgttgacaatattgtaattgctcctttggcaatggcacaatatgtgcttacagaaggtgaacgtgagtttggaacaatcatggttgatttgggtgctggacaaacaacagttagcatcgttaaagaacaatcattaagatttacacatactagccccgaaggtggcgattatgtaactaaagatatttcaacagttcttaacacctctgtttctgcagcggaagatttgaaagtcaactatggtgaagcaagtacagaacgtgctagccaagatgagtacttccttgttgatgttgtaggtaaagaagaaccagaacaaattacagaatattatctttcacaaattattgaagcacgtatgactcaagtttttaatcgtgtacgtcaagatttggaacacggacatacttcagaaactcctggaggtttgattttggtcggtggaacggctgcaatgcctggtgttgttgatttagcaacaaaaatcttaggaataaatgctcgactttttgttccaggcgaaatgggattacgtaatccagcatttgctcaagtgattagtgttgttaattacattggaaatcgtagtgatattgatattttagtatctcaagcattttctggtgattatgcttatacgacgacagaagaaacttatgttgctcctgttccaacaattacaccacaagcaacaacagttgctgacgtagaaaatgatttctacgttgaacctcaggcacgtccagtagtagctcaaaaagcttctgagcctgaagaagaaaaagaaggtctcgttgaccgtgccaagaatttctttggcaatctctttgattaatctgaaagtaaaaaacggagaaataaaaacatggaattttcatttgatacagacttaacttctggtgctgtaattaaagttatcggtgttggtggcggtggtggtaatgccatcaatcgtatgattgaagaaggtgtttctggcgttgaatttatcgccgctaatactgacgtacaagcattgcgtagctcaaaagcagatacagttattcaacttgggccaaaattgactcgtggtttgggtgctggtgcacaacctgaagttggtaaacgcgcagctgaagaatcagctgaaacagtatcacaagcccttgaaggctcagatatgattttcatcactgccggtatgggtggtggaactggtacaggtgctgcaccagttatcgcacaaattgctaaagaacttggcgctttgactgtgggtgttgttactcgtccatttggttttgaaggatcaaaacgttcatactttgcaactgaaggaattgaagctcttcgtgcaaatgttgatacacttctcattatttcaaacaataacttgcttgaaattgttgataagaaaactcctttaactgaagctttgcgtgaagctgataatgttttacgtcaaggtgttcaaggggtaactgacttgattactaacccaggaatgattaaccttgactttgccgatgttaaaacagtaatggaaaacaaaggtgatgcccttatgggtatcggtgttgcgactggtgaagaacgcgttattgaagcaactcgtaaagcaatttactcaccacttcttgaaactacaatcgaaggcgcagaaaatgtccttttgaatgttactggtggtatggatatgagtttgattgaagcacaagatgcttcagaaattgttatccaagcagctggtaatgatgttaatattatgttgggtacagcgattgaccctaaccttaaagacgaaatccgtgtaacagttgttgcaactggtgttgctaaggaagatgctgacgaagctttgggtttgcaacctgaaccacgtcgtcaacctaacttgactcacaattctaatatgcaacatgctcaaacaagccgtccaatgcaaagtcaacaacaaacgcaagtgtctccacaagggcaaaatcaatcttctgcatttggagattgggatattcgtcgtgaaacttcaacacgtcaaaacgtaagtaacacacgtgatacttcttcagtaacaagtttcggcggagttccaacaacagatgaagatcttgacacaccaccattcttccgtaaaaactaaccaatgacgattaaagagaatgttaaaagaatactgagtaatgtagatgcggcaaaggctgcgtcttcttattctaatcagtcagtttcagtcgtcgctgtgaccaaatctgttgatgctaatcttgcacgtgaagtttttgaaaatggagtttcacatttagcggaaaatcgaacagaactttttttggaaaaatacgaagctcttaaggatttagaaattacttggcatttaattggtaatttacaaagacgtaaggttaaacaagttattaattatgttgattatttccatgctttagattctctgaaattagcacaggaaataaataaacgtgctgaacacaccattaaatgttttattgaacttaacatttctggtgaggaaagtaaacatggattttctgtcaatgaacttatggaaatattacatgagttttctgaattggaaaatattgagattgttggtttgatgacaatggctccgtttgatgcgactgaaagtgaatgtaatgacatttttggacgaatgaaaaaattacaagttgaaatatccgaaatgaatctttcaagaattccttgtactgaattaagtatgggaatgagtagagattatgagattgccattaaaaatggtgcaacttttgttcgaatcggtacagaattttttaaaaatctataagtcttaagattaacgtaaacaacggaggaaaatatggcatttaaagattggatgaataatctacgtgattattttgtagaggatgatgaagagttcaatgaacctgcacgtcctgtgcaagaatctaggccaacggtggcatctacgccaaaaccaaaggttgaggaacgcaaagcacagccggaatatcagactcgtcgtcctgcacaatcaacttcaaaagcacaaacacaaacagcagcgccaaaacgcgctggttcaacattcacaaaacctatgcctgaaaaaatcgtacaacaacaaaccgtttcacaatctcaatcagtggctgcaacggtttctactattgcaattaaagaaccacgtgcctatgcagacatcatggaatcagcacgcatcgtgaaaaacggtgaatgtgtccttgtcaattttaaatttatgggtgacgcccaagcgcgtcgttcaattgacttcatgactggggtggtctttactcttgatggtgatattcaaaatgttggtggtcaaattttcttgatgactccagcaaatatcacagtcgatgcagcgaaagaaatgtctatcttagctggtcaaaattttgaaagttacgatatttactaatgcttattacacttacaataataaattggcttttacgcttacttgatgtttattcaattattctagttatttacgccttaatgagttggataccaactctttatggaacttggtttggacgtataattgttaaagtttctcgtccctacttaagtttatttgaaaatttacctttacaattttggggattagatttttcaatcgttattgcttttattgttttgaaatttattcaaagatttattgttattgtatttaacggagtattctattgattactgaaaatgtctatcaacactttcaagaaaaggaaaggcattttattgatcgttgtttagaatggataaatcgagtaaaagaatcttattcggtgataagtacattttttcttaatccccgagaagtggatattttaaaaacactggcaaataagagaaatgttcagattttttctagtgaggaactagcaagaacggaattagtcaaaataattttggcgccagatttttatgttcttgacagagaagactttgatatttctttgcttgaaattaattatgcttcaaaatttgtagaactttcacattcccaagtccttggaacttttttgggacaggctggtgttaaacggcaagaattgggtgatattattgttagtgacaataaaattcaagtttttgtcagtaaacatcttgttgagagttttaaagcaatagaaacaattgggcgagcagcggtcaaaattcaagaaatttctttggaaagcttagttgaagaaacagataaagctgtcagagaagttgttcttgtggataacttaagagttgataaaatgattgcagtcgctttcaaaatttctcgcaatattgctacaaatatgttagaatcaaagaaggttaaggttaattacctagaaattgataaaaaagatttctcttttggtcttgatgatttgattagcgttcgaggttttgggcgtatcaaaatattaaggattttaaattttactaaaaaaggaaaacagagagttgaaatagaacttataagaaatcgaaaaaaatagattctaagatgaaaatcagatttataagattttctaaggataaagaggagtgattgatgacattaaatagtttagatgttcaaaacaaaacttttaatccacaatttcgcggcttcagtaaacatgaagttgatgaatttttggatatcgttgttcgagattatgatgaattcgctcaaacaattaaagatcaagaacgagaattaaaggcattacgcgaacgcgtgaaatattttgatgacatgaaagattcactgaacaagtcaattgttgttgctcaagatgctgctgataatcttcgtgaacaagccaaaagtgaagctgatacgcttagaattaattctgaaaaagaatctgctgatattattgcaaatgcaggacaaaagagttctttaattattgaagcggctaaaaaagaagctggatttattttgaatgctgcttctgatgatgctcgtaaattagtacgtgatactgatgatttgaaacgtaaaatgcgtctctatcaccaacgaatgacttcaattattgaaaatcaacttgcgtctattcaatcggatgactgggctgaaatctttagacctactcaagattatgcaatcaatcctgaagaaaaattgcaatcaatcattgaagaacatttggaaaatgctgaaactactttggcaaaaacccaagcaattaaacctttaacagatgaagatattgcacaagcaaatgaaacatctgatgaacctgaaacagaaacaattgtttcagaggaaattgttgttgaaaccgaagtacctgacgaagtaaaagaagaagtagaaattactgacgaagctaatactactgatgattctaacgaagagtcagaagttgaagctccaaaagcagatgattcagaaattttcccagaattagattcaaaagcaccagctgaaacagctgaggttgttgaaaaagataatcaagaaacaattgatttaagcgaattaaaaaattaaaaatcagaccaagataagaaaaaatataattcaagcaagcgagtgatgatggaagactcgtattccctatttttcttattatcagctgattggaattctaaagttactgacagaatttattttctcaaagaatttttagaaaaatcttggactgaactaaaagtaagttcaagcgtcttgcacgttacgcaaaagagtttctgtcagtaaattttactgacagaaaaaatgaaggtggtaccacggtttttcgtcctttgcgaaaaatcgttttttttattcaataaaaacaaaatcgaaagaaagaagaaaatatgaaaatcaaagatactttgaatttggggaaaacagctttcccaatgcgtgcaggcttgccaaataaagaaccaaactggcaaaaagactgggcagatgcgacactttatgagaaacgtcaagaattaaatgaaggaaaaccctcatttatgcttcatgatgggcctccttatgcgaacggaaatattcacctcggacactctttgaacaaaatttcaaaagatattattgttcgttataaatcaatggcaggatttcgtgctccttatgttccaggttgggatactcatggtttgccaattgagcaacaacttgctaaagcaggcatgaagcgtaaagaaatggatttgcttgattatcttgaggaatgtcgtaaatacgcgatgaaacaagtagatatgcaacgttcagatttcaaatcccttggtgttcttgctgattgggaccgtccatatttgacactattgccagaatatgaggcagctcaaattcgcgtttttggtaaaatggctgaaaaaggatatatttataaaggacaaaaaccaatttattggtcaccttcatcagaaagttcactggctgaagctgaaatcgaatatcaagatgttcgttcagcatcaatttttgtggcatttaaagctaaagatactaaaggtaaattaccagaagatgtagaatttgtaatctggacaacaacaccatggacaattccatcaaatttgggaatctttgctcatcctgactatgattattcagttgtagcagttaatggtcgtaaatttgtgattgcctcagaaatgcttgaagctgttgctgaaaaattagaatgggaaaatccagaagtccttcaaacgattaaaggttctgaattagaatatatggttgcaaaacatccattctatgaccgtgaaactttaatcatgaatgcagattatgttactcttgattctgggactggccttgtacacgttgccccaggacatggtgaagatgactactttgcaagtcgtaagtataaattgcctgttctttcaccaatagataaccgtggttattatactgatgaagctcctggacttgaaggacttttctacgatgaaggaaataaagttgtcagtaaatggctagaagaaaaagatgctttattgaaactcgaattcttcactcactcatatccacatgactggcgtactaaaaaaccagtaattttccgtgcaacaccacaatggtttgcttcaatcgatgacttccgtcaaaatattttagatgaagttgaaagagtagattgggtaattccatgggggaaaactcgtttattcaatatggttcgtgaccgtggcgattgggtcatctcacgtcaacgtgcttggggggttccattaccaattttctatggtgaaaatggagaaccaattatcacaccagaaacaacagaacatgtagctaaactttttgctgaatttggttcaaaagtttggtttgaacgtgaagcaaaagaccttttaccagaaggattcactcatccagcgtcaccaaatggtgaatttacaaaagaaaaagatatcatggacgtttggtttgactcaggttcttcttggaatggtgtccttaacgaacgtgactaccttagctttcctgcagacctttaccttgaaggttcagaccaataccgtggttggtttaattcatcaattacaacctcagttgcggtaaatggcgttgcaccatataaagcagttctttcacaaggatttgttttagacggtaaaggacgtaagatgtctaaatcaattggaaatacaatcgtgccaaaagatgtcactaagaaatttggtgctgacattctccgtctttgggtggcctcaattgatactgaatcagatgttcgggtatcaatggatattctcagtcaagtttctgaagtttaccgtaaaatccggaatacattgcgtttcttaatcgctaatacatctgattttaatccaaaagaagatgcaattgattttgcagaacttcgtccagtagacaaatatatgcttgtgaaatttaatgaacttgtaaaacaaattcgtacagcttatgataactatagctttatgactgtttacaaatcaatcattaatttcatcacaaatgatttgtcatctttctatcttgattttgctaaagatgttgtttatattgaagcagcaaattcaccagaacgccgctcaatgcaaacagttatgtatgttattttgaaagatttagtgaaaattcttgtaccaattttgccacacacggcagaagaaacatggacttacttggaacatgaactagaaaattttgcttatcttgcagaaatgccagaagcagcagaaattcctggaagtgaagaattgttaggaaactggcaagaatttcttgatttccgtgataagattttgaaagctttggaaagtgctcgtgaagcaaaattgattggtaaatcattggaagcaacagtaactatttatccaaatgaagttgtgcgtactttattgacggcaattgatgaaaatgttgctcaacttttgattgtatcaaactttgtagttgccaacgaaccagtaaataatgccccagagtctgcaatgaaatttgatgaccttgcagttcttgttgaacatgcggctggagaagtttgtgatcgttgccgtagaacagatgaaacagttggacacaatgctaatgaacatctcaaaatgctttgtgaacattgtgcacacatcgttgaaacagaattccctgaaatccttgaagaaggttttgaagattaataaataaaaaaagttactgacagttttgtcagtaactttttattttaaaattaataattacaataccgcaagcattgatgcaagtacgctgaaaagcgtaagaacaaccatgataatcacaacgaccatggttactttttggaaagtacttttttgtggttttttatatgccataagttcctcaataaaaatatttttaactaattgtaacaagaaaaagaagacttttcaattagtttgagtctttctccttattattttcttttggagtcaaaaatttagcaaatggatcttccattttttcaggagaaggaacgctttttttatcatcatcagtcactaaatcaacagttgagatgcctaaatcgtccatcattttatcaaaatcatcacgttttctaaaagttaagcccattgtggtctccttgaaataaaatatttaacagtgctcaaaaagagaagagcaatactagaactattttactacttcatagataaaaaagctagatatatgaaaaaacttcttgaaaaaatgcgattaaaagctgataagacttgcatttcaaaactattttaagtataatgataaagaacggtagtttgctttatgcagactacctataataaaacaaattccccaaaggagacatttttaaaatggctaaagaagtatacgaccgtagcaaaccacacgttaatattggtactatcggacacgttgaccatggtaaaactaccctctcagctgcaatctctaaagtattgtctgacaaaggttactctaaagcgactgacttcgcatctatcgatgctgctccagaagaacgcgaacgtggtatcacaatcaacactgctcacatcgagtacgaaactgaaaaacgtcactatgcccacattgacgctccaggtcacgcggactacgttaaaaatatgatcactggtgctgcccaaatggacggtgcaatcctcgttgttgctgcaactgatggaccaatgccacaaactcgtgaacacatcttgctttcacgtcaagttggtgttaaataccttatcgtcttccttaacaaggctgaccttgttgatgatgaagaattgatggaactcgttgaaatggaagttcgtgacctcttgagcgaatacgacttcccaggtgacgatattcctgtaatcgctggttcagcacttggtgctttgaacggtgaaccacaatgggttgctaaagttgaagaattgatggacatcgttgatgaatacatcccaactccagaacgcgacactgacaaaccactccttcttccagtcgaagacgtattctctatcactggtcgtggtacagttgcttcaggacgtatcgaacgtggtactgttaaagttggtgacgaagttgaaatcgttggtatcaaagaagaaactaaaaaagctgttgttactggtatcgaaatgttccgtaaaacacttactgaaggtcttgctggtgataacgtcggtgcacttctccgtggtattcaacgtgacgaaatcgaacgtggtcaagttattgctaaaccaggttcaatcactccacacaaacttttcgaaggtgaagtttacgtattgagcaaagaagaaggcggacgtcacactccattcttcgacaactaccgtcctcaattctacttccacacaactgacgttactggttcagttaaacttccagaaggaactgaaatggtaatgcctggtgacaacgtgcatatcgacgttgaattgatccacccagttgcgattgaacaaggtactactttctctatccgtgaaggtggacgtactgttggttcaggtatcgttgctgaaatcaaagcttaattataaatctaagcaaattggagctgtcatttatgacagttctttttttatttaaaatttttcttaaaataaaaactccccttggggagtttttttaaatttctgattttgtaaatacaccgcggtcaacaagtgcatccatttggaagtaaaatttattttgaatcatttcactcgcatttttaaaaatatcaacatttcgtaaaccggatttgtcagtaactgaaagtttaaaaccacttaaatctggattaacaataattttcaataaaaatccttcgtttgaatttggaacttcttcaagaagtcttttaaattcaaaattaccaattttagtttgaataaaagttgtatcttttaaagtgaattttttaacagtaggcgcaagttgataaacatatttgctaccttccaaatgtttttcggtgataaatgccattgtgagtctcctaaataaattgtttatttttttaaaatagaactaagtttctcaacgaagagattaacttcatcaattgtattcatttctgaaaaagaaatacgtatgttttcttttagtttttcagaatttttcccgtaaacagcttcaagaacatgggaaggttcgattgtaccggctgtacaagcagaaccggttgagattgcgaaaccagctaaatcaagtttggtcaagagtaaatcatgattttcattcggaaaagcaagatttagaacgtgaggcatacttggaccaaaattatttttataaaatgaaatcttttgttcttctagtttagttagtaaagtttcattaagtttttcaactgcttgataatttgattcaatattttcaagggcaagttctaaggctttagctaaaccaacaagagaatggagattttctgtaccagcccgtcttttttcttcttgttctcccccatgaatcaaagcatcaaaatgtagcttttcgttatagtacaagaagccgaccccttttggtccatgaaatttgtgcgctgatgctgaaaggaaatcagccgaaacatccagaggatgcactgaaatttttcccattacttgagtagcatcaacatgaaaaacggattgatgttgcttcaagagctctccgacttcctttactggaagaagttggcctgtttcattattagcccacatcatgctgactaaaattgtatcaggacgcaagttttcttctataagtgaagctgggaatgttccgtctgcttttggttttacaaagctaacatcaaatccataacggtcatgaagatattgaacagtatttagaacagaaggatgttcaatagctgttgtgatgatatgatttcctttatctttattagccagtgcataaccaattaaggcttggttattagcttcgctagcaccagaagtaaaaatgatattgcgacttggaacttctagagcatttgccacagtttcacgggctttacgaacaatctgacttgaagcacgtccgaggctgtgaatactagaggggtttccaaaattagcggataaactttctgagattgcggtgataacatcaggaagtagaggtgttgtagcagcgttatctaaatatataatttgattttcctacctttcatagtaattgctggatattttataaggaaatcatttaattccatcaggattaaaagtccccttatctgtaagctctattttaccatttttttattctttttatatgaaaagcaatgagattattatttaaatatcttataatcttattcagatcaattaatgtgatttattgatggtatatttctaataataattatataatattcttagggaggttttattatggttgaagaatataaaaatatcttagttgcagtagatggttcagaacaagcttatgatgcccttcgtgaagcgattgacacagcaaaattaaatcattcacatctgaaaatattgtatgttttaaatgataagttagcaaatattccagtacatttagacacaatgaccttgtataaaagtgtacaggagcattctgattatgttgtagagcaagttcaagaatatcttaaaggcacagaagttgattttgagattgtacgtttaactggcagccctaaaagagaaattattaattatacaaacgaaaataatatcgatttagttgtaattgggtcaactggtcttgatgcgattgatcgttttatcattggttcaacaacacagtatattgttaaccatgcctcttgcaacgtaatggttattaaataaagaaaagaaaaagtcgtcaattgagatgacttttattttataaattaatatatcaaaaataaaaataccaacttagtgttggtattttttaattgcttaaagtgtttctataagaattactttaatcttgaggtttttcatgttcaaaaagtggagaaactgggcgtccttcgtggatacgaagaatagcactggctaagtattcagctgcactcaaatattttacgtttaaaggtttgcgatggtttgttacaacagaatctgtgaccaaaatttctttgatatctgctttttcaagaacatcagcggctccgctagtaaataatccgtggctggcaactgcataaatttcacttgctcccgcttcgcgtacaacatttgcagcgttggcaaaagtgaccccagtgttcaaaatatcatcgataagaataacttttttacctgaaacattaccgataacatatccgttttcacggtttttgtcatcatcttcatagtcaacaatggcaattgctgactctaagtattcagcaagtgagcgtgcacgtttaatcccagaattttttggtgcaacaacaatcacgtcatcaccaaataatccactcttacggtaatagtcagcaaaaagtgggacagtaaacaagttgtctacagggatatcaaagaaaccttgtacttggacagcgtgaatatcgagggttaataagcggtcagctccagctttaacaatcatatcagcaactaatttagctgtgattggttcacgagaagtcgcagtacggtcttgacgagcatatccaaagtatgggataacaacattaattgtacgagcagaagcacgtttacatgcgtcaatcatgattagtaattcccaaaggtgatcgttaacagggcagcttgttgattgaacaataaagatgtcttgactacggacactttcttccatgttaatcataatttcaccgtcggaaaactgttttgaagaaagttttcctagaggaactcctgtaaactggctaattttctcagcaagaccagggtttgagtttaaggcaaaaagctttaagtgtgaatcagagtaaaccacgatttctctccattttcttttatgaaataatatagttctattttagcaaaataatagtgattttcctagtctatatctgtaaatatatttgtgaattaatttgaaaataaaatttgagagtattttgaataattttttcaagcaaaaaatttttcacaaacttaaaattctaataaattacaaaagcgctttaaaggttgatgtgtatgtaattgaaaacattttcaaaaaaacgagaatacaaagtttgtgaaagttcatgcaaagtcttgcgtttgcaaaagcgaagtgttacaatggttctgtaaggttcgtgaaagctaagtgttacgaacaaattatttatttttaggggaattaaaaatgaaaaaaacaaaagtgatctcacttcttgcagtttcagtactctcagtttctttacttgccgcttgtggaagtaataactcttcaagtagctctgataaaaaaacagaacaatcatcaaaagcagaagtttttgctggtgcaactcaaggaacaaacaacttctctgatttgcaaaaaggctttgctaaaaacggagcttggttgaatgcaactaaaggtgatatggatgcttctgggaaaactttgactgttgaaggtcttttcttaggtgacggacaagtcgctcgtaaattggcaatctacaatcaagatagcagccacaaaattactgaccgttatactttgacagttgataaaattgaagtgaaatctcctggtttctatatttcaaatggtactgttaaagggaatgttgatgtatttgcaactggcttccacggacaaaccggtacaggtgttgaaggacaagcaacaattgatggtaacttgacttttgctagccaagaccttcttgatgcttataataaattaccagatgctcaaaaagttaaagtaactggtacaacttcagttgttaaaggcgatgttgtttcattcaaacctggtggaattacagctggtgctcacggaaatgtaacttattcatttgaaggaaatggtacagatacagaaactggggcaacaactggtactgctgatgtttcagtattgaaaaaagcactcggtaaaaatggtgcttggcttgtagctactaacgctgatgttgatgcttcaggtaaagaccttacaattgatggtactttcctcaatgaaaaatcagctgttcaacgtacacttgcaatgattaaacaaaatgatcaacaccaagtcactaaatcttatactttgacagttaaacgcttgattgttaactcacctgctttcgatcttgaaggtggtaatatcaaaggtgacgtttatgtcggtaaagatgcttcaattatggcacgcgacatgaaagggactgatggtcaatcaatccaatctgaaatcactggaaatctttactttgcaactcaagaacaacttgatacttacaaagctcttccagctgcaaaccaatttaaagtctctggcgaagttgctgtaaaagccgctaactaatgaactaaaaattgtctaaaaggctctctatgagcctttttttcttacttaaaatatagtataatgggacatacgtgtagttctatacaaaagtgaatctgtcagtaaaaaagttactgacagaaaataaaaaagtttttgtcagtgaaaaattactgacaagaggttcagtaatgacagattgatttttgtttagaaaaacataaagctaaaatatattacaaaagcaggagactggactgttagagaaagttcatagcatttcaagtcaaggagaaaaacattggcaaaagaaacattttcaatcgaatttgcaggtcggacattaactgttgaaacaggtcaagttgcaaaacaagcaaatggtgctgttgttgtacgttatggagatacaactgttttaacagccgctacaatgggtaaaatggctacaggtgatttcttcccacttcaagtgaactatgaagaaaaaatgtatgctgctggtaaattcccaggaggtttcaacaaacgtgaggcacgtccgtcgactgatgcgacattgactgctcgtttaattgaccgcccaattcgtcctatgtttgctgaaggttttcgtaatgaagttcaagtcattaatactgttctttcttatgatgaaaatgcttctggccgcgtggcagctatgtttggctcttctttagcgcttgcaatttctgatattccatttgatggaccaattgcaggtgttgaagttgcttatattgatggagaatatatcatcaatccaactgttgcagaaaaagaggcatcaagtttggagctctctgttgcgggaaatatcaacgcaatcaatatggttgaatctggagccaaggaactttcagaagaagtgatgcttggtgcacttttggcaggacataatgctgttaaagaattaattgaatttcaaaatgaaattgttgcaaaagttggaaaagaaaaagctgaagttgaacttttgcatgttgatgaagatttaaaagccgaagtgattgcagcttacaattcagatttgcaaaaagcagttcaaattgaagaaaaattggcgcgtgaatctgcgacaaaagcagttaaagaggcgataatttctgtttacagtgcaaaatatgagaacgatgaaaatctatcaatcattttgcgtgatcttgctgaaattcttgaaggaatggaacatgcggaagttcgtcgcttgattactgaagataaaatccgtcctgatggacgtaagattgatgaaattcgcccgcttgatgctgaaattgactttaccccacgtaatattacacatgggacaggtttatttactcgtggtcaaacccaagctttatcaacattgactttggcaccaatgaatgaagcacaaatcattgatggtttgaatgatgaatataaaaaacgttttatgcatcattataatttcccacagtattctgttggggaaacaggacgttacggggcacctggacgtcgtgaaattggtcacggagcgctcggtgaacgtgctttagaacaagtattgccttctttagaggaattcccttatgccattcgtttggtcgctgaagttttagaatcaaatggttcgtcatcacaagcttcaatctgtgcaggaacacttgcactgatggctggtggtgtaccaatcaaagcaccagttgctgggattgcgatgggcttgatttctgacggaacaaattatactgttttgacagatattcaagggcttgaagaccattttggtgatatggattttaaggttgcgggaactcgtgacgggattactgcgctacaaatggatattaaaatttcaggaattacaccagaaattcttgccgaagctcttgcacaagcaaaaactgcacgtttccaaattcttgatgtaattgaagcaacaattgcacaacctcgtgaagagttggcaccgtcagcacctaaaattgatacaattacaattcctgtcgataagattaaagttgtcatcggtaaaggcggcgagcaaatcgataaaattattgctgaaacgggcgtaaaaattgatattgatgacgaaggactttgttcaattttctcttctgaccaagcagcgattgatcgtgctaaagaaattattgctgaacttgttcgtgaagcaaaagttggtgaaatttacgatgcaaaagtggttcgtattgaaagttttggtgcttttgtaaatctatttggtaagcaagatgcaatggtgcatatttctgaaatggcttgggctcggacagaaaatgttgaagatgttgtgaaattgggtgacactgtcaaagttaaaatcatgaaaattgatgacaaaggtcgcgtagatgcatcaatgcgtgctttagttgagaaaccagaaggttatgttgaacctgagcgtaaaccaagagaacgccgtgaaaatggtgaccgtcgcaaaggtaacggaaataaccgtggtaatggttttgaccgtcgtaataatgaccgtaataaccagggaaataaagttggaaaccacagttttgagcgccgtgaacgtaaatcacatattgatgaagagtttccagaactctcaactaaaaaaccagaataagctcaatcataaaatggaaaagctgtaaaaatagaccttgaaataaaataaaatttactgataaaaatgctagtctatccagaagtcttagagggataatggatagatgataaccgaaatgtgattattcatgcttggatttctgtcagtaaattatttgtttatttagctcgtaaataatcactgacaggtctgtcagcaaaaaatatgtcaaattataatctcaatccagaactagatgaacgtttgcgagtttcattagcgaatccaggctcatttatggaagacctctcattggtctatgcttttcatcaatttccagtattggcaccaaaatcagttttcttcgttccgattgaagaccacaaggcactacctgtttttacaacagaagaagaacttgaagttttcctgtcagaactgacagactttgagacggaatgggaattgcactcattaattgaaattttagaccaattaatggaaacggatattgatattttagcaatcaatcctaaattacctcaagatgaagataaaggcaacaccgtttactttgggacaccagaattaatgcaatttttagttcattatactgaaattttgaataaagtttttagtccggaaaatcttgaggctgaacaaagagaaaaatattatttcgtcccagctttcgtcacaacaagtggtcaaagaactttccctaatctaatcaatcaggacaatgaagaatatcttcctttgtttgataatttagatagtttggctaaatggcacaatgaagcctactttagccaagcctttaaggaaaataatggacaagttctacttttaaaaattgatgaattattaaatggagaagatgaagtcataaatgacttaggaaaaagcctaggaattacggtaaatcctttggactactcacaagaagaagttcaaaattcaatggtcacttgggaagaattaacaagggattaaatcaattgaaagcttgatttagtcaattacacgtttttgaatcaacaaggcccacaatgcttatggtataatttactataagtattttttaacgaagtaggaaaaaatgaacgaaaaaaagaaaggtttttggtctgaagcaattcgagtgaccaaagaaaatgatccggcagctagaactgccctggaagtctttttgacctatccaggagtaaaagctcttgcagctcaccgaatttcacattttctttggcgtcatcatttgaaacttttggctcggatgcactcacaattttggcgattttggactcaaattgaaattcatccaggagcagaaattgcccatggtgtctttattgaccatggttctggattagttattggtgaaactgccattgttgaaaaggacgtcaaactttatcacggagttaccttgggggggacaggaaaagataaagggaaacgtcatccaacaattagacaaggggcattaatttctgcccattctcaacttttaggccctattgaagttggagaaaatgcaaaagtaggggcgagtgctgttgtggtaacagatgttccgccagaagtaactgttgttggaatacctgcaaaagttgttcgagttaaaggtaaaaaagatgtcgagcgcatcacaagccttgaagaaaaaagagaagcaagctatcattcatcacatttgtgaggagaaatgagaagtgaaaaagagaaaagtagcgatttatgagggacatttacttgcaactttaaaatcatttacagatgctgttatgtctatcattgcaacgattatggttttagaaattcctttaccaaaacttattggcaataatcagtatgattttcgtgaaacaagcagctcactcattattttctttgtgagttttctggttgttgtttcttattattttcaatttagtaagttttttggacgtataaagaaaattagtggttggcagatttttgcttatacaatttttctcatgcttgtctcactttttccctttatgacccaaattgataatggaattcatcccgcatacttcacaatcatctatgttttatatattattgtgacctcacggtttgcttctttgattatcaaatatacttaccgcctgaatgaaataataatcagtagacatcagtcacgaaaaccttgggatttgattgtgatgtctgctcttgctattgtgatttcgagtattggatatcctgcttatacggggattccattgctctatttaccaatacgttctcttatcacctctattgtttatgatgaagattaagaaggaaatagaatgaaaatatataatacttatagtcgacagctagaagattttcagccgattgaacctggaaaagtaaaaatgtatgtctgcggaccgaccgtttataattacatccatgtgggaaatgctcgttctgttgttgcttttgatttggttagaaaatatttggaatttcgaggatttgaagttcaatatatctctaatttcacagatgtcgatgataaaattatcaacggtgcaaaagctgcaaacatgactacgacagctttttctgaacgttatattgctgctttttatgaagatactgatgctttaaatgttaaaagagccagtcaaaatccgaaagcaacagaattcatcgaagcgatgattgagtttattcaagaacttgtggataaagaatttgcttatgtttctcaaggagacgtatatttccgtgtatctaaatctaaagattacgctaaattagcgaataaaaatcttgcagatttacttgcaggggcttctggacgtacggatgaagaaacaaaacttaaagaatcaccagccgattttgctctttggaaatccgcaaaagctgatgaagtttcttggcaagcgccctggggatctggccgtccaggctggcatattgaatgttcagtcatgtcaacttcactattaggcgaaacaattgacattcatggtggaggagcagatttagaatttccacaccatacaaatgaaattgcacaatctgaagcaaaaactggacaaaggtttgttaattattggatgcacaatggattcgtaaatgttgatggtgaaaaaatgtctaaatcactaggcaatttcacaactgttcatgaactccttcaagtagttaatccacaaattttacgtttctttttagcaactactcattatagaagaccagtcaattttactgatgatgcactgacagaagctgaaaataatatcaaaaaaattgaaaatgcttatcgtcatttggatgagcaagctgagtctaatttgtcagcacttacgactttcagaaatgattttgttgctgccatggatgaagatttcaatattgccaatggaatgactgttttttatgactttgtttcttgggttaataaaggaaacggtgggcctgaggtcaaagaattttttgaccaagttttagaaattttagggattaaatttaaatttgagcaaagtttggacagcgaaattgaagccatgattgaagcaagacaattggcacgagaagtccgtgattttgcgaagtcagatgaaattcgtgacgctttgaaagctcaagggattgttcttgaagatacaaaagacggggtacggtggcatcgtgaataagcaacaagcagaacttttgaatggtattgcattggcctatattggggatgcgatttatgaggtctttgtgcgtgagtacttattagataaaggcctgacaaagcccgccatgcttcaaaaaaatgcaacgaaatttgtgtcagctaaagcacaagcaaaaattatttctgcaatggatgaagttgattttttgactgaatatgaattgacttattttaaaagagggcgtaatgctcattctaaaacgacggccaaaaataccgatgttgttacttacagaatatcaacgggttttgaagctgttgttggaattctccatttaacgcaacaaaaagagcgacttcaagaattttgggatttttcccttaaaacaattgaagcagatctggtttaaagtttattaattacaaagatcaaagtattaagcaaattattttaaaaaaagaaaaaaatccgctagaataggtatgcaaagatacaaagaaaaaaatcagcggaaagaagaagagatgtatagagtagttacaatgtacggcaccgatgaaccatggtggttcttcgacggctggaaagaagatatagtttcagtagatgagtttgatgatttttataaagctttaaaatgttataaaaaagaatggtttgaaatggctgagaattttaaagaattcactagcaagtctggcttgcaaacagcattttggaaaaacggagatgaagaatggtgtgaagactgtgtaggttatttacagcgctatcacagcattgctttgttggaagactggcatgcgattccgctagagaaaaagcgctcaggttatagtaaaaaatctggagaactcccagaacgtttctgttcaatgaaaactgaaaattaaaaaatgagaaagtttactgactgagtaagctttcttttgttctgatagaataatcgtaagcatttcattggtaagaaacttgaaattatattataattattttataatataaatctaatgttaggaggcgctatgaagaaaccgttaattatattagatggatttttaatattacttatcgcagttcttggactggcattatttcataatgttcaggaacaatctaaagagcattcactatcgaattcaacagcaagcacacaaaattcgactgaaaataaaacagaaacaaataatacaggaatcaaaataaacaccaaagaaatcaaaaaagaaaattttatgacactatcaggtctttggaagaatagctcaattgctaagaaaactaaaactcttgttatttcaggtccttcggcaacttttgagggtcaacaatatgacttaactttggaaggcgtgagttctgaaaatgagctaccttatttgaagttgataggtgaaggaattaactcagggaagtttataggtatttatccacaagggagtgctattccagtaagattagctaatggtaaaattgattacgcaggtcaatatgatcctactgacaagaagaaagatcgtatcattctttttaatgattatatgtctgctcaagatatcattgagcaagttttataccgtgaattggaagaaatcttttaaaaacagtctaagatttaaaatgataagaaaatagtcttgaaaaaatgtttaaaatgagttaaaatatcattatcttagataagaactcgatggtcaaagctcgggaaaatatgacaagggacttttaaaagttactgacagaaaaatcaattgtgattattttctgtcagcaactgatgagaggattttttgacatatttttcacagctttggcttttttatttgcaaaatatttactgacagcttttaacaaggctaattaaggactataaaagctgtcagtaaaagaatgattaataactctgtcagtatttttgcaagaacttttatcaaaatataaagaaaggcgaatttaaaaaattcgtagtaaaaaatgaattttcaagaaaattatgatgttgttgtcattggaggaggacatgcaggggttgaagcttcactagcagctgcacggatgggctctaaaacattactcatgacgattaatcttaatatggttgcctttatgccatgtaatccatcaattggtggctcagctaaaggaattgttgtcagagaaattgatgcgctcggtggtgaaatgggtcgcaacattgataagacttatattcaaatgaagatgcttaataccggaaaaggtccagcagttcgagctcttcgtgctcaagccgataaagatgaatatgccgcttcaatgaagaatacagtttctgaccaagaaaatttgacactccgtcaaggaatggttgaagaacttattcttgatgaagaaaagaaaaaagtcatcggaatcaagacttcgacaggaactaaatatggtgctaaggcagtaattattactacaggaacagctttgcgtggtgaaattattattggagaacttaaatattcttcaggacccaataactctctttcatcaattggtctagcagataatttacgtgaaattggatttgaaattggtcgttttaaaaccggaactcctccacgcgttttggcaagttctattgattacgataaaacagaaattcaaccaggtgatgaagcgcctaatcattttagttttatgagctctgatgaaaattatctaaaagatcaaattccatgctggctcacttatactactgagaatagtcatactattttgcgtgataatttacaccgagcaccactcttttcaggaattgttaaaggagtagggccacgttactgtccttcaatagaagacaaaattactcgctttgctgacaaacctcgtcatcaactcttccttgaaccagaaggacggaatacagaagaagtctatatcggtggcctttcaacttcaatgcctgaagatgtccaatttgatttagttaaatcaattccaggacttgaaaatgctcaaatgatgcgtccgggttatgctatagaatacgatgtggtgatgcctcatcaactccgtccaacacttgaaacaaaattggtttctggactatttactgcgggacaaaccaacggaacctcaggctatgaagaagcagcagggcaaggcttagtagctggaataaatgcagcccttaaagttcaaggaaagcctgaatttatcttaaaacgtagtgaagcctatattggggtaatgattgatgatttggtaactaagggaacgctggaaccatatcgtcttttgacatcacgtgcagaataccgtttaattcttcgccatgataatgctgaccgccgtttgactgaaattggccgtcaagtgggccttgtttcagatgagcaatgggaacattaccaagcaaaaatggctcaatttgatcgtgaaatgaaacgattgaattcagaaaaactcaaacctttgcctgacacacaagaaaaattaggaaaattgggctttggaccaattaaagatgcgctgaccggtgcagaatttttaaaacgacctgaagttcactacaatgaagtcatcgattttatcggacaagcaccagaaaagattgatcgtaccgtcattgaattgattgaaactgaaattacttatgaaggttacatcaaaaaagcaatggaccaagtggacaaaatgcatcgcttggaagcgaaaagaattcctaaaaatatggattgggataagcttgactcaattgctactgaagcccgtcaaaaattcaaaaaaataaatccagaaacgctgggacaagcgagtcggatttcaggtgtaaatcctgctgacatcagtattctcatggtttaccttgaaggaaaataattaaaaatttaaattttactgacaaaaagttactgacagaaaattttggggagagtccttgtgttttggcactgaggaagcaacttaaaattttcgtcagtaactttttttcttgtggaatactttaaaagttgataaaataggcttaaacaaggaatgaggaaagagatgacagaaataaaaaatattatttttgattgggacaatacacttttcccttttaaagaaaaatattgggaattagctcaccgccaacttttttcagaacaattaggaccatttactgaccaagaactcaatcatttcatggagaaataccatgaatttgatgaattgctttggccacaagtccatcaaagaaaaatgacgattgaagagctaagagaagaaagattaagtttgactatcgaatattttgatttgaaagtcgatgaaaattatcttacaggctttttcaaaaaattcttgaatagattgtttgaattgatagagcctgatgaacaactcatccaaaatctaaaaaacctttccaaaaactacaaacttgccctattaagtaatgggggtcatgtggagcagagagaaaaattacgtcgttctcaagttgaaaaattattttcggtttacatctctggtgaaacaggctatctgaaaccagatgcgcgtgcctttaaaaatgtgctcactcaagaaaatttccaagcgtctgagaccttaatggttggagatcttctcgaacatgacatcaaacccgcccaagagttgggaatgaagacagcatatattggacctgaaaaagaaacgattgctgattatgaatttacaaacattcaagatttttttgattcatttatagaaaaaaacggtgattaaccgttttttattattggactagttttaaagagtcagcagttaaataaagtctgtcaataggcttgttagacaaccgataaattccatttttgttaaaagtaatctttttttcttcaaaagtttcgttaggactttcaaggtaaaaagtaaaatcaccaacaagattaccagtaataacaagagctatgttatttgaaccacgtaaaacctttaaccaactattagaatttaaaatatattggatgcccgcttcgtcatcaaaagatagaatatgtgaaaattgaatagagggacaagttgttttatgattttcgaccatttcctcaaaaatcgaaatttcatcatattcaatcagctggtcaagaacttcactgaccaattgcgcagttaacaaacggtcacttgcaggaataattgaatgttcattttcgttatttgaaccatcagtaatataaagctcatgcattaaacccatggcatacattcttttccgatgaattgaccagttttttgtttttttgatatcttcagtaagatgagttaaatctagtggagtcatagataatcctttctatttttaatttgatgctgatgacacttgaaaaagtcgtagagaattgtcatccatcacttgataggttttgagttgattgggagtttctgtagcactggtaataaaaattgtaatgagttgaatatctgacattttattctcctttcgataattttagtttattataatcattttatcattttattttcattttattgaatgatatggtgtttgaaattatagaaaaaatgctgaattgacaagattaaagccatattctaaaattgtattctataagtgtcaaaaaattagaattataatcagaattagagataaattttactataaataattaaaaaaattaggacttgacaagtctttaaataattgatagaataatagagttgaaaagcagaagcacccgcttctcgccttagaggttatagccctgggcaaacgaatggaattattcaaaaacgaatgttttcatgagcggggcgagattgtcgttccgcttttgtttttctttaaaaaagaagttgcctaaatcttagtcaactttcacatcatattagaaggagaacgaacatagctaaacaagacaatagaaaacctatgatgaacggtgcaatccgtgctcgtgaggttcgtctcattggcgctgagggtgaacaattaggtgtcacaccaacgtctgaggcgctaatgcaagctgaaaatcttaacatggacttggttttaatttcaaaccaagaaccacctgttgcaaaaatcatggattatacaaaattcatgtttgagcaaaagaaaaaacaaaaagaagcaaagaaaaaacaagctgttgtttctgtaaaagaagtccgtttgtcaccagtaattgaccaaaacgactttgatacaaagcttcgtcaagccatcaagtttcttgaaaaaggcgataaagttaaggtttcaatccgatttaaaggtcggatgattactcaccaagatgtggggcgtcaagtaatggacaagttcgcgcaagcaacaaaagaagttgctgttgttgaacaaagagccaaaatggatggtcgtcaaatgttcttgcaacttgcacctattaaaaaataggtcttaacaagacaaccatctgaaaggttaacctttcacctctctattcattgaaaacgaatgtttaaaatgaatagaggtgcagaataattttttctgccaactgatataaattaaggagaattacaatgccaaaacaaaaaactcaccgcgcatctgctaaacgtttcaaacgtacaggtaacggcggtcttaaacgcttccgtgcttacacttctcaccgtttccacggtaaaactgtaaaacaacgtcgtcaacttcgtaaatcttctatggtttctaaaggggacttcaaacgtatccgtcgcatggttgcgacaatgcgttaagcgaacattgttcgctgcattggagcaatcctcgcaggagcgtaagcgactaagagggacaatgaaataagtcatctaattttcttgctccagctcaataaaaaaataaatttgtcattatgacaaaattgaaatctactaagaattaaaggagaacacacatggcacgtgttaaaggtagcgttgcaactcgcaaacgccgtaaacgtattttaaagctcgctaaaggttactacggagctaaacataaactcttcaagactgctaaagagcaagtcatgaattcatactactacgcattccgcgatcgtcgtcaaaagaaacgcgacttccgtaaattgtggattgcacgtatcaacgcagctgcacgtatgaatggtctttcatacagcaaattgatgcacggtttgaaattagctgatatcgaagtaaaccgtaaaatgcttgctgacatcgcaatcgctgatgctgctgcatttactgcacttgctgaagaagcaaaaaaagctttggctaaataattatcttaaaaaatctgctggttttctagcagattttttatattttaagcagacgctctcttaattatgatattaggaaagtgtttttttattccgaatatactaaattgttgcaaaaattaataaaaaagaatataataccataagtccttgttttgaaataaaagtaatttgttttcaataaaagacatttagtataaataagaatacaggatggaggtaaatgtggaaagtgaaaatattttggaagcaaaacaagtgagtgttgcttttcggattgctggtaaatttcaaaaagcaatttatgatattgatttaaggcttagacgtggtgaagttttagccattgttggggaatccggttctgggaagtcaacttttgcaactgctgtcatggggttgcataattccaagcaaactcaaatcactggctctattttattggatggggaagaagtgattggtaaaacgggtgattccatggcaagtattcgaggaagtaaagttggaatgatttttcaaaatccactcactgcgcttaatccattaatgaaaattgggcagcaaatcaaggaaatgttggccgtgcgtgatgtttatccagaaaatcagtatgaaagtagaatctttcaacttttagaacaagtaggaattccaaacccctccagaaccacctacaagcaatgctgtgagtttaccaattgcatctggtgtataatgctgcccttttgacgaaacagccgagtgagtcataaaatagtccctaaagaaatcaactcccatgtcatggtggatatttaagattttagaataaaattcttcacgtccttttttatcaaaaacaagttcttgaattcgatttgtaaaattcatgtgttcatcaacattgagcatgtcatagaattgctgctcagtaattgtcatttatcccctccaatctctgcgagtgctgattcagtaaccgattttaaattctctactgaatacatatttaaactaccattcaattcacaatgattatcacagccataattacattcgtgaatatcatcatctataatttcggatatttctgtcagtgcctttttcgcagtgttaatctgttcttgaagttcgtctctttcagcacgtaatgaaaatatataattaacttcttggagttcaagttcttgcttacttagaaatttaggtgtatcactcattttcttcctccgcttcaagtgctgcattctcagctaatacaacatgaatattctttccagtcactttttcgatataatcaactgcaagtttatgggttttagctaggtccgcaagctttctgtctacaaggtttcccacaacaatatcttgagtgatatttgctgctgcgctcgcttcaatcaacgtttgaatacagctctctagttcttcttgtagtttttcaaccgaaagtttgtcagtgatagcataattgtcggagcattcgccacacaagctattgtcagttgcatatcttcctattgttcctttgccacaatttgggcaaatcatataataactcattctcacacctccccagtgctaccaaatccgcctgtgcgctttccatttgcgttgtcatcgtctgttgtaaggtatttgacaaataccccttgcattattctttgacctttagaaatggttacaggctcttttgagatgttcataaataagcctttaaattcttgcggatagtaatctgaatcgataattcctactgaattaatcaatgcaatgccacgcttaactggattacttgaacggtcgtataatttcaatacttcatcatcaccaagttgaacagctagcccagtgcttaccattttaatttcatcaggttgaatcgtaactgtttcacttgctgaaatgtcataccctgcgctatgttttgtcgctctttctggaatagtcgcatttccgtctagttttttaaattctcttgtcattctccgtcctccacaggcacaagctcatagctcccagtttgcatgctgtcgatttcttgctgggtgaatgataatttccacgctgtgccaatagaatgcgtaagtgggtcttctccagtccaaaaaaagtatctatccttgtctttaaaccgattatcctttgcaaggaattgtccggttaactcatctctcaaatagaacagctgcggtttttcgactgtgtagccgtctagccatgcacgcatataatcttcttggtgttcagaaatccaaaatacaatatcttgtagtgtttcttctgtaaagccagtttcttcgtatgtttctggattttttagtggtttaaggcctttagtttttaatatttctatccactcagcaacaaaacttggcacgaatggtaagtcttgctgttgtagttgggattttaaattagcgatttcttcgtctgcttgtgctattaacgttttaacatgaacagccgcataatatttagtatcaccaataggatgttcaatattttttattggtaatatttctagtttttcttcaaacttagtcatttttcgtgtcctcacttttttcatcttcacaagtgaagcaaatataatgcccttcatctaaaactttatcaacgattgaactttcagttgtaaatatgaaattctctttgcatttttcgcatgttacatttatttttttaatcatttttcgtgtcctccaaattcatcatccatccatattttcatttctgctgcgtggttaacgtcaccagtagtttcaacataccagttaatcaactcccaacaatttgcttttgcgtactcttgagcaactttctttgtgtataataaatctccgtcttttaagtcacaaaactggttgaggtttgcctgtactgtgctccaagctggttctttaaccaaaacaacttctccgactgcttcaatctcgcttagtttcatctcatccctcacttcacaactctgtcaaagagttcacatgcatggtatcttccatttatttttacaattctaaaatcatcacgcttaactgattttttagtgaactggtctttttcaaccgttatgtatttgtcagtgacttcgataacttttaagaattttgtgtcgcggaagcatattttatctccatgccttatttcatttttgctgaacatattactacctcatattttagcttctaagcacttttgtctagttcgtgataaattatccatgaaacggtttaagcgctcaatgtaaccgtaattttcatgaattaaagctattctacttctgtaacttcaatttctatccgtggtcgcaagatataacgcttcttagcgtagatatcactgatttggttgtcatctggccatgcatgtttgtttagtgcatctagtacagatttttgcaaattatcaatatctggctttttgaccactggaattgtttctgcttcaagcgctgcttgattcttttttacttttgataatgctattggtggctcaagatagaagcccaatttaacaaatagtggttttcctgaaacttcctgttttaatttcagcaatttccatttgaataagagttgagctttccaagccatgtattccttaggcatataagcttttacaaatccgcctttactgctaaatctaggtcttgggcttgccattggctccattgctatctcaaacttcatattttcccttaaacgatttttattttttcgtactcatcctcaacacgttttccgtgttccatgtgccaaggtaagatacgctttgatacttctgcgacactcaaactagttatcgatgaaataaacatccatgggcttatcagtaatccattttccttagcccatttaagccatctgtcgtaatggtctggagtgattccctcacagactctactagcaagttcaagataatactttctgaggtcatccattacgcaaccccatttctccaactaatttgtacatttcgttttgtttcattccagttgtatcgataccagctttaatgagcttatactcatctccccattcaggaagccccttagttgatttagtgggtttttgctgctgaaatttattctgattgttttgagatttattttgaaagctcacttcctcagcttttgcttgctcaagagtttttattcctgaacgattccaagattttagaatgccttgtgcataggcgtactcacgttgtctttttatcgctcgtttgacagcttcaatgattaactcaagaccataatcttctaaatcagctttcaagtcatcataaagaattggttttactattccaaagtttgcttgataaagttcaattaagttttgaaaatcagaatttgttgaagtagctgtgcttgcttctgcttctttatctatctctttctctatctctatctctgactctatgtgacccacctgtgacaatgtcacgtttttttgtgaatcggtcacatcattaaattgtaaaagttccctttcacgctctcgctgtctacgtttgcgctctgctgatgctgtttcagaaccgaccaatgattttgttttagtaatttcaaattcatcaaaaccacaatcaatcattaaacctttattaattaaaaatgctactaaaaaactgaccgctttttcatcttcttcgatttctaaagcccattcttgagaataatcgtcaccgatattttcgtaatatatttttccatcattttctaagcttttcaaaatgagttttaaatatataatcgtgtaagtatcaccgccaggaagtcttctaagatatttgatttctttctgttcaaaaaaactttgttccattttgaaccagtaatatcttttatctgccacatcctctcctttctgttgtaattatttcaatcagcctctttcgtaaaatatatcagcagctgtatcgaaatcacagccttcttcttccataattttataaatttcagatttataataaaccatacctacctcctaccgcaaaagcgggagcagttgaaagcttgctcaggctgactaaatactaaaccaccgcccaaggtggctttgctaaagttgaattatttctaattctactgctcaggattagtgaggactgcagtttgctcatagattagatttttttaaattctgttgctttaaaatctccgaaaccattatcaatcatgacttgcttccattgatttttttcttcaatacttgagaaataaatttcaattactgccatatatttttcgttaggaagattttcaggctcttcattgactatagttccagatatttcaatttgtgattgagcagcttttttatcaaattcttctttaaaatgttcaactacttctggttgagataatgctcttgcgttttcttcaccaacatgagaaggtagagcgttgaacgattcttcaagctttcttgtttcatattcttgcttctgtttttcaagttcagcttgtctttgtctttctgcttcttttcgtttttcctcatcttctttgcgctgtttttcaaaaagaacgtcctcagaaattgctgacattacttcactgacagattttccactatcaagcatccgaatatatggtgtatcactgacattatttccaaaacaaaagtttgaaatcgtatctttatttgctttgtattcagcaatcttttgcttttcaccatcaatgacataagtaatagaatcaataagctgttttttaggtttaatatcattaaagtttgatgcttttgcccaatcatcaacaaagttttcaaagattcgtgaatctacttctgtgtctgttgtcagttcaaccaataattcatgaacaactttttttctctccgctttttgttcagcttcgatatctttaattccagaatcaatttgagaaatagcctgatctaatactgctacagcctttttgaaccaaacttcaaactccgttaaaggttggttatactcctttttgatgcgaattttttcatcattcaaggattttgaaagtttccgtagctctgcacgagtttttttatcatctgccattgattcaacagttacaagccggttagagtttgcttgagcaattgaattaatttgctcttcaaacttttcacggtctaagacttcaatttttgctggttcaaacgttacattaaattcattcattttagaaatcctccgctgttatttcatcaataacttcgccagtttctttaacaacttctttttgaggttgagctttttctttcaactcttcaatcttctttgctgcgtagtcttccttatcaaaagattcgatttgtgcacggtcaggttcttttacaccattcacttcacgaggttctttttctggctcaggaaactcttcttcgccataagttcctgaaaactcggcaggaaatgccattctcaacgcttgactttcggctacttttccaagcattgtacatggtttattagtccacatcttattagggtgtccatctttcatttgaacgtattcatcataagaaactgcaacatatactggaatttctgtattttttaaatgaactctagcccatgcaccaactaattcttgatcatgagttttgaatgttccttcgttatgttcaataaccccatctttatttagaacaattacaccaacttcgactcctgcaaagtttggattttggaaagctcgttttctataaaaatcacgagatacaacgatttgagctggttgattaccatatttgatgaaataaacttctttcataaatggattcatgttgttttgtttgcaaagattaataagtaaaattaattcatcatcacttgcttgaccgccaccttttaaataatctttaattgtggtcatattcaatttatctacactaaagattcctaattcatttgccatttttaaattctccatttcatatttttgttgaaacgtgatataatctaggtataaaattttgtagacgtatcacgtcttagtccgcattcctagtgcgggcttttttgttgtttgttcatactaatatccccagtcagacaagcacgaattgagcatagcagctttttctcgttctgttcgtgatctgcggataatgtacattgttccgtcttttcttcgataagtagattcaataacttctccaactacttctcttttttctaagtcataatgtttatatccaatgactgttggaactgtcaggacttctcgcccattcataatttgtgtgtgcattatttgcctttctttttaaattgatttaagtcaatatcaagtacttcagctatcttaatgactatctcaaagctaggtttcttagattgaccaagtttgatagcagataaagactgcgtactaactcctgataatttggaaagtctgtatattgacatatttttttctttaagttttccttcaatgattaaccacaacatcttgtgcctcctttaaaatgtaaatactttttgacacaatatctagtatcatcagtttgtgtaacaaaatgtattttgatataatgtagtagaatgaaataccgcggctagctgtttttattcataatatttgagaaaggagattacgatttggtaaattcaatcaaacctggcacggataatcaaaaacctggccattatgtcgaagtaggtcctcgtggtggtagtgtaccaaagggacatactgcaacaatcggaaaaggcgaccgccttcctccaacatctactaaaggcaacggatggaagaaagtttaatattttttagtgtttgcgtacagttcattaatgactgtgcgtttttttgataggcaaatgcaccatttgaaaaaattgatttgaatccaagcttcagcataatctttaccatctcttgcgtagtgagttatataatgtttaatcataaatctctcttttctagcggagcaccgcatttaatttcttagcaatgagcttgattgctcgaatgttttgtgtgattaagtcgtgaaataggtcaaacagaatttcacccgtttctgggttgactatgtatgtgtaggtcatactctaccctcttcccggtttatatctgccaaaatcatgtaaagcggattatatccgttaaaacctttaccacttttcttaatgtcagcatattcaacgacagttccatctttccatttcccatagattttaggtctttttgtcatgtgctttcctttctaagcttcaaagtcaaagctggtttgtgagttcaatccacgaatttcaagcgttgtattgaaagatggttgccacatatcaagatattctgttgcttcgtcataacggcttaatggaatatcgctatatttcacaacatcgaagcgattgttcaaatctttataaaactctctgaataccttagctcctaatttcttatgagcatttgaatatttaccaccagtaaacatataaactttgcttgctactttcttttgcaaaactttagctttatttgatggaagtccgaatcggtcagtcaaatcaagaactgaattttcgatttgttcgacttttttattcaagttcacgtttccttgagcgagtaatgcgatttgttgttcgggagtttgcggtaaaagctgttgtttgagttctttttcaacttcaatgaaatattgacgggcttgtttccctttttcgttacgctgaatcatggaaatttcttttgccatgtcaatttttaacgcatgatcaacacttggacgaccgcctagttttgaacttttttgttcaaaacctataaaatcaacgttttcagtaaatccatattctgccattctttcaaaccaaatatgataaggagttttgacttctaaaaattcatgtagttcacgaccgcttactacttggtcgttgttttcgttttgtgtgattgtaattaattgattcattgttttgcctttctaactagcttgcatgtttatttaataaaggcacagaaattctgtgttcttttcctaaaaaaatatcatcataagtaactttatagatttccataaattttttcgtataaaaatcttttaagtttgatgaatctttttcccaattgttaatagtgtttggagatactccaatcatctcagcgacttctttttgggtaagtttagctcgctctcggtgagttcttagtgtctctgccatactggctcctttctgtgtgtgtatttgaatcctccaagtgctataatgattgagtaaatatttctcagatatttacttaatcattatggaaaggaggtatgtgtgaattatgaattgtaaagtcaatccagaactttttgcccaatcggtagtttcttcttcgagtgaaactgatgtttccgctttatttaatttgtacattgaggcgatgtcggtcgctcaaaaacacaatgaattattaccgaaagaaaagggtaatttaaaaagtttcaaataagcgctctagtatttaactagtgatgtataaagctcagcgatggctgcgaccattgctgggttttctttagtctttgaatctattaaagcagatataataaaatatgcaactgcttgatttacagtaatatcttccattccattctcctttctgtgtgtgtatttttgttatctccttggtataatagctatgagcagatatttgcggtatttgcttagtactatggaaaggagatgaattctataatgaatgaaaatgatattaaagttattcttgacaaacatcatgttgaggattcagagaacttagctaatgccctatcagagatattacctaaatttatcaaggcatcaattagtacaattgatgaagaaattggtaaaaaatcagctatgaataacttgttttgattttcaaaaagtcacttaccaatctggtagttggctttttttatttcattccttactatgttaaccgttgcatcagcgattgaatgtacttctgtcagaaaaggacttgttgtaactttaatcacgtcattgtttcttcttttcttttgccgttctcttgaatactttggaatataagattttattttcgccatacagattcctttctgcccctctagggctttttatttgtcagttcaactgctgctttataagcatttgaccattcaaataactgaggtaataaagagtctttgataaattgaatagaaaaatcttttaacagttgttttttgtaccactcaacactatgctgctgaatagtttctccgtaatgcgtaactacttgttccattagaacctccatttgcctgtaagggctttttatttgccaaacttgctacttacgtcgcggtggatacgtcgtgtaccgtcatttgagcctgttccgtctgccgtactgaatgctccatgattgttcgcttgtttgactttatgaaattattgtaacacagaatttctgtgtagtcaacaataaactttataaatcacaaaaaaattgtgttttggttatttatttgatattatatattcatggaagaagaagaacttgaaagacgtaaaattgttgcagagaatatcagaaaacttataaaagaaaaaggtataactcagaaacaactggcaaaagagattggaatgtctcaaaatattattactgaatatgtaaaactgcgttcttttcctccaggtggtgttttacaaaaaatagcagattacttcggagtgaaaaagtctgatatagacacaacttggaaaaaagatgtaaattcagataatacacctattatagaaaaaaccatcgatacaatgaaacagctcgaagagccaagacaaaaagtagttcttaacactgcaaccaatcaattagacgagcaaaaccaagaaaagaaaaaagaatctaaagtgattccgattaataaaatacctgatgatttaccaccatatataagtagaaagattttagaaaacttcactatgcctacaaacactatggaatatgaacctgatgaagacatggtagatgttcctattcttggtaggatagcggccggacttcctcttgatgcagtagaaaacttcgacggtacaagaccagtacctgcgcacttcttatcatctgcccgtgattattattggttaatggttgatggtcatagcatggagccaaagattccgtttggatcttatgtcttaattgaagctgttcctgatgtgactgacggtactattggagctgttcttttccaagatgattgtcaggcaacattaaaaaaagtttatcacgaaatagattgcttgagacttgtgtcaatcaacaaagaatttaaagaccaatttgctacacaagacaatccagcagctgtaattgggcaagctgtcaaagtagaaattgatttataattaaatatacgagcaatatcttgaacctcgttaaaaaggtaagtaaataacgtgcgccatcacaaaactggcaaggagaaattatgggatttaaggaactactcaaagcaaaatcactcagagaatattcagaagcgaaaaaggaccctgagaaaatgtctgaaattgctggaagaagtaaaaaagatgtagtaaaaaatattagtggaaataaatgcgcttcgtgcggaaataaattaagcttcactaaccgttttatattaaaagatggttcttatatttgtgctagctgcattaataaagctggtgtaagtatggggggatatgatgttgaatatttcaaaaaaaatgtaactattgatacattatttgatgatcactcagtacaaaaatataaacctactactcacggaaacaacactaatatatcgaaacctaataccaatgcaattaaatgtccaaaatgcaacagcactaatgtccagttcatgcaacaagacaaaaaagccttctcaattgggaaagctgttggtggtacaatattaactggtggagttggggctcttgcagggtttgctggaaaaaaaggtaaaaagcaatggttctgccaaaattgcaatagtatttttgaaacaaaataaacaaaaaatccgtccaagtttggcgactggggacggattaaaatctatgggatagtaaacctccaatttggagctttttactatactcattttatcaaaaacgaggaataaaaacaatgaaaaaagtagcaatatattgccgagttagcacgcttaaccaagcagaagatggatattcaataggcgaacaacaagataaactgaataaatattgcgacattatgggttgggaagtaatcgaaacatacacagacgctggattttcaggaagcaatatagagcgcccagcaatgaagcaattattaaaagacgctgccaatcataggtttaatactattttggtctataaattagataggctgtctcgaagtaccagcgataacttatatttaattaaagaagttttcaaaaaaaataatattgagttcgtgtccttaaacgagaaaatagacacctccgacgcaatgggggagttcttcttcactcttcttgctgcagtggctgaaatggagcgaaaaacgattacagagcgtatggtcctaggaaggcttggaagagcgaaagctggaaagacaatgtcttatcaattacctccatttggttacataagaaataaagaattggatattttagaagttgttcctcatgaagcgaaaataattaaatatatctactcaaaatatatttcaggagatagtataactaaaatatgccatgatttaaatgataaaggacatatcggtaaaaatgtcagatggtctcacagttcagtaaagaacgcattaacaaataccgtctatattgcaaaaggaaagttcaaaggagaaatgtatgagcaagagcatgaaaaaatcattgatgagaatactttttggctagtacaagatgaaatcaacaaacgtcaaataagagaatctcagcgaacaaataaccctcgacctttccaagccaagtacatgctttctggtttgatgaaatgtggctattgtggagggcatataaggactgtaacgggaaataaacggatagatggctcaaagcctgttagatacgtttgcgaccgtagaagcgattatagaaagctcatggagcctgacgaaattaaatgtaagtctggattttatcatagattagatttagaacaatatgttatcaattatcttgccgatttacctaacgacgatagcgaactaaaagaagctttatcaatgggtcaaacaagtgaatttgaccctactctgcttttaacagaaatagaatcaattaataaaaaaatagataaagaaaactatttatttagaaacgattatattgatgaggttgagttacaacgaaatgttaaaaatcttgtcgatacaaaaaaacttttagaaaatcagttacaagaaaacaatggagataaaataaatgagcaaaagcgtaaacgaatactcgatatgttaaacactgggaatatacgagaaatgaattatgagcaacaaaaaaagatagtgaaatcctgcatcagtaagatacttcttactagtgaggaaatcactatcgaattcaatttttaattatattatttaaggtttttagtcaaaacttttttaatatcttctgttacttggctaatttcttgttcaccttcaatgtttttaacaagtccaagttcagtatagtgttcaataattggagctgattctttaatattgacatccaaacgatttttaactgtttctggaacatcatccgcacgttgataaaggtcatgactaccacaaacgtcacaaacaccttcaactttagttggattgaagattttatgataagttgcaccacagttacggcagatgtaacgaccacttaaacggtcaaccaaaatatctgggttaacaacgatatttacaacggcatcaagtttaattccaagttcttcaagcattgtatcaagtgcatgagcttggtcaatcgtacgtgggtatccatcaagcaagaagcctgaagctttgatatcatcttgtgctaaacgttctttaacaattccgttcgttacttcatcaggtacgagttcacctttatcgatgaaagatttagcaagtttacccatttcagtttcgtttttcattgcggcacggaacatgtcacctgttgaaatgtgatttactccataatttttaacgatgaactcagcttgagttcctttaccagctcctggaagtcccatgattaataaattcattttgttttctcctgattttaatttataaattactgacagaactgtcagtaaattgcagatgttctctgtgattttacctacactattttagcgtatttttgctaaaaaataaagaaaaaccttgtctaatgacaagattttattttgtttcaagtggattatccataaatcctgcatatttacgtttgagtaaatatccttcaagttgtttcactgcttgtatagcaacttgaatcaagattaagagtgatgttcctccaagagcgacaatttttggaagtccccaaacgttttgggcggcaattggaatgattgaaatcaaaccaaggaagagcgcacctaccgttgcaagacgcattaagagacgtgatacatacttttcggttcctttacccggacgaacagatggaatgtaagaaccttgtttttgaaggttttcagccatcttttcaggattgacctgaacgaatgagtagaagaatgtaaagagcacaatcaataatgcgtagaagagcattcctgtccaagtcgtatatgacaaggcatcttgtaaagttgacaaccaacctacattacttccttgcgaacgttgcaagaattgcaaaatcgtagctggagcagttgtaattgaaccagcaaagataactgggataaccccagctggattgacacgaagtggcaaataagaacttgttggtgcaccttgagtcaatttagtatattgaataggtactttacgttctgcttgttgaacaaaagttgttacataaataatgataattgctgacaatactagaccaatgacaaataaccaagacattggaatttctgaaggtcgaacgtttaagaatttttcatcataaacagatttgaccgccgatgggatactagatacaatcccagcaaagataattactgaaacacctgaaccaaatcctttttcattaatttgttcacccatccaagtgacaaccattgaaccagtggtcaaaattgcaccaatcatcaaatagctttgccaatttggattttgcacaatatttaacgagctcatggcttggaaaccagcagtaatcccgatagattgtgccatagcaagcactaaggtaatgtaacgtgtcgcttgattcagtttacgacgtccaatttccccttgttttgaccactcaacaaattttggtaaaatgtccatttgcaacaattgaacaatgattgaagcagtaatataaggcgaaacccccattgcaaaaagtgagtagttttgcatggcattaccagaaaccaagttcatcatgttcaagaaaggaagattacttacttctgtcaagttttgaacgttgacgccaggtaccgtaatatgagcacctaagcggaaaacaaaaaggatgaaaatcgtaaagagaattcttgctcggacgtccttgaccttaaaggcttccttaagcgtcttaaaaaacataaaatctccttaaagcgttttaattgtaaatagacaataagcggttgaaaattcaaccgccaattgtagtgtaaaaattaagcttcttctacagaaccaccagcagcttcgattgcagctttagcagcagcagatactttagcaactttaactgtaagttttttagctgtcaattcaccgttagcaagaactttaacacctgatttaacgtccttgatgattttagcagctacaagagtttcagctgaaacagttgctccatcttcaagacggttcaaagtttcaaggttgacaatagcgtattctttacggttaacattcaagaaaccacgttttggcatgcgacggaacaattctgtttgtccaccttcaaaaccaggacgtactccaccacctgaacgagatttttgacctttttgtccacgtccagatgttttaccgttacctgatgatgtaccacgacctacgcgattacgtactttacgactgccttcagcagctttcaatgaatgaagttccatttttttctccttattttgtaccttgctgtcgcctattttccatgtaaggaacgtgaaaaacaaactcgccgatacgttaatatatttatttgcctgatatcagacttctattattttactatttttcgattggaattacaagccatttcgtcgtttgcaaatatattttattattctaaaaaatagcaaataatctttttttaagtactctagatttctgtcagtaaaaaaacaatcctgtcagtaaagacagaattgttatttttttaatattaattatgcttcttcaacttttaccaagtgagaaatagagtttaccataccaagaatagcaggtgaaccttcttttactactgagctgttgagtttaccaagaccgagtgctttaacagttttgcgttgagcagggatacggccgattggtgagtttaccaatgtaattttaatttgagccattttttcctccttaggcgaaatctgatacagatttaccgcgtaatgcagcaacttcttcagcacgtttcaattgattcaatccatcaacagttgcacgaacaacgttgattggtgtgtttgaaccaagtgattttgatgttacgtcagcaacaccagcgagttcgaggacggcacgaacggcaccacctgcggcaactccagcaccttctacagctggtttaaggaggattttaccaccaccgaagacaccaagtgcttcgtgaggaagtgtagtacctaccataggaactgtaataaggtttttcttagctgcttcgattgctttacggatagcttcaggaacttcttgagctttaccagtaccgaaacctacgcgaccgttacggtcaccaacaacaacaagtgctgcaaagcgaagacgacgtccacctttaacaactttagtaacgcggttaattgaaactacgcgttcttcgaattcgctttgttcgcgatcatttcttctgttttctgccatgtttaattacccctttccttagaatttcaatccagcttcacgagctgctgtagcgagtgctgcaacacgtccgtgatagaggtaaccaccgcggtcgaagacaacttcttcaacgcctttagcttttgcagcttcagcaacgagtttaccaacttctgcggcttgttcagttttagtaccagtcaatttaagtgatgaagctgatacaagtgttgtaccagttacgtcatcaatgacttgtgcataaatgtttgtgtttgaacggaaaacgttcaaacgtggagtttcagatgttcctgaaattttaccgcgtacacgtgtgtgacgtttttggcggagtttgtttttatctggtttagaaatcacaattctacctctatattattttaaatttcgatagtttttgccatcgattttcttactgacagaattactagaatgctgtcagcaagcggggagtttttgtctgtctaacaaagttagcattgacaaaatactggcaatttgacaagtcaaaccaccaattacggataacattttttgctaaataaatgttcaagtgaacattattttgacaaaaattatttaccagttttaccttctttacgacgaacgtattcaccaacgtaacggatccctttacctttataaggttctggagaacgacggctacggatgtaagctgctgtttgaccaacggcttctttgctgataccttcaacaacgatagaagttggagttgcaacaacaaatttgatgttttctggtgcttcaacttcgtcttggtgagatttaccaactgacaatacaagtttagttccttgtaattgtgcacggtacccaaccccgatcatttcaagtgctttagagaaaccagttgaaacaccttctaccatgttagcaagaagggcacgagtagttccgtggagcattttcatttctttagtgtcgtttggacgttttacagtgatttcgttttcagcgatatcaagtgtgatgttttcgttgaatgaacgaacgagttcacctttaggtcctttgacagtgacagttgcaccgtttacttctacagatacgcctgcagggataacgatgactttgttaccaatacgtgacatttttttctcctgttaaattatcagatttaattcaatctgttttcacgggttttaaatcaaaatttgatttaaaagaacttttattttactgacaggcataaaaatatttctgtcagtaattttgacttacgaaaaattcgcttgtcggtttaatatcatcaaaagtcgacattaaacatttagatcaactccatcaatgaagtctctccgaactaattaccagatgtaggcaattacttcaccaccaacatttgtttcacgagcaactttatcagttactacaccagtagatgttgagatgattgctgtaccaagtccgttaagaactttaggaacatcatcagatttcacgtaaacacgaagacctggttttgaaatacgtttcaagttagtgataactttttcaccgtttttaccgtatttaaggaaaacgcggattacgccttgtttgttatcttcaacgtattcaacgtctttcacgtaaccttcagctttgaggatttcagcgatttgacgtttgatttttgatgcaggtgcttcaacaacatcgaatttacgcatgttaccattacgaatacgagtcaagaaatctgcgattgggtcagtcattaccatagtgtaatttctccttatttgtagtttgggcttgttcaaatcccactttcaaattaatgaggtctttttcataaaaagaccgaacttaattagtatagcagaagttccgcaccatgtcaacacttttctttacaatgttttcgggtgtgtcatagtttttttagaataaaaattactgacagaattgccagtaatttgttataacttatgagctcaaagtgtggtatcattacttactttgtaaaaaaatgctgttggcatagtatcaaatatttctattccctcttcatccgtagttattataaatctgtcttttcctgaatctgtcttatccacattcgaggaatttggaaatattggcgaattgtgggcagcggcaaacataaagcccatatgccttttatcattcaacgcatcagcaataattattccatccttagccatcggatttgatattattctctcatattctggactaaaaatgatattgccattattcaaaataattttagtagacccgtcagcagtctgccaagttccattcaaggaagaataattccctgatagaatttgtggaacatctccaaatccttcctgagtggaagaacttgaacttgagtttgtacttgaagaatttgaactactactactttgactacttttattattaatactcgaagagaagctgctttgttcagactttttactttctttactgccacaggccgttaaaacagttaaagttcctaaagtaattaggctaattcccacaaactttttaatattagctgatgttttttccataaattcctcccgtttcctcaccattatagcaaatctatacctttaatccacaataatagactagcttttaataatttatctaagatacaaaaaaaattactgacagaaattctgtcagtaatttttattcgttacacgataattaacaaattaccatgaagcttttttaacgcctggcaattgacctttgtaagccaattcgcgaagacagatacggcaaagtttaaatttgcggtaaactgaatgtggacgtccgcaacgttcgcaacgagtataagcttgtgttgagaattttgcagggcgttggtttttaacaaccatagatttcttagccatttatgtattctccctatcttatttagcgaacggcatgccgagtttagcaagcaattcacgtgattcttcgtcagtgttagcagttgttacgataacaatatccataccacgaactttatcaacatcatcatagttgatttctgggaaaatcaattgttctttcacaccaagtgtgtagttaccgcgaccgtcaaacgctttgtttgaaacaccgtggaagtcacgtacacgtgggagtgaaacagtaaccaatttgtccaagaattcgaacatacgttcgccacgaagagttactttcgcaccgattggcataccttcacgaagacggaaagcagcaactgattttttagctttagtaatcaatggtttttgaccagagatcaaagccaattcagcaacagctttatcaaggtttttagagttgtttacagcatctccaacacccatgttgataacgattttatcaacttttggtacagccatgattgaagtgtaattgaattgttcagtcaacgctggtactacttcgttagtatatttttctttcaaacgattagtcatattatttctcctttccgccttagtctaaaatttcgccagattttttgttgaaacgaacttttttatcgtcaacaactttgtaacctacacgaccagcaacaccatttttgtcgagcacttgtacgttagaaacgtggataggagcttcgatttcaagaatagcaccacttgggttttctgagtttggtttttggtgtttcttcatgatagcaacaccttcaacgacaactttatttacttttggcaaagctttgattactttaccagtagtaccgcggtctttacctgcgataactttaactgtatcaccagtttttacaaacatgtttaattcctttcttacgcccgatgggcaccctaatattttgttactaggggactattctgttaataataacagtaaaatatgattctgtcaaaaaatttttccgacaaaaccatatctctataatgcttgattagagtacttctggagcaagtgaaacgatcttcatgtagccaccttcgcggagttcgcgggcaactgggccaaagatacgtgttccgcgaggagttttatcgtcacggatgagcactgctgcattttcatcaaatttgatgtatgaaccgtcaggacgtttcgcaccagatttagtacgaacgatgactgctttcacaacttcaccttttttaactgctccaccaggggcagctgatttaactgtagctacaacgatatcaccgataccagcgaacttacgtgatgaaccaccgagaacacggatagtcaaaagttctttagcacctgagttatctgcaactttcaaacgagattctgtttgaatcatgctatattcctcctagttttgcttagataataactgcttcttcaacgatttctacaagacggaaatgtttgtctttagacaaaggacgagtttccatgatacgaacgatgtcgccagtttttgcagagttgttttcgtcgtgagctttatattttttagaatagttaatgcgtttaccatagacagggtggttacgcttagtttctacgacaactgtgatagttttatccattttgtctgaaaccacgcggccttgataaactttacgttgtttgcgttccatttatagtttctcctgacctattatttgttcaattcagcttgcacagtttttacacgtgcaatagttttcttgacttcatcaagcttagctgtgttttcgagacgaccagcagcagcttggaaacgaagatcaaacaattctttcttcaattcagcttcacgagttgtcaattcttcaactgacaaagcgcgcaaatctttaagaagtgatttagtttcgctcaatttcattacgcttcacctcgtttcacaaatttagttttaacaggaagtttgtgtgaagcaagacgcaacgcttcgcgtgcagtcgcttcatcaacgccgcccaattcaaacatgacaacgccacgtttaactggagcaacccaaccttcaggagcacctttccctgaacccatacgcacaccaatagctttggctgtgtatgatttgtgagggaaaattttaatccaaacttgaccgttacgtttcatgtaacgagtcatagcaatacgagctgcttcgatttggcggttagtaatccagtgagatgtagtcgcttgaagaccatattcaccgaaagaaatagtatcgccacctttagcataaccacgcattttaccgcggaattcacgacggtgttttacacgttttggtactaacatggattatttttctcctttcacagattttttagtagggagaacttcaccacggtagatccaaactttaacgccgagtttaccataagttgtgtctgcttcttcccaagcgtagtcgatgtccgcacggagtgtgtggagtggaactgtaccttctgaatatccttcagcacgggcaatatcagcaccattcaaacgaccagaaacttgagttttgatcccttttgcaccagcgcgcatagcacgttggattgcttgtttttgagcacgacggaaagcaatacgtgcttcaagttgtttagcaattccttcaccaacaagatgagcgtccaaatcaggttttttgatttcaacgatgttgatgtgaacttgtttaccagtaagtttgttgagttctgcacggagtgcatcaacgttagctcctgatttaccgataaccatacctggtttagcagtgtgcaaagttacgataactttgttaattgcacgttcagtttcaatcaatgatactgaagcatcagcaagtttagtttggataagttgacgaattgccaagtcttcgtgaaggtaatccgcatattctttttcagcataccatttggcatcccaatcgcgaataacgccaacacgcattcctattggatgtactttttgacccacgtttttacctccttattctttctcagctacaactacagtgatgtgagctgtgcgtttgttaattggtgaagctgaacctttagcacgtggacggaaacgtttcattgttggaccttcattaataaatgtttcgcttactaccaagttagctttttcaagaccaaagttattttctgcattagcgatagcactattaagtacgttttcaacttctacagcagctttagtcggtgtaaatttcaagattgcaattgcatctgcaacacgtttcccgcggataagatcgataacaagacgagtcttacgaggtgaaacgcgaactgtttttgcagttgctttagctgaagtaatttctgccatttttttctcctcctattagcgacgtgttttcttgtcgtcagcagcgtgaccacgataagtacgagttggtgcgaattcaccaagtttgtgtccaaccatatcttcttgaacgtaaactggtacgtgtttgcgaccatcgtaaacagcaattgtaagtcctacaaagttcggaaagattgtagaacggcgtgaccaagttttgatcacagattttctttcggcgttgacttgagcttcaacttttttcatcaaatgctcatcgacgaaaggtccttttttaagactacgacccattttgcgagtttctcctttaaatatttgtaccactaccgctactaaggcggagttggcggaatttatagatgcactttcgacatctcattaaatttgacaataagttttatcaaatttaacaagacgccgagaaggctcttgtgaaaataaagcgacttattagtcgttgatacgacgaacgataagtttgcttgattttgctttcttgttgcgagtcttgagaccaagagctggtttaccccatggagtcattggagacttgcgaccaactggttgacgaccttcaccaccaccgtgtgggtgatcgttagggttcattacagaaccacgtactgttgggcggatacccatgtgacgtgtacgtcctgctttaccaaggttgattaagctttgttgttcattacctacaacaccgattgtagcacggcaagttgaaaggatcatacgaacttcgcctgattgaagacgaacgagtgtatatttaccttctgaaccgagtacttgagctgaagcaccagctgaacgaaccaattgtccgcctttaccaggtttcaattcaatgttgtggatcaatgtaccaactggaatgttagcaagtggcaatgcattaccaactttgatgtcggcttcagggccagatacaactgtcattccaacttcaaggcctttaggagccaagatgtatgatttaacaccgttagagtaaacgatcaatgcgatgtttgcagtacggtttggatcgtattcaattgtagcaactttagcaacaacgttgtcagttgtacgtttgaagtcgattacacgatatttacgtttgtgaccaccaccgtggtgacgaactgtgatacgaccagtgttattacgaccagctgttttgctcatgcttacaagcaagctcttttcaggagtacttgtagtgatttcagcgaagtcgctaccagtcatgttacggcgaccgtttgtggtaggtttgtaaactttaattcccacgattttcctcctctattattctgcgtcttcgccgaagatttcgattgttttagaatcttcagtcaaagtaacgatagcttttttgtagcctgatttagtaccagtgtatttaccaactcgtttagattttggtttaacgctgatagtatttactgaggcaacttttacaccaaagacagcttcaacagcttgtttgatgagaagtttatgcgcacgtgaatctacttcgaaagtatatttcttttgatccattgcagccatagaagcttcagtaatgataggtttacggatgatatcataaagtgacattatgcaagaacctcctcaatttgtgtcaatgctgattgaaccacaaggagtttgtcagcagaaacgatgtcaagtacagatgctgaattagcagttgtaactttcacgtttgcaagattacgtgcagagagttctgcaaattcgttaccttcgtttggaagaaccacaagaactttacgttcgattgaaagtgctgagattacttttgcaaattcagcagtttttggagctgtaaagtcaagtgtgtcaacagcgattaatttaccatcagcaacttttgttgagtaaactgatttaagcgccaattgacgaactttttgtggaagtttgtaagcgtagctacgtgggtttggaccgaagacagtaccaccaccacgccattgtggagagcgggtagaaccttgacgagcacgacctgtacctttttgacgccatggttttttaccaccaccagacacagcagaacgatttttgtgtgcgtgtgttccttggcgaaggctagcgcgttgtgagattacaacgtcgaatacgactgattcgtttggttcgataccaaatactgagtcgttaagtgtaacttcaccagcttgtgaaccatcttgtttaaataatgatacttttgccattatagatttctatctcctttccttcttatttagctttgattgctgatttaacaacaatcaatgatttcttagcacctgggacattaccttttacaagaataacgttcttttcaggaagcacttgtgcgataacaaggttttgtacagtaacgcgtttgttacccatacgtccagcaagttttttaccttttggaactttgttagctgcaacaggacccattgaaccaggacgacggtggtaacgtgaaccgtgggccataggaccacgtgattgaccatgacgtttgattgggccttggaaacctttacctttagaagttccggtaacatcaacaacatctccggctgcaaatgtatcaacagtgatttctgctcctacttcagcgccttctagtcctttgaattcacgaacgaagcgcttaggagtcgtattagctttagcagcatgacctttggcaggtttgttggtcaaaacttcacgaagtgtatcgaaaccaacttgagttgcttcgtaaccatctgtttcaacagattttacttgaagaactgtgttaggagtcgcttcgatcacagtaacaggaattaattcaccgttttctgtgaagatttgagtcattcccacttttttccctaagattccttttgacatgagaattacctttcttaattagagtttaatttcgatgtttacaccacttggcaaatcgagtttcataagtgaatcaacagttttttgtgttggttcgatgatgtcgatcaagcgtttgtgtgtacgcatttcgaattgttcgcgtgagtctttgtatttgtgagtcgcgcggataacagtgtagacgctacggtcagttggaagtggaattggaccacttacttctgcgtttgtacgtttagcagtttctacgattttttctgcagctgcatcaaggatacgatgttcgtatgcttttaagcgaatgcgaatttttttagttgccattttttctcctctcgtctattgtattcaataggctagctccacgggaaaaccgacacgttaggtatggcaataccttcgggtgtgtcgcaacctctcgtttcgtcgctacatactgtttttaacagcacttgtctattctatcaaaggagatgtggcttgtcaaggactttttagactttttttcattctttctaaatcttttttggtgaatgaaggaatttactaaaaatgacaagaaagcttactttgtcatctttaaactttttgatataatttgtttaaaggatttataatctattatataggaggatttatgttaaaggaatttaaaaactttattttacgtgggaacgtattggacttagccgttggggttatcatcggggcagcttttactgctttagttaaatctttagttgataacttgattaatccgttaatcggaatgtttgttcaaagtactgctcttgctcatttgtcagtaactgttggaaaaacaaaattcacttacggtgctttcttaaatgatgtcattaatttcatcattacagcctttgttattttcattcttatcaaattcatcaacaaactcttccctaaaaaagaagaaactgtcgaagaacaaaaaaacgaagaattggaaactctccaagaaattcgcgatttattgaaaaaacaataaaaaaattactgacagaaaagctgtcagtattttttttttaaaattttgcttgtgaggcttcgattaaacttgattttgagaaaaataaatctaaagagattatcaagtaaaactgctaaccaaactccctctagccctaattttaatcctaaggctaaaaatgctcctaaaagcaagcgaatgccaaacatccctagcgttgtggcataaaaaggaagttttgtgtttcctattccctgaaaagctgctgtataagttgttgctcctgtgacgaaaaaagtcgctaaaaatgaaaacaaaataacagtggtacttgcattcatggcaattctgtcggtagtgaaaaattgatttagaatattggctgtcagtaaaagggccaaaccaatcacaaacatcataatcgtcgctaaccagtaggtctttttgatataagctttaacattttcaatactattttcagctgctgcttgtgctaccaaaatcactgttacggtggccattccgaaaacgggcatataattaaattgtgtaatgctttcaccaattgcatttcctgcaaatacacgttcgcctaatctgacaataatcatcatgatgagcaaatcgcccaaacgcattgacaaacgctctccagttgctggtaaacttaatttaatcaattgatggtccaatttttctttataaaattgaaaatcgggtcgcttatcttttaacttataatagaggaaaagcaccccaataaatctagcaataaccgctccaagtgctgttcccaacactcctaaatggaaaacaaaaataaagacaactgacagtatcaaatttagaagactggcaaaaaaacttgcccacatcggtgtcttggtatttccatcagcccgtagaaaggctccaaaagtcgtcattaaagccaaaaggacaatcaagccacctactaaactaagataaataatggaaagctctaaaacccgctgacgagcaccaagtaaatagagaataggtcgtgctcccacaactgaaacaatccccaaggcaagaccaattaaaaaagtcagtttggtagcagaattaattaatctttttggattttcctctaccttctttgcaataagcactttggcaaataaacttgaaacaattgttcccaaagcgataaaaatcgcctgatagaccgtgatgagattattagccaaagaaacagctgctacggcagaaagactaaggtgagcgacaatcattgtgtcactcacccctacaagcatttgtaagaaattttcaataatcgccggaaatgcgaattttaatatttctctatttgttttcattttaagccaagatatttttctacttctttttgcatttcagcggctggaataacggtatgatgtagaacttctgcttcttcaagtccgatgactgcttttggtaatggaatcccactcaatttttcaagtgatttaacagcagcaaaatcgtctctatttactgacagctttgttttatcatcttcaagcccctctaaaacaacttttggaaacttataaggacttgccgtgctgaccacaactgttttttctttgggttgaatttgatgatagacataatttgctactgctgtatgagggtccagaacatatttttcattttcaaaagtttcttgaatttcttttgaaatttcatcttctgatgcccagtcggccacaaatccctgaagtttagtaatcatttctttagaaatttgataatgtccttctactgataaggctgtcagtaaatctgaagttactttatcattttcgtcagttaattcaaaaattaaacgttcaagatttgaagagaccaaaatatccattgaaggtgaacttgtcacataaaactcacgatttttatcataaagtcctgttttgaaaaagtctgtcagcacattatttttatttgaagcgcagatgagctgatgaacgggcaagcccaattttttagcataataagccgctaagatatttccaaaattccctgttggaactgaaaaattaatttcttctccgtcagtaatttgaccagttttgacaagttgtgcgtaagcataaatataataagcaacttgtggaatcaaacgtccaatattcattgaatttgctgacgaaaattgtttattatttttcaaaagttgatcatgtaaaactttgttattaaacatttcttttactgcggtttgagcttggtcaaagtttccatcaattccaacaacatgaacattttcccctttttgagtcagcatttgttgctcttgaatatggctgacaccacctttgggataaaaaacaataatttttgtttggggcacatcagcaaaaccggccattgcggcttttcctgtatccccagaagttgcagtcaagataacaatttcattagtcacaccatttttcttagccgcttgggtcattaaatgaggtaagatagagagtgccatgtctttaaaagcaatcgtttcaccatgaaaaagttcaagaatatagtgattcccaagtcttttaagcggtgcaatttccggactatcgaatttttctccgtatgcttttgtcaccattgatttaacttcgtcagcagaaaaatcatcaaaaaatgctttcaaaacaagttcagcaatttcttgataagaagcgttttttaatttttcaaagtctaaatcaacttttggaaagtcaacgggaacaaaaagtccaccatcttctgccaaaccttgtaaaatagcttgtgacgctgtttttttatttgatttatcacgtgttgactgataaaaagttaccatgatatttattccccaatcacattttttataattataacaaatattctgtaaactcgcaaaaagccacgaattctcgtggctttttttattataatacttaattaggcttgaatatcttcaatttggtgcatgtccaattcaactggagttgcacgaccaaacatatcaacagtcagagtcaatttgtcgccattgatttctgtgattggagcttcaaatcctgaaaaggcaccgtcaacaatacgaacacgttttccaacaaaaacatcaaagtcaatttcacgaacaactttacccatgccaaccaaaatatcttgaatttcttgttcaaaaagtggtgtaggttttgatctattcccgtgtgaaccaacgaatccagtaacatttggtgtattacggacaataaaccatgcttcatcagtcatattcatttcaaccaaaacataacctgggaataagttttcttcaacttctttcattttgccattaacttctgtacgaattgtctcagttggaatttcgacacgcaaaattttgtcagccatgttataaagttcagcacgctcaagcaaatcttctttaactttacgttcataacctgcataggtttgaataacgaaccaaccttggtcaaaacttactaaattattatcttccatttgaaatacctctgtatttattttttacttaatcagttaaaatcccagctgacagaaattctgtcagtaatttgggtacaagaaaaagggccaagcccttatcagataatattattatatcatatttatcttgaattaaaaggacttttactaaaattagaaaagaaaaatctgtcaaaactgacagatttatagattatttaagaaatgggattaaatggttaacactaaatgtaattccatgttgagttacccaatcgaaaattatgatgaacaccaagaagaaagctgtatattcaatgaccataaaaaaatcacgaacagattgttttctgcttggccaagtggttaatttcatttcttcaataatgctaccaataaatttaaacataatcttttcctatcactgccacaaatttactgacagagtccatttcttataaaagtttactgacagaatgccagttcgacgtgtttaaaccctattaaagtaaatacgatttaacgcgtttctttgtgtaatgtgtgtttgccacaagtacgacaaaactttttaacttcaactcgtttttctttcgcaactgacgaaagattgagtgtataatttcgtgaaccacatatggtgcacgctaatccagcttttcttaacatattatctcttattctatcaaaaattatttagaagcgcaaactatttttccatattggtcagactattagctactaaagcggcgtatttttcggcccctgttcctttaggatgaatattatcactgtagaaccatgaactttgaccagatgcttttttattccaatcaataattttcaaatttttatatttctttgccattttcgtcagcaaattattattaggttttgcccaaacacggtctgcgtgaacattcaaccaataaacaggtttatctccagcaactttcatcgctgcgtcaatttctgcttctttaattgttccgtttgttcctagaccaattaagtaagcatcaggattaggcatttttgatttagcattcgttaagtctgtcgccagtgactctgcttgtcttccaactgctgcatcaatatacatatgtggaaaaacttcttgaagatttgtagaagcagcaaccataaccgaatctccaagggctagaacattcatttgagaagctttttcagcaactacaggttgaaccttatacttttctgctaccgcctttaaggacatcggcactttgttgtttgcctcagccaattgtttcttttgtagtgcaacctgttgggccattattttttcttcaatcactcgttggtcatggggtgaaggcggtgaaaaaataatgaaacctaaacctatcagagcaagccctgaaaggagcatcggtaaaatattctttttaagtttccaacctttttctcgaacaaaattttgaaggattcctaaaatattactataatcaaagcgctgcgttggcagctcaatcaaacgatatgaaagttccgtcagaataagaatgagcgccaattgccaaattaaattataccaagcggtaggagcaagtaccttagcttcagcgaaagcaaaaacaggaagttgccacaagtaaattccgtaagaacgtgaaccaatatattcaaaaacaggatttgaaaatagcttgttagtcggaagacttggatgtgccaccaaagcaaccattatcacactggccaaacttgctagccacattccgccataataagtaaatgtcccttgagcaggcataaagatataagcaagcagcaaaagcaaagataatccaatagtcaactgccaagcaattttaaccgctcgtttattaaccttatgtgaaagtttattcaaaggccaaatgaaagcaagactagcccccattatcaagctaaagaaacgcgtatccgtaccataataaacccgcgttgggtctgccccaggaacgaaaagaattgccatccaaattgccgaaatcaaggccaaaacattagcaatgataaaaatccgacctctttttttaacaaattttagcaaaacaatcaacagcaaaggccaaaggatgaaaaattgcccctcgattgataaataataaatatgtttgaaaggtgaagcacccgcaatatcagcaaaatatgaacttccttgcgaaatctgccaccagttctgaaccgaaaatacagcagaaaggaaattagaacgtaatcccgcccacaaattaggttgaaaaatgatgatataaggtgtcacaagaagaaaaattgcaactagtaatggatagagacgctttaatcttcttccccaaaacttccaaatattaatcttcttatttttttcatactcgcgaaggagcgaatccgtcaccaaatagcccgagagaacaaagaataaaacaacaccaagaaaaccaccctgaacatggtttggccagaggtgatatagaataactgttaaaacaccaatcgtccgtaatccattaaaacctgtgacgtaacgcttcatttttcttctcgatttctatctttattctttaaaattttcttgtcttaaaactactacgctttacctctaattctaccatatttctacctcttttttcagttttagttgccaaaaatccctttaactttatcccaagcatttttagctgcatctccaatatctttacctacttttccaaggtccaaaccaccagaatctgaagacgatgaagagctagaactagagctttctggtgtatttccagtcgtgtgagcttctgcttgttcttggtccacaatatcatcttgatattgtctttgttgagtccaataaggttcttgtgcggcaacacctgcttccgcataaggattttcaactgtaaatgccgttcctttagtataaggcaacatataactagcttcttgacggaaaatgactgaggtttgtccttctgatgaacctgtcagtttatatttcccatccgcataaccaacccagagagccataaccacatccggtgtataacctactacccattggtcttggtcttcattggttcctgtcttaccagcaagtgtataagacttaggtgaagctttccaagcagaaccattagtataagtccccagcatcatttgagtcattttgtcagctgtatctttactaataacccgttttttggttacctttgctgtttttacaacttgtcctgcagcattttcaattttagtaatcaaatgcgcatcattcatcactccgccatttgcgaaaacttgataagcctgagcaatttgccatggattcgtttcaactccagctccgagtgccgtcggtaaaacatcatttttactacttaaatctaaaccaaactcacgccctaaagcatttccgacttttggtccaatcgcttgatatgtattaatagctggaatattatatgaatttgctaaagcagtatacattgggatttgtccacgccattgattatcaaaatcggttggtttccagccattataatctgctggtgaatcatcaaccgttttatcaattgaccaccccgcttcaattgctggagcgtaaacaataagaggtttaataactgaaccaggagaacgtttagacattgtagcatagttataatcagtaaagctatttgaaccttctgtattaacatttccgacaagagcattgacagctcccgttttagggtcaatagcaaccgaagcagattgggcataagttccatcagatgcttgtgggaagaaacttgggtcagaataagtcttttgcaagccggattgcatattttggtccatgcccgtatatatcttgtaaccattattcatgatttcttgtaatgtcagaccatacttgcgttccgcttcagaaattacagcattataatagcttggatatttatattgactacttttagattgataattgtcttgcaattgagcttgtaagtcaactttcataaaagtatctgcctgtgactgctccaaataaccagcattaaccatattttgcaaaactgtattacgtcggtcagtcgcatattttcctttttcgtaaagaggattataaatttctggcccttttaacattcccgcaagacttgctgcttcatcaacagttacttcgcttgctggaacaccaaagtatttcaaagctgcatcctgaattccccaaacaccattaccaaagtaagaattattcagatacatatcaagaatctcatctttactataatgtttattgatttcaagtgccaagaaaaactcacgcgctttacggtcaatcgtttgttcttgagtcaaataagcatttttggccaattgctgagtgattgttgaaccaccaccaaaacgccccagagtaacggctgctagagcaaaacgtttcaaattgacaccatgatttttatagaaagttctatcttcagttgccacaacagcatttgtaatgtttttggaaatttggtcaatcttgaccggtgttcctttttgaccataaagatttccagcttcattattatctttgtcataaatgactgtttgtgccgaaatagaactttgcagtactttaacattagctgttttagctaagtaaaaaagatatgaacctgtcgaaacaatggctactaagacaaaaataattgtgatttttgtcagattataacgtttccagaaccgtttaattggtttcatgaatttaccgaacttcgttttagccggtttttctatttcttcttcaagctttttttgttttttagggcgtaaattaggaatttttaaactattttttttagattcctttttattacgccgactgaaattattattttcagacatatatcgttcctcagatgctttttatttctttacttactcaaatgaatacagcaataccttattttaatacttttctgctttttttgccttacatctttgtaaggtatttagatttcattttttcagttctgattattttaccaaaaatccctttggcttacaatgtaagtttgtaaaacgaaagggatttatgttttattataaaggtttctctagatttttcaattgtttcacttctagcaccaaaattctatttataatttagctaactaactctaaattaaaacaagagtattcgctttctaatattattttgtatatccgtaaagtttaagttcacctgataagtattctcctaaatatatttccttaatttggttatatccttgcagattaatttgttgttcaagccaattttcatctttatcaattaattcgagaacatcaaaattagcttgtccatcaacaataattggatatttaatattttcaccaccaaattcaatcaatgtcaattgaccattttgttctaaaatagctcttttaacattatgtatctcatagataccattggaacgtaatttaaacattaattcattagcagagattccatttctgagacattcatttactctcacttttccatcttgaatcagagtcaatggtttaccatcaacgattaattttacatagcgattgtgctcctttgcaaattttaaaattaatactaacagtgtccatatgattagaaccaagacaaattgtaaaaccgtaatagaatcattatagatgactccaccaataattccccctaaaacataattttgaacttgatccattgctgatgagggggcaagattacctttccccattaaatttatttgaataattaaacaaataatacctaaagcaaattttagtattattgggctgtataattgcattttaactcctaattttttatttttcgggattaatcaagtaacttttagtaagggtgtatgactgttgatcagcactaaggttaactttataataatcaccttttatctttacaatcacaccatcagctaattgcgtggaattaacaaaaatattatttttattcgttctttcgtttttagcgactctttcaataaatccaaccatctgtgaagattgagtatgcttagattgattaatttgataatttgaatattgtataccaatctctaaaataataaataataataaaataatactaagatctctatatttcgttttaattctatgcttaatatatatagcaaatacaataacaagaactacaagactcccaaaaataaagatatatcgaagataatcactaagtccagcttgcgattttaaaaattcaatatcataaaatttcatatttttcaccccttaataactattatattaaaaaaatgattaataaatcattttataattattcaaacctcatttaattttataaataaaacttctaagatgaaatattatctttataatagttgttctacttccaccggagtaagttcaagaactgatcgcaaaaatggatacttttctttcatcatttcaaattctggaccatttgaaataagttttgctttagcactcaccctaaagccaatcccttgatagccatttttaccttcgacttctctaaccccaagcatcagataaattgtatcattcactttaatatcttcttctaaataatgcatccctgctgctggtgccaatattcgttcatccctggtaagctgtaaataagaaatccatgttcctgtaacatgaggacttttctctgctccccatgaagtgagggaaactgaaccttcatattttaatgtttctttaaatttttttgttagcatttttttctctttctataattcactcataatatttattattttttacattttgagttatctttattacgtatttttaagaagatactttgattataacaaacctagagttaattgaaaagtaattctcttgataatcccgatgctgtcaccctttcagtttcttatatttttgggccaaataaaaacttatagtataatgtgaatatggaatataacttcattttacccgaaaattttatagaacagtctgtctctgatttactcgaaaaaacttggttcattcctcgtaaacaaagacactttctaagaatgaaaaaacattgcttagtcaataacaagcttattaacgaaaatcagctcgtccatgctggagataaaatcactcttatttttgataatgaggatttctctaatttatctctaaaattcggttcagcaaatttagctgacatcctttatgaagacgaacatttgattgttgttaataaacctgaaggaatgaagacccacggaaatacggctgatgaattagccttacaaaatcatgttgcagcggcaatcaatcaagaagtttttgttgtccatcgcctggaccaagcaacatctggtgctgttttatttgcaaaaaatcaatttgttctccctattcttggtaaaatgtttgaagaaaataaaattcatcgtgaatacttggcactagtcaaaggtcatttcccagaaaatcactttaccattgatcgggccattggtcaaaatcgccatgataaaaataaacgaatcctttccgcaaagggtcaaaaagcagtgactcatgttgagattatcaaaaaatttactgacaaaactcttgttaaatgtaccttagatactggaagaactcaccaaatacgtgtccatttatcttcattaaatcatcctatcattggtgatgatttgtatggtcaaaaatcacaggagagaatgatgcttcatgctgataaaattattattcctcatccatttgaaaataatattttagaaatttcagcaattagtactagcttccttgacatttttaataaaacaaaataaaaagaagtgatttttaccacttctttttatttatttcttaggctcgaatcaatcgttttaaacttgaagttaccaagaaaaggacgatgaaaattaaagtaattgcggcagatgctggagcatccatatagtaagaggcaatcaagccagcatttaaaccaataaaacttacaataaccgagataaacaacacagctttaaaagatttgcctagacgcatcgcaattgaagcaggtaaaaccataattgccgaaacaagtaaagcccccgctgcaggaatcatcaaggcaatagcaacccccgtgacaatattaaaagcaatcgaaatccatcgaacaggaagtccatcaacaaaagctgtatcttcatcaaaagtcatcacgtaaagcggacgtaaaaagagaataaatccaagcaaaacaactgctgctaaaacaaaaagcataatcacttgcgataaggaaattgtgataattgagccaaataaatattgctccaaactaacacttgttgctccttttgaggaattcaaaatcaaaagggcaatggcaagtcctgctgacatcaaaatggccgtcgcaatttccatatagttatgataaattgttcttaaatactctagaaaaacagccgcaattacaactgtaattaaagttgtaattgttggattccaacttaagagaaccccaaaagcgacaccggctaatgatacatgtgataatgtatctgacattaaactctgtctacgtagtacaagaaatacaccaagcaaaggagaaaatattgaaatagcggttgctgctaaaagagcatttcgcataaaatcatactgaaataattcaaacatcagcttcctccttcaattcttgttggttttcttgagctactctatcgcggtctgtatgcaaatcaaagcaagcaaatttcccatttttatctttcaataaatggatatttcggtcagcataatctttcacttcttccggatcatgagtgaccattaaaacagattttccatgtttatgagccgcatggtgcatcaattcataaaagtcactacttgatacatcatccattcctgttgttggctcatcaagaataaataagtcaggatcactagcaaacattcttgcaatagcaattctttgcttttgccctccagaaagttcaccaattcgcttatttctgtagtcccacattcctactgagtcaagggctgccttaacgtgttctgagtcgtgagctgtcatttttttaaaccaaccttgtctcggatagcgtccgctcataacaaattcatgaaccgaacttggaaaaccagcattaaaacttgcaacttgctgaggaagataagcaattcttaatttttctcctcggttatttttgggagaaatttttattttaccttttttaggttttaaaattcccaaagttgtttttataagagttgatttggcagcgccattctcacctgttaatgtgacaaattcaccggaatcaacatgatagctgatattttctaaaactggctctctatcataatagaaagtcaagttttcaacattgatatatctcattttttctctttatatctctaatagtaattcttatttcgatgtttttcttactaatctatttttatttcaaaaacacgaaactcccgttcatgagaacgagagtttcaaggagttttatgaaaagattttttggaagaaattcattataaatccttcatcttaatttttccttaaactcacttgatagttttctttaaagcagtcaaattatcttgcatcagtgtgagataattgtcaccattttttttctgctcgtcagataatccttcaacagtattgataccaataaggttcgcccctactgattttgctaaagtctcagcaattttactgttagcatttccttcaaaataaacattttttagtcctgctttttccatttcaacttttaaattagctagcgttgatgctgaaggttctacttctggatccaatccagcaatcgcaatttctttcaaaccataatcacgacttagataagcaaaagcttcatgttgtgtaataaatgttttttgtttagcatctttcaaagtatcaaattcactgtctagcttcttcaatttagcgacataactcgctgcatttttttcaaaagttgctttatcatctgggaattttttcccaagctcagaggcaatggtattaacttcaataattgcttgctttggactaatccaagtatgagggtcaccagatatcttatcaacatccttgctggcttcgattttaatccctttattatttacttttttggcccatttttcaaggtcattagaattgtaaacaatagcttcagcatttgtcattgtcgcaacttgctttgcacttggttcaaattcatgaacttcctgattagcagggacaatattttcgacatcgactttgtcaccaacaattgccttcgtaaactcatacattggctcaaaagtcgtgacaacttctggcttactggctgatttttgacaacctgccaagagtaaaactgctggaatagcaagtaacatcaatatctttttcattgaaattcctccgtaagtgctgataagaatttacttatcacttcttgttcttcgtcagtaaatttgttccctaattcctggtaagtactcagagttttctcgtgatgagtagcatgctccttagcaaccggaaccgctttttctgtcaagctccaaaggaccacgcgttcgtcatttgtggctcgacttgatttaattagttcttgctcttgtaatttctttagggctttagttactgctgctggagaaatctttagtttttctgcaattttagcatttgtcgatatttgttctgccaaaagcattaaaatatgttcttgtgtgctcgttagtttcacatcactttcacacttaccaagtaatatttcatgcttattttctgcaaattgcatgattgtcccaagaaactggtcgatttgatttgctaaactcatcgtatttcgtcctccataattagtttactggttaattatatagcaaagaaaaaataatgtcaaccagttaacgttatttttttaattttttatttgaaagcttgtgccatcttttagatggatactaaattgataagttttttcatcacttgaatggtcagtaatttttgaactggctgacgaatctgtcagtaaattgtaggacaaatctcctgaatcaaaatgaatttgaccttgagattttaaatcagtctttaaagctactgacaccattaattcagctgttaactgctccttttcacttcttaattgtcgagcatcatctatttgcctttccaaatagaactgaagaaacattgaaaacatcaataataagactagcgtatatagaagtattcctcctcttacgtatcttctggaaattgatagataaatgttctttcacctccttgattaaaatcaattcttatggttattaaatttttagtagcttgaatcttagccgcttttatatcataaagcattggctgataaccctgacctttgtcatcagtcttccggaaatcatcactcctaaaaccaaaccttagttttttatctttagttacatacagaaaattctgttctaccctatctaattttgttcctgagagttcaaaacgcatttgctgacagaaaatttgccaatcttttatgctatcactttgactaatctctacttgttctttcaacatctttgttaaacctgagataacaaggactgaaccagaaattgcaagaagtgccaccaaacactccaacaaggtaaatgctttaactttgaagttcaagtcgcataatttcctttccatgattactaataatcagtaaattttggttttcttttatctttatatctgaaccgttgattgataattctgttaagtgactttcaatcgccatttgtgccacgtttaaagcttcaatcttttgattttcttccgtatctttttgtcttacttgcacaagagaacttaagataaagctgactagaaaagcgagtagagctatactaattaaactttccaaaagcaaatatgccttaactgattttctttttaaattttccactgcctatctccaattgataagtgatgagctttttttcgtaaggtaaagaaattgtgagtttttgtaagctagaattctctcccttatcatcaaatttaactgtaaaatctttaactgctacctcctttggaattgtgatacttctatcttcacagattaattcttgatttttagcaactaaactttcagatttttgaagcagtgcagcatcttcttgactccttttatagaaattttcaaattgaagaacaaacaattctcccttaaaaagatggactgtttgtattatttctaaagaaaaaagagttgcgctaaaagaaataatcaacaaaactagaagagactctagtaaagtaaatgctctagtcattaaaatttcgttcttcatttttattctgatcatagtaattatcgtaagcagaaatttgtttttgagtaatcatcccagcgctgagcaattctgacagagtcggcttctcatcatcatgatctaattcataaagttgggcttgactttctactacttttacaactgccgcttctccagttttttgaacttgtgatttttctttaattaaatttggaacaaatagtaatatcaaaatactaataatagctagtacaattaacatctctatcaaagtaaaagcttttagctctttctgacggcattttttttcacaaattttaacgaataaaaatattttttgtattttctttaaaataaacttctttgttctttccattttttcatcctttctatattcccgaacccatatttgaatagatggggagtaacatggctgcatatagcaaaataatcatcaatgctacaaaaataaaaacaagaggttggattaattgcattaaacgatctatctttgtaaaaaattgttcccaacattcatccgcataaagcgaaagctctaagcctaatttatctttaatagctccatattcaatcattaatgagagctcgggtaaaaaaagcgcaagtttactgacagcttgttcaaaagaccgaccagcattcaattctaaatcaagattcttgccaacttctgaaaaaattcgacttttttgttttttcatcaagttaataatttgacgtaattcgacaccttgagcaattagatttccccattctcttgcaaagtaagctgttaaatataaacggataaaagaatgaaccagaggtaatttaacaagaaatgtaaaattcattattgctgattttcgtttaaaaagagttactgacaaagctgtcagtaaaaatataaaagctccaaacgaaaaaaatactaagggtaaatgattaatcaatagagtagcaaagttactgccactattgagttgtggtagtaaataattttttaagccccacataattccaaccagaaaaattaataacaatattggataagtagcaacttccactaatttatttttaactttaagctgtttttttagatgaagttcaaccaattgcatcgtccctgacaagttaccatgcacttctaccaaagcaagttgtgtcaccacatttttagaaaatgaaagactttctaaaagctctgataaagcttgaccagaagcgagaccttctttcattttcaatgtaaattctttttccacaagttttgataaagataagaaatttatcacttctcctaaattaaatccactattcaaaagatttcccatcagttggataagtttggcttgtttaatcagtcttaattttttccctcttggcttcagtaggtgtgagatatccatttgtaagtagctgatcaatttttttattccaattttctgatgaccaagactcaaattcgtttttggcaatgtctaatactcctttcccagctattaaacgctgataaacaacacttgataaagcattttttatttcccaatgacttaaacccagctctgataatctctgaatgacacctctaacagaagcggcatgaacggttgaaaacactgtataacctgtcaaactagcccgtaaaactgcttgagcggtcaatttatcacgaatttcaccaacgattaacaaatctgggcgatgcctcagtgataatttaattaattcatcataactattaccaatgacttcgttgacttgtaactgaataaaatcggaatcaatcaactcaacgggttcttcaatagtgataacttgtaaatctgtaaaatgacgacgagctaaatcaaacattaaagatgttttgcccgagcctactggaccggcaaagagatgcaatcctcttttacaatcataattctctagctcttcatcaaaccaaaaatcaagttatttgttttgatcatgcaagagacgtattactaaggattcattaccctcgaaatcccccactgttgaaagacgcaaacgttttgcattactttcctctatttcataccaacaagctcccaattgaactcgtctgcgttctcctgtattcatcccagctagaaacttaaagtgagtaagtagtgctaagccaacttctaacccaatttcttctaccagaacacgcgctgtcatttgtcgaaaataaagtttatacttttcttttgaagcaatcagataaatatctgatgcacctctatcaattgctctttgaattaattcttttgccatttttggtatcatactagactatacgcaaataatcagttaatgtaacaaaaaagccgaaaatttttcgacttttatttcttaggattatcataattcaacctttaacctcttattaaaatcaaatattttatacctttttccgataccaaaccgacctcaactccctcttttatccttttttaagcgaataaacattacgagacctataatcaacagtatcagtgtcaaaagcaataagaaagatgaaacacctattatttttattaaattatttatcatccttatttatctttatttttattatctaaaatgattctactaattgcactaaaaatcacaactccgagaagcactttgattatgatgctggcaataggatttaagtgaaaaaatatttgcaaaataaccgctacgactaccatagaagtcattataattttgtagccatttattttcattgccattgtaccccatactactgctctagaccccataagtggtgcaaactgtggtgatgaattaaagacaacaccacctggtataaatctacctacagttagtccaagaactcctaaagctgcttgtgcagctctaacaggaacataaaccccagcaataaccaagcctgctcccacagccaattggacatctgacctattcagccctattctaaatccataccagtaaacgtgcaggtaagttgaaccatacaagtagaattgctagacttgaaaggatcagatttttttaaaatttgacataattttgctctcctttttgaaatgcgatgcaagtcagtagagagtttgcatcgctgttatagcgaagttttttcttccaagatttttaatcctccttatatcattctgagtgagcgacactcatgattcatgaatcatttcttgttttctaaactgattatatcaaatcaaaatacccaaaaaggccttttccgaaatctcggaaaaaatttttttatttttattaataataaaaaaaaggaggcttaaagcctccttttctctatttttaatattagatttatcaaaagaaatcatcaaatagacttaattgattatcatcaggcattccttcaagaacacccatattggtcatgttttcaataattgtttgtgaaacaccaccacgcttacgaagttccattttacttaaaaattcaccttcagcacgcgctgcaacgatttgttttgctacgttttcacccaatccgtccattgttacaaatggcggaattaaagtatcaccatcaataacaaactcagtagcctctgagcgataaaggtcaattttaccaaaagtgaaaccacgctctaacatttcattacaaagctctaaagtcgtataaaggttagtttcaacatttgttgcatcaaaacctttatctttaatttctttcattttggctttgactgcttcaaggcctgctcccattaccccaatatcaaaggcagttgctctaatagagaaccatgcacaataatacaatattggatgatgaactttgaaataagctacccgtaaagccatcataatataggctgccgcatgggctttagggaacatatatttaatctttgaacaagactcaatgtaccattcaggaacatcatgttctcgcatagcttctacatatttttcacgttcttcggcgggaattttattccacattcccttacgcacccgttccataattgtaaaagcaagaccgttttctagccccttatgaataagatacaccatgatatcatcccgacagccaataacgctcgataagtcggcaatccctgaacgaattaaatcttgagcatttcctgaccagacgtccgtcccgtgtgaaagtccagaaatttgtagtaaatctgcgaagtttttaggtttggcttcggcaatcatgttcattgaggtgaaagttcccatttcagggattcccaaagttcctaattttacccctaactgttcttcggtcaagcccaaagattctgtcccagtgaaaagcttcatcactcctgggtcatccattggaatatcttgaggaacaataccagagagactttgtaattttcgaatcatcgtagggtcatcatgtccaaggatgtcaagttttaagatattgtcatgaatagcatggaaatcaaagtgagtcgtttgccattcggcattaacatcatcggccggaaattgaacaggagaaaaatcataaacatccatataatttggaataacgataatcccacctgggtgctgtcctgttgttcgtttaacaccagttgagccagcagctaagcggtcaatttctgcatttccataaaattgatcataatcacgttcatatcctttgacaaaaccaaaggctgttttttcagcaaccgtaccaattgttcctgctcgaaaggcataatcttcaccaaagatatctcgaacgtccaagtgagcaaggggttgatcatccccagagaagttcaaatcgatatcgggaactttgtctcccttgaaacctaagaaagtttcaaaaggaatatcatgcccatctttgatgagtttatgatcacatttagggcaatttttatctggcatgtcataaccagaaccgaaagatccatcatcatagcattcaaaatattgacattctgggcaacgataatgtggagctaagggatttacttcggtaatcccaatcattgttgcaacaagtgatgaaccaacagaaccccgtgaaccaacgatatagcctcggtcattagaacgttttacaagttcttgtgaaataatataaacaaccgagaaaccatttcctaaaatcgatcgaagttctttttcaagtcgtgcgtcaataatatctggcaatggattaccataccactcatgtgctttttcataagttaagcgaacaatccgttcctcggaagtttctcctccatcaaaaaccatcttaggtgtatataaatcatcccgaactggagtcaatacatcaaattcatcggccaatttttgcgtattgtcaatgacaatttcacgcgcggtcttctcatcaagaaaactaaaggcttcaagcatttcatcagttgttctaaaatgagcttcgggtaatggaagaggtttggcatgttccccgtgtccttgagtccagttaatttcagctccaagaccaagtgagcgaacaataatttctcgataaatagcatcttctgggttcaaataatgtaaattacctgtggccagaactggcttgcctaaagtcttaccaatttttatcaaatctttaagcgtttgttccaattctttttctgatttgaaagaaccaccaacaacaagtgaacgataaagagctggtggaaatacttcgataaaatcataaaacttggcgatttcaagcgtttcttcaaatgttttattgattgccgcatcaaaaacttcaccaatttcgcaggccgaaccgaccaacaatcctttacggttggcttctaaaaccgaacgtggaacccgaggaagaccagcataatatttaacattcccaaaactaacaattttaaagagattttttaaaccttcttgtgtcttagcatataaagtcacgtgttttggacgaacttttttataagaatcttcactgaccaatttgtcattaagttctaaaagacttgtccatcctgtatttctagtacgtaattcttccaaaaatacaaagagcaaacgtccggttgcttccgcatcaaagttggccatatggtgatgttcaagtccgatttggaatttcttagtcaattgacccaaaccaaaacgtttcatttctgggtagagattacgggcaaattcaagggtatcaaccactggttgcgtgataatcggcaaaccatttcgtgaatagttcatattcatgaagcccacgtcaaatgttgcattgtgggcaacaagaattgttccttcacaaaacttttggaattttgttagaacttcatataatggtttggcatttttgacatggtcatctgtaattccggttaattctgttgtaaattcgctcaaacgatatcctggattgataaattcatcaaattcatcaattggatttcctttgtgcatttttgttgccgcaatctgaatcaaatcattatgaactgccgaaagtcctgttgtttctacgtcgaatacaacataagttgattcatacatatcaacgtcagtttcattgtaaacaatcggaatttcatcttcaacaagattggcttcgacgccatagataatcttgatgccattcttctttccagccgagtgagcctcagggaaagattgcaaaccaccatggtcagtaattgcaatagctttatgtccccatttagcagcctgagcaaccaaactagaagcagaaggaatggcatccatttgactcatattagtatgcgcgtgaaattcaacacgtttttcatctgatttgtcttcacgaacattttgtgtcggaatttcaatcaaatcggtcaattgtaggactaaatcatttttgaaattgtcccgttgaacattcccgcggacgcgacaccatagtcccgctttaatttgtttggctagctgaatttcttcttcgccacgtagccatttctgaacataaaaacttgaagtgtaatcagtcatctcaaattcaagaaggtaactaatatttcctgttttacgtgatttaatttcacggagttcgcctttaaagacatatccttcaaaaacaactggtccgttagtcgaaaattcactgacagaacgcatcggagtgacgggttcattatttttgatttcgcgacctaattgaattttatctgattttacagctttgatttgaagagcaacacggtcaatggttggtttaggtttaatttccacaaccgcattagcggtcatcaccaaatcatctttgtatttgtcatgttcaatatttccttgtacacgcaaccaaagagcatcagataagctgtcagtaaaattattttctccatcagtacggtcagctataattttttcattcatagctttgacagtattgacaatttgatcaaattgggcaatttcttcatccttacgcccccattttgaaatcataaaagttgaagtttcatcagccatttttaattctaaaatatggttgactttgcctgattcttttcccgtaaactcacggtgtgcggcttcaaaaacaagcccctcaaaaataacgccaaaaccttctccagcaataaaagacatgctggtaattggactttgtccgctgatttttcggccaaagaaaataccgtcagaaagtgctgtttccacaaattctggttttgcttctctggtatttttgctttcccgttcttctgaacgttgttttttgatttcagaaatttgggcttgttctgcagtttgagccgccaagcgagccgcaactttttcagcgtgagcagctgcttgcgtttctgtcagctcctggtcaactagaggggttattcttaattctccaaaaccgaaagacttaaatttttcctctagaattggaaaatatttctccacaaaaaaatccatttgcggattatcttccaccattaagtgaattttttcttcttccttttcaagatgatatttcttaaaaatacttgaaaaagcagaatcgcataattctggaagtgtaagtgcaaattgataataatcgttaagattttgctcatcaatattttgatttcgactgctgacagaaatttctgtacgagcaattgtcgaaaaagcagtttccgtcagttctgtcagtaatttatatgtatcaattggtaaaatctcatcaaaaattaactgaaagtgccagagcttacttgccgtgtgcacttcaacattttcaatatcagcatgctcaaattggctagaacgacgcaaatttggtggcattttgatttgttccatcaatttttcaaacagattttccatgttttttgaccctttatcttattttttctatccttagcaaatagaatttcatttctcattatagcataaaaaaatgttgcttttcatacttttttaagaataaaataactgacaaaactgtcagttattttattttaaaattaatagttactgacagagctgtcagtaaaactatttaccagttgagcgattttcttcatccatttcccaaaaatagagtgcttcttctactgtctgtgcttcgccacgtttcatatagcgaatcatatgactgacagcttctattgttttaaattgtgtgggaattcgtcgaaaatgatttaattctgtctgaattttttcttcatcttctttaagtttgttcaaatcagcatttaaagatttcatttttagagaactttcaccctctaaagctaatttttctttaaattttttggaatcatatctgaacaaaagacaaaaaatgaataaatagacaactgaaatcaccaacaaaagaactaatgacaactttaaaaatattcctactcctaaaataataagaagaagtgctaattttaaaatcaatgatagagtttgatgagtatgaattttttgcttatcagagtgttcagcaaaagattcaatgctttgttgaactttctgcaaatcctcaagtaagtgaagcactttttgacaataaactatctctttattagtcgtttccacacaatctacctttcattctcccttactagtcgagctaatatgcgattaagaccacgaggatctttgtagccatgttcaaaataaaagtctgtgaactcaatatcctcaatttttaattcttgttgaatagcaagtgagaaaatattgacgtactctgccatatcgctcgtttttccaatacattgtaaaccaagaatttgatgagtacgtctctcataaatcatccaaatattacttggtgaatgtccgtctaagtgttcatttagtaaatgaaccgcatctgcatcataaccagcatcaactgcctgtcttattgtaatcccagtcatagccatcactaaattattcattggaacatgataagttccctgactactattaattttttggcgaggagcaagtaaattaatcgccgcaatttcaccatcgcgaacagcatccgaagcatgtggcagataatagcttttttccaacaaattaacataagtcgttgaaacatctccgacagcaaaaacatctgaacaagaggtttgcatgtattcatcaacaataaccgctccgctatctcctaactcaacttgttgattcagaagataagaattaggccgaaaaccaatcgtaaagattactccatcaacaggaattttctgaccatttgctgtttgaatgattgtattttcttcgtcaaacccaatttctgtcacttctgtatttaatagaagacgcgttccctctgcattcatccaactttccaataaatgacttgctggttcatcaagataatcgtttaaaagatttttattgcgatgaatgagtgttgtctgaattcctctttcttgggcaatccgagcaacttcaactccggtcattccaccaccaattactgcaatatttttggctgttttcagaaattcatctgtttttattgcatcatccatactttttaaaaagtaaagtttgctttttttatcaaaaggaacagaggtcattgccggataagaacccgtagcaaaaatcaatttatcatagagagctagtttcgtctttttggaattgactctccgataaaatagccgtttatttttggtatcaatctcttcaaccaccgtttccatttgcatgtttaaaccagcagcttttagttcttctaccgaagaataactagattgattaaggacagatttttgacccgccagataagaaataattccttgagaaacaaaagaaacctgattacgcttatcataaagcgtaatttcggcttctgggtattcttcaagcgcccgtaatccggcacaaattccggcgtgggagcttccaacaataacaattttcatagtaaatctcttttattatttacttaaaatttcaatggtattgacaagttcatctttattaatttcaacaacttcacctgtcgcacgaattttaacttcaacaacaccctcagcagcttttttaccgattgtcacacgaactggcaaaccaatcaaatcgctgtcagcaaatttaacacctgcacgttcattgcggtcatctactaagacttgataacctttgccacgcaatttttcttcaagttcagaagtcaattccattgctgcttcatctttaacattaactggaacaagatgaatatcaaatggtgctaattctttagggaaattaattgaccagctaaatttaaattcttctcttggcgttttttcaacatagatacgagcaaattgttccaaaatagctgaaagcaaacgacttacaccgattccgtaacaacccatgagcattggaattgaacgaccattcgcatcaagaatattggcattcatcgcttctgtatagcgagttcctaatttaaagatatgtccaatttcgataccacgcgcaaatttcaaagttccacggccatctggtgaaatttcaccttcattaactgtacgtaaatcaacaaactcttcaacttcaaaatcacggccaaagttagcatttttataatggaaaccatcaacgttagctccaactacagcatttttaatttgttcaactttgcggtcagcaataatcttgacattttcaagtccgattggtccaagtgaaccaaaatgtgctccaaatttttcttcaacttctgcttcactggcagcttcaataaatgatgctccaagataattggtcaatttgacttcgttgagttggtcattaccatttaacaaaataaccactaattcatcatctgcgtgataaaccaatgttttaactgtttgttcttcatcaatttcaaggaattttgaaacttcatcaattgttttagcacttggtgttgctactttttcaagttcaagttcttcagtataagctacatttggttcaaattgactgctggccatttcaatatttgccgcataatcaccaccttcagcgtagacaattgtatcttcaccagcaatcaaccatttgccaagttcttctttgatttctgaaaggacagaatctggaatttcttcgattgatgtaatatttttactcaaaacgagccatttttcaagattgattctatcatctgtaatagcaataaattcttggctatctttaccacccattgctccagcatcggcaataattggtttaaaatttaagccagcacgttcaaagattttttcgtaggcttttttgtaatcattataagtctcgtccaatgaatcttggtcagcatggtagctataaccatctttcatcaagaactcacgaccgcgcaatagtccataacgtggacgtttttcatcacggaattttggagcaatttggtaaacattaagtggtaattttttataagaagtaatttcatcacggacaagagaagtcattgtttcttcatgtgttggtcctaaaataaaatcagaattatcacggttttttaatttatataaatcctcaccatatgtgtcataacggccagattcgcgccaaaggtcagctgtcaaaagacttggagcaagaagttctactgcaccaatttcgtcaaactcttcacgcatgatatttttcaacttttcaagtacgcggtttgctaatggcaagtaagcataaattcctgctgaaacttgacgaacatatcctgcgcgcataagtaaagcatggctgataacctgggcatcagaaggcatttcccgaagggttggtataagcatttttgattgtttcataattttaaaatttcctttatgagtttggttcagcttctttccttttgaaatagaagacgaatagatatattaatttacaaaggctcggagaatatcattccatgttactgctacaaagagcacaagcatgaagacaactcctaccattgtgatgattgattccttttcttgtgagagtgctttgccacgaattgcttcaataatatttaggacaatttttccaccatcaagtactggaataggaaaaagattgacaatccctaaattaattgaaagcatagctaaaagattaataatcgtcggcaaacctgctctcgcggcttggccactgagttgataaatagcaactggaccaccaagtttatcaagactcggtcgtgcaatcaaacttcctaaagctttaaagattgctgtagctgattggcctgcttgaacaaagccacctgtaatcttatcaaagaaacctgttttcattgattgcataatgccaacacggtaacttccgtccatttttttaggtgtaactgataaggtttccgatttgcctgaacggctaacttcaagttttaattcttttcctttagaacctgaaatttcagtaacaacattgttccaatctgccgttttagttccattgactgcttcaattttatcaccagcttttaagcctgcattgtaagcgggtgttcctttttcaacttggccaatagcattagtagttgaaggaacgcctccttgaacaaaggttagaacgataaaagcgatgattcctaaaataaagttattcaaaggaccaccgaagtttgtcaatattttatgaaagacaccggctgattgatattgaacatcgagtggtgcaatccgaacttctgttccatcttcttcaatgattgttgcatcatgatcaacagaataacgtttgatttccccaaaaacttctccttcaatgaaaagttctttttcaaaatcatattcagtaatcaacatcggaattgcttcttctaattcaacatgttctgacagattaattcttctgacgatattactgacagaattttcagcttctggatttactacttcagatttactgacaacaagacttgcagcttgtccttttttgatttcagtcttgtcatcaccccaaccagccaaacgaacatagccaccgagtggaagaattcttatcgtgtaaagtgtcccatcttttgcttggtgagcaaaaattttcggacccattccaacggcatattcacgcactaaaattcctgaacgttttgcccaccaaagatggccatattcatggatagcgacaataataccaaagataataataaaagtaatcagtgtttctatcaatcgacttcctccttaaaattagaatagtccaagtagatgcataatcgggaaaacaaaaattaaattgtcaaagcggtcaagaattccaccatgacctggtaaaattttacctgaatcttttacgccaaaatgacgtttaatacttgattccacaaggtcaccaatctgaccaaccactgaaaagataattgtaaagataacaagtttcacaaagccaatttgcggcaattccttagtaaataagaaatacatgactaaggcaacaacaacggctgaaacaattcctccaactgaaccgaccactgttttatttggtgaaacagatggcaaaagtttttgtggaaagcggtctttaagcgagcggccaaaagcataggccccaatatctgtcgcccaaacgataaatagagctaaaaagacaatataaacacttgtttgacgtgctgtcagtaaattttgaaaaccaatccctacatagaaagccgaaagaaaaggaaaaccaacatcaacaaaagaatatttcccgtttgaaaggaccattcctgttaacatcatgaataaaaagagtgtaaagagcatcactcccccgtcagcatttagacctaaccaatgtttaccgactggcaaagcaagtgacaaagcagctaaagtcgctaaaattccttcaaatgaaaaaacttgtaatttatacattctaaatagctcttgcattgcaataataacaagcaaagcaactaaaatttgaaagtaagctcctccaagaagcaagagggctaaaaagattcctcccgcaaccactcctgtgataattcgttgcatcattatttgactcctccatatctgcggtcacgcttttgaaaagcagaaatagctttgtccaattctttatcatcgaaatctggccaagcagtttgcgcaaaatataattcactataagctgactgccaagtcaagaaattagacattctttgttcaccagatgttctgataatcaagtctggatcccgaagattttcaggcaaaacagcagtttgtagatgttttgacaactcttcttctgtcagtaaacttaaatcctgaccacttttagcaagctcttgaatggctaaaataatatcacgacggccaccataattcattgcaaaattcaaaatcattccgtcattttcagaagtttcttgagccgcacggtcaattgaatctaacgttgcttttggcaaaccttcgcgttcaccaatcatccgaatctgtatattttcttcttttaaaactggaacatatttgctataaaaatcgataggtaaactcatgatgaatttcacttcatcaactggtcttgtccaattttctgtggaaaaagcataaacagtcatcacttttatgccacgtctcgcaccatgaacagcaacatcttttagcgaatccattcctgctttgtgtccaaagattcgtggtttccctttctgcttagcccatcgtccattaccatccatgataattccgatatgctctggaagtaattcttcttgctctttattttttaagttattaaacatagtacctcacatgagaattttatgcaaaaaatatttatcataaattcaccattatgctctttggttattaaagttttatttaccccaaagactctaagaaagaaattctcttcttcttatttttttctttatcaatttattcaaaaactttctctactgttttttcaaaaaagacagtattacttttccattttaccatattttaatatagatttgtatctcaaattttattggtcagtaatcataagttattctatttgctaaaatcaactgacagataaatctgtcagtaaaatattttataaaaaaatcctgtcagtaactgacaggaaaataaattaaatctattttctcattaaatgtagaaaagagattagttttcttcaattgggctttccacttttgtttcggccggtgtttcttcaacaacagttgtttctggtgttacaccactttttacagtttttacggctgcacggtcgaaagtcaaaatcacaccttcacaatcaagttcaattgttccttttgctgaatcaatgcttgaaagaattccgtgcaatccaccaattgttacgatttctgaacctggttgcattgcatccaattgttcttggcgtttagattgttgtttcttttgttgacggttcatgaagaacatcatcccacccataacgacaacgataaaaataagagataagcctgacatttctgtctcctttataagttttattcaaatttaagttcattttcgaacattcttcttattctatcatagtttgaaaactctgtcaaatcaagctttagagatgtttacttgcttctcgaattgaaagtttcgccattttattttcatgttcttcaataaattttatgacccaagcagaatttgtttttgccaaatctcgcaaagcccaacctattgctttcgtaataaaaaattcatcagcaaaagaactacctaaaagatttttttcaatattatatgaaagtaattctaaatctgtttgatttttaaagcttaattgacagtcaattgcaattcgtcgaatccaaaaattttcggcttgagcccattcttttacgagagtcttgacctgttcataagcagttgagtcattttcggtcgcttgtttacgacctgtcagtaaaagctgaccaaccaattcatctaaagcgtcaaccgtatcccaccatgatttactgacagtcaatttttttatcttttccatgtcatcaaaaataagccatttcttcatttgatgaagataatctaaagccagatattgaaattcacgctcaggcaaattccaaaattcgaaaacaagcttccaatcaattttcttatctgcctttttttcctttagaaaatcttttgccaaaagacgtctttctggcgtttttaaaccaataaattcaaactggtgacgcaaatatgctgcttgtttttcagcattttcttcattcttatgttggcgaaactcttctataatattaatcatttcattcctttcaaatttttacttatgataagccgaacctcgattaatcatttgtgcccgataaatttgttctactaaaaccagacgcatcagttgatgagggagtgtcattcgcccaaaagaaatttgcaaatcacttcgttgataaacttcctttgaaagtcctaaagaacctccaattacaaaaacaagatttcctgttccgtaaacttcagctttcttcacaaaatcagccacttcctctgatgacattaattttccttgaatggctaaaatcgctaactgatctcctgcttgaatccgtgataaaattttctcaccttcacgttttttcaatgcctctgcttctttttcggaagcattatctggaattttttcatctgctagctcaataatttcaagtggcagcatcgttcccattcgtttaacatattcagcaattccatcttttaaatacttttctttaagttttccaacaactactaatttaatcttcatttttatttttctctctaaattaaaactttattacttaaaaattaacaacttttccccagttttttgattacttttacactttcaggaataaaaacatttataaattcttaaatttattttataattttacccttttcccccattgaaaacaagatgaaaacatgatttatcaacatttttttacttttttccacttttctgtggaaaactttattaaaatatccacttatcctcattaattttaagattatccacaaaaatgtggagaaactatattagtttgatttttgttactattaaggtattattaagtgagagtagatataattacatcatagaaatgctacaaagaataataattgaaaggaattatttatggcaaaagctaatataggaaaattgctattaacaggtgtcgtgggcggagccatcgcacttggaggaagtgcaatctatcaaagcactacaaatcaatcggcaaataatagtcgctcaaatacaactagtacaaaggttagtaacgtttcggtaaatgtcaataccgatgttacctctgcaattaaaaaagtttcaaattctgtcgtttctgttatgaattatcaaaaagataactcacaaagtagtgacttcagttcaatttttggtggaaatagcggttcaagttcatcgactgatggcttacagctttctagtgaaggctctggtgtcatctacaaaaaatctggtggagatgcctacgttgtaactaactaccacgttattgctggtaatagctcacttgatgttctgctttctggtggacaaaaagtcaaagcttctgtggttggttatgatgaatacacggaccttgctgttcttaaaatcagttctgaacatgtcaaagatgtggcgacattcgctgattctagtaaattaacaattggtgaacctgccattgccgttggctcacctttaggtagtcaatttgctaacactgcaactgaaggaattttatctgcaacaagccgtcaagtgactttgacccaagaaaatggtcaaacaactaatatcaatgcaattcaaacagatgctgccattaaccctggtaactctggaggggctttgattaatattgaaggacaagttattggaattactcaaagtaaaattacaacaactgaagacggttctacttctgtcgaaggtttaggatttgcgattccttctaatgatgtcgtaaatatcattaataaacttgaagcggatggtaaaatttcacgccctgctttaggtatccgaatggttgacctttcacaattatcaacaaatgacagttcacaattgaaattaccaagtagtgtaacaggtggggttgttgtttactccgtccaatctggacttcctgctgcctcagctggtttgaaagctggagatgtaattacaaaggttggcgatacagcagtaacttcttcaacagacttgcaaagtgctctttactcacacaatatcaatgatacagtaaaagttacttattatcgtgatggtaaatcaaatacagcagatgttaaactttctaaatcaaccagtgacttagaaacaagcagttcatcttcttctaattaataacttaataatttaataaaagtcttctgtaaatagaagacttttttcatactaaagtctgaaatttttaaaaataataaatttccatttttcttttattgatttatggtaaaataaagttaagcatgaaaattttactttacttagaagccgaacaatttttgagtcattcaggaattggtcgtgcaatgaaacatcaacaacgcgcccttgatttaatgggcattgactggacaaaaaatcctgaggatgattatgatatcctccatttaaatacttatggctttagcagttggaaaatgttaaagaaagcaaaaaaagctggaaaaaaagtaatctttcatggtcattcgaccaaagaagattttcaaaattcctttattggctcaaatattgctgctcctttctttaaacaatatttaatgcacttttatcgtgctgctgatttagtcattacaccaactgattattctgctagtttgctccgttcttacggaattaaatgtccaatcttacctatttcaaacggaattgatttgactaaatattctcgaagtgaagccaaagagaaagccttccgtgagtatttttcactaacagctgaccaaaaagttgtcgtgacagctgccctttattttaaacgtaaagggatagatgattttattaaagtggctgaaagaatgcccgatgtgactttcatttggtttggttatcaaaatctttggactattcctggttggattcgtcgaattgttaagaaaaatcatccgaaaaatgttcttttcccaggttatatcaagggagatatttttgaaggagctatgtcttctgcagatgccttctttttcccttctcgagaagaaactgaaggaatcgttgttcttgaagcacttgctagtcaccaaaaaactgtcgttcgagacatcccagtttatcatggctggcttgattcaacttgtgtaagtatggcaacagatgttgaaggttttgtcaatcaacttcaggatgttttagatggaaaggttgacaagacaaaagaggcttatcaagtagctgaaagtcggacaattgaaaaagttgcccaacaattagctgatgcttatcagcaaactttagaactttaatttttaaaaattactgacagaaagaaaaagtagttgctgaccaagctgtcagtaaaattttcttactaaaatttttgtcagtaaaaaaataaaaaatttacagaaatataaacgggaatttatttatgagagttggactttttacagatagttactttccacaaatcagtggagtagcaacaagtattcgcactttggccctagagcttgaaaaattagggcatgaggttttcatttttacaacaacagatccaaatgctgatgtggaccacgaacgaaatattattcggctgcaatccattccttttgtgagcttagcagaacgtaaaattgtcctcaaaggtgtttttgctgcttatttaattgctaaagaatatgatttagatatcatccatacgcaaactgaatttggaatgggaattttaggtaaaatggttgctgctcaattacgcatccctgtcattcataccttacatactaagtatgaagattatgtttactacatcgccaaaggacgcttaatccgtccaagtatggttaaatacattattcgtaatttcctgcgtggaactgaagcgattatttgtccaagcgaaatggttttggaaactgtcaatagttatggtgtcactcttcctaaacgtgtcattccaacaggaattgaaattgaccgttttaaacgtgatgacattaaacctgaagaaacagcaaaattaagagtcgagcttggtcttgcagaaaatgaaatcatgttgctcagtctctcacggattgcggctgaaaaaaatatccaagcagtgattcatgcattaccagatattttagaagagtttcccgtgaaacttgtaatcgttggtcatggcccatatgccgaaaatcttaaagaattagttaaagaacttgaacttactgataaagttgtcttcacaggcccagttgaaaatgagaaaacagcctattattataaagctgctgacttcttcatttctgcttctacttcagaaacccaaggcttgacttatcttgaagcaatggcagcagggacaagagtcctagctgctaaaaatccttatttgtctgaattaattaatgacgatgaattcggacaactcttcattggtgatgatgatttagctgaagttaccaaaaaggcaattcgtgatttacatcccattgataaagataaatttgaaaagaaactttatgaaatttcagcggaaaattttgctaaaaaagtttatctcttctatattgacaccattattgaatacaataaccttaagtctattgaggcggaacgttttccaatgaaaatggaagataccattcgtcaaatgccagttactgttaaacgttcacttaaaagagaacaaattcgagcaaaatattttgccagaaaagccagtaaacttgccaaaaatctacaaagttatgttaaaatagataaggacaaagaacaggactaatggggtcaatcctaagaactgtccctttgaaaaacaattggaagtaaaaaacaattttataaaaacagagttttgctttgcagaacaccgaaaggaatttttaagaaatgaaatcacatttgttagcaattatgaatcgcttaaaccgtttggttgaaggtggtgacccaaaagaaacttataattttgaacgtgaaggcgaagtaatgcttactgtaagttacagtccagaagatgaagcttttgctttgcgttatcctaaacaaaaagatgcttcattgttcgatgatatcgaccttgttgccattgaaatttatgatatgatttattaaaaagttactgatgaaaagattaggataaacctaagagctttcatcagtatttttttatcttaattctaacatttcttaaatgttgttgaacttttacattttttatagtagaatatcaataaaatacaattggagaggtttatgaaaaagaaaatttggatgtccttgggacttgctgcacttgcagttttttccctttctgcttgctcaactaaaaactctgatgaggccaaaaaagcttttatttcagatacagttgccttgaataattctaaagactataattctcaaaaagtaaaagttgatgttaatgaattcaaaattcatggtggtggagataattctgaattcaacaagatttttaacaagggtgctggactcgattttaatattggacttgataagactaaccaacttgcagttcttgatggaaaattgacagtcgctaaaaaagattatgatttaggatttatgatgtcacaaaaagggctttatattagtagttcagacattaaatcactttatgataacaataaagatttaattccaagttctgccgaagatacggctacaatttacggagctatgattgatagtctcaataaatcatatttgctgattgattcgcaaacgcttgattcaaatgttcaatcttctaaagataactgggaatcaacgcttaagcaactttttgaatcaaattcaaaaatgagtgaagctgatttagagaagcaatataaagagattcccaattctgatttcaccaaatctggaaataaagtgactgtggaattttctggtaaagatattgacctcaatgatttaatcaataatttgagtgctacttattctattcctaaagaacaaacagagcgattaatcaaagaaagtaaaaatattgatatcagcaaactttctattaaattaactgtagataaaaaatctcatgaaatgactggaaaactgactggtagtatttctaatacaaaagaaaaaacaaatgctgatcttgacatttctttagcctcaacgcgtggcaaactaaaagaaacccttaaagagcccgctgctacagacactaatacactcgaagaagtgcaaaatgcagccattgaaaagttaatggcgcaagcaagtgcgatttaataaaaaagttactgacagaaatttctgtcagtaactttttttaatgttttccataataaatttcatcaatttcatcagtgtaagttccgtcatcattatgaacaatcaaaggcggtaagaaaatttcgcccccttctttgccgtctttaatcgcatcaatcaataaaatatttgctggttgattttccttaggataaacaaattgaatccatttaggttgcaaattattagaacgcattttgtctacaatttctaaaaaacgctctggtctatgaaccatggcaatgtgtccgtttgttttgagtaattttttactgacagaaaaaatttcatccagatttgtcgtcaattcatgacgggccaaagtataatgcttactttcatttaaatgactttcatctgaatccactttaaaataaggtggattacaaaaaatcaaatctgcacttgaagtatgaagatggtcaagcgctcgattaagattatcattaatgacagacattctgtcagtaagtccattgagttcaattgagcgagttgccatatcagccaaacgttcttgaatctctaattcaataatttgagcatttgttttagaactcgcaaaaagtccgacagctccatttcccgcacataaatctacaattttaccccgttttggtaagcgcggaaaacgagctaacaaaatcgcatcaatgctaaaagaaaaaacctctcggctttgaataatttttaccccactgctggcgatttcatcaattctctcatccatgttcaattcgatattttccataattttattataacacagccagtaaggcgaaacaaaatttcgtgctgttgactctccgtctaattactatttcgctcccttcgtcagctgaattgtccatactctctacgacagtaaactgccaagttctagtggcaatcaagtcccatcgggcttagcgggttgcctttctactaatccgaaaaagggtgaagatacgggcaatgagtattttaacatagcccctaacctttcttctaacagtacccgttaaaaaacgataatcagccccagctaattatcgtttttatttattttgtcaataaacgtgaagaagtgagcagtttaattctatcaataatctttattatttagcttcataccaagttttaccagtattttcatccacttttaatgggacagcaagttcaatcgcttcttccatcgtttgttttaccaatgccttaatttcatctaattcccctaaaggaacatcaaggataatttcatcgtgtacttgcaataataattttgatttaaaatcacgagcactcaaagctttatccaaattaatcatcgcaatttttaagatatcagctgccgaaccttgaattggtgagttaatagccgtccgttctgcaaaaccacgaacattaaaattacgagcattaatatctggaatcttacgacgacggtgactcattgtttcaacaaaacctttgtctcgtgcctcgcgaacaatattttccatataggttttaatcccaggataacgttcaaaataagtttcaatgtaatttttagcatcttttcttgtaattccaagatttcttgctaaaccaaaatcggaaattccatagactactccaaaattgactgctttagcatttctacgatcattagcagtcacatcttctgctttttcaatgcagaaaacacgcatagccgttgaagtatggatatcagctccatgtttaaaggcatcaattaaatgttcatccccagaaatatgtgccaaaacccgcaattcaatttgtgaatagtcagaactcaataaaagcgaatctttgcttgggacaaaagctttacgaatttttcgtccctcctcaagtcgaacaggaatattttgtaaattcgggtcaactgagctcaaacgtccagtttgagtcaaatcttgaacataacgtgtatgaatttttccatcatcagcaatttgaggaatcagacctttcacataagttgattgtactttattgatttgacgatattccaaaatttttgctacaacgggagataaagcagctaaatcttctaaaacatccactgccgttgaatagcctgtttttgtcttctttccaaccggtagctgtaatttttcaaataaaatcacacccaactgttttggtgaattaatattaaattcttcaccagccaagtcgtaaatttcacgcgtcaaagaagccaatttttcttcattttccgcaccaatttcttccagtgtattttggctgacagcaatccctgtaatctccatttttgctaaaacttctgctaatggtaattccatatcagccaaaaggtgttcttgttcattttcaagcaattcagccatcattttttctttggccaaggcaagcactttaattttacgagctaaatgttcaaataaaaccgcgtcatcaggtaaagcaatttttgtacctttgccaaaaacttcttcatccgttgccaaatgtccgctattgaaaagtcttgcaatcgtcgaaattttattatcttctgttgttgaaattagatattttgcaagcattgcatcaaatttgaccaaaggtaattcgatatccaagtgactcaaaagtacccgatttttcttgaaatcataagtattttcggggaacttcatttttgtcagtaaatctatatttttagaaacataaattttctcagcatttccccaggcaaaagccacaatttgctcacgatgataattttcccctaaagtttccaaatagaagaaatcatcagcatttaccttttcactgatagagccatcagtaactatttcaaaatcaatttcgtcaacaactttttcgtcagtaacttctccaccagcctcagccaataatttacttttgaattgagcaaatcccatttcatcataaaattgactaagttcatcaacctttttaccttttaaaagcgtatcatctaagccaatttcaattggagctttcgtatttatcgttgccaattgttgtgacaaaaaagccatttctttgtcagcaattagattttctttcattttgctggctttcaaagaatcaacattttcatagagattttcaagtgacccaaactcttgcaaaagtttaagaccagttttttcgccaacttttgtcacgccagggtaattatcagaagaatcgcccattaatgcttttaaatcaataaattgagctggagtcaatcccattttttctaaaagataatcaggtgtaaactcctcaaactcagcaacccccttcttagaaatttcaactcgcgtatttccatccacaagctgaatcatatccttatcacccgtcacaatagtaacatcaaaattaacatctggggcttccgccattttgtccaaagtcccaataatatcatcagcctcatagttagctaactcataatggcgaattcccaattcctcaatcatttccttgataaaaggtaattgctcacgaaattcatctggtgtttttgaacgtccgcctttatagtcagcaaacatttccgtacgaaaagttgtttttcctgcatcaaatgcaatcaaaacatgtgtgggctcaatccgttccatcaaagaagaaagcattgtatgaaatgcaaaaatagcattagtatgtaacccatttggcgctttaaagcgatctatctgattatatagcgcaaaaaaggcccgaaaggcaaccgatgacccatcaattagtaaaagtctgtccttgttctccattttatttcctatctcttccatatttctatacttttacccattcatctaagtaaatattatcttaaaacacataaaaacgagctttactaaattataacattttcaccccttcttttggaactgctcaactttaagcatggtcattcaattattttaaaaataaataatcaataatccttgacatggaacgcgttccataatttaaaatagacttaatcaaacaaaggagcttaatcacatgaaaattaaacacatttttacagatatggatggaacattacttgactcacacggaagtgtatcagacactaaccactggtctatttattacagtgaccttccaatcacattagtttcagcccgtagtcccttggaaatgagcaatattgtagaaaaattacaactaacaacgcctcaaatcgcatttaacggaaacctaaccttcacccaaaatcaatttggactacaaattattgataaaaatcccctagcttcagaaaccgtctcacaactattaaattacatctcaacagaatttcccaatgtcagcttaaattggtacagtcttgctcactggtacattaacaaacaagacaaaggaacctttatccaaaaagcaataacaggtatagaacctaaaatcaaagcctttgatagtcaatcagaaatatataaaataatgatgattgtctttgattctcaagaactcttacaacttcaagctcaactaaataatctaaacatccccaatatttcagttcaacaaagcggacaatggtatttagaaattacatctaataataaaacaaaagccgacgctgtacaatcaatacttgataataaaaatttagactttcaggaaattgccgctattggtgatggtcataatgatattccacttctccaatcagctggactatctatcgccgtagataatgctaactccgaggtcaaaaaacatgttaaaatggttgtagcaaaaaatactgaacatggtgttgctgaagcaatatcagctattaataccattaacgaacaggtgatataatgacctctttatccgatttatcgaaacttagcggctattcaaaagctaccatctctcgtgccctttctgggaatggctatgtttcaaaagaaacacgtaaaattattttggacttagctaaagaacttgactatactcccaatgcaatcgcacaggatttatcggctggtacaacaaaaaatatcggagttgtcctcccctacgtcaagcatccgttttttgggcaaatattagaaggaattctggataaaagttttgaaaccggttataaaatcgtcatcctcccttcaaattatgaccaaaatctagaaattcaatacttagaacaactccgaaaaaaagcatttgaagcattaatttttacctcaagggaagtttctgaacaaaccgttcataaataccaaaaatatggctcaattattttatgccataaacctaaaagtaaaaaaatagccgccagttatgcagaaagaaaaattggatatcgaaaagctctagaatggctccaagaacaaaattgtaataatattgggtttctctttgcacgttataaaagtccaactacatctgttactctccaaacctataaagaaatatacgaagaaaaagtaagagatgaacaaataaaaacgggtgcagtatcttcagcagacggttacaaattggggccccaacttacacaatttgatgcaatatttgcaaattctgatgatattgctgctaatgtttggcattggtttgaacaacaaaaaatacctaaacctgttattattggccaagaatcattaatatctggtcaggttctcaatattccaaccgtaaataatcactttcaacaagtaggacgttgcgcatttgaattggctatttccaaagaaattcagcaactagcaattaaatcagagtttattctaaatcgtagtttggaagggtagcgaagaggctaaacgcggcggactgtaaatccgctccttcgggttcgggggttcgaatccctccccttccatagaaaacgggcatcgtataaaggtagtacaaaggtctccaaaacctttagtgtgggttcaattcctgctgcccgtgtttcattatggcggatgtggtgaagtggttaacacaccggcttgtggcgccggcactcgcgagttcgatcctcgtcatccgccttttaatggggtatagccaagcggtaaggcaagggactttgactccctcatgcgttggttcgaatccagctaccccagttgttatgtttcgccgaagtggcggaataggcagacgcgccagactcaaaatctggttccttcacgggagtgccggttcgaccccggccttcggcataacataaaagctaacatgcctattgttagctttttttatataattaattagattattttatagttaataaaaactactgaaaactattgaattcggtagttttttattatattaaataagtttttgaaatcaggagaagcgtaaagcctgaactgagaagcttgctccagcaatgataaaaatatagccaataatcaaggatttgagaatatttccgtcgccatgaacgattagaggaatcaaaaatcctgctaagcacagaattggggtccatgttctagttgctagattatgccaagctaaatagaaaattaatagtgaaagaatcgtccctacagctagaagtaaaatcagtagtgtagagttgattgctgttaaattcccatttatccagaagacaccatgttttagtatctcatccacctttcctcggtaagtcccatctatatcatacctttgccaatctactttaaaaaatgtgtggttaaaaataatataagtgatggtaataattagtgaaaggatagaatatagtaataagatccatcttttaatattatttggtttgtttataaaaattttcatagttctccttaattataaaaaacgatatattcaaactattttgaatatatagcataatattagcacttgatcaataacatgtcaaagaagtttgtgtatttttaatataaatgctattatttaatcaaacgtagtatgtataatgagtttcatctaatgaaaaaatagataaactgacctatttataataggtcagttttattttatagtaaggttttattcaaaatccagacctgttatattttttgaaatctgccaaagtctatctgcgtcattgtggtctactgcatgcggacgtaagcctccagaaaaattattagcttcttctgatgtcataagtctggcaatattaaggtcttcacaataaagcccacacttaccttctaaatcagggcttgttgaggcccaaagaggtgtttcggcaccttgagctattgtttttaaatagcgatatttacttcggtcaaagccggatttaagtgcattaaaaaatacggggatatgaattaatttaaaatagtcggctaggtagcggagccaaggggtaataggtgaattttgacgaccaatatttgtcattggaatcataccagggtggacggcaaaacttctaattccatatttttttcctagttcatctagttttattgaaaataaaacgttggcagttttagattgttggtagcctatttggggattatagttttctattttttcaaaattccaatcttctagtaatggtgtcatttgttgagcacgactggataaatttataactcttgagatttttgcattttttaaagcgggtaaaagttccattgttaattgatagtggcctagatggtttgtggcaaagtgatattctattcctcgagaatctctttttaaaggaaggtacattaatccagcggaattaataagaatatctagttttgaattattttgcaaataactttcggcaaattgatgaatactttctggattggtgaggtcaaggggaagaatgtcaatattttttattttagataaatttttcttggctacctccattcttcgggcggggataataatttttgctccagcacgtgaaagttgtttggtcatctctaaaccaataccagaatacccaccagtgatgatgattgtttttcctgaaagattaatatttttcataactttatttgctgttgttttataattaaatttgtagtttgctattggttcttgatttgacataataaaattttcctttgtgttataatatttatgtgatacaagtgtaacagcaaaaaagaacttttacaattaactttggacggtttgtctttaaaagtgacaacaaaatgaaagtgtaacagaaatgaagcgaaaagagcaatatcaagattttcatgactttattattgaaggaatgatgttgtgtttagagaaatatacaatcaatgaattgccattgacagaagtttgcaaaaaagccggggtgagtcggatgactttctatcggcacttcaaaaataaggaagaagtcgtattagagtattttgagctaatctatgataaatttctcaaagaacttttggagctagaaagtattaactcacttattttaagtgagaagttggtgggactatttgttgaacaagaagaagaaatagaaaaagctgtcaaggggaattattattcgctgatttttcaggtatttgctcaaaagatgactattttttataatgaaacaacgacttgggctgattatctagggacaaagcaaaaattttggaacgattttatggctgctggtttattttatgttttaggaaattgggtgaaaaatggctgtcaagactcttatgatgaagtggtgaagatggttgtagaattccatgaacaagtgaacagataaaaaggctcaagttattttgagcctttcttttagccaataaattttttcccttgtttattaagaatcactttcgtaatttcaatgacaagggttgggattaaagctaagatgatagctatcagccagtgtgtcattgataaaggagcaacttctaggatgttcatcaaaattggaacatttgtaaagagaacggttattcctagtgataataaggtggtaccaaaaatcattttattagtggtaattcctcttgtgaagagagattcattacttctagcattatagatatttattgtagaagcaagggttaatatcacaaaggccattgtttgtccgagttgatggttgggtgtcaatccagcgatttcaataaacctaccgagataaaaaccaactagagcagtaatgatgaatgcagtggaacaaatggcgatacgccagctgacccctcttgagaagatactttctttgactccaacaggtggttgttccatgatatgactgtcggctttttcacgtgaaagtccaaatccgggaattccatcagcaaggacattgatgtaaaggagttgaattcctgtaaaaggcattccccaaccgacaattgctccaatgagcattgttagaatttcagctacgtttgctgagagaaggtaataaattgtttttttgatattggtgtaaacgcgacgtccttcgcgaatggcagcgacgatggtcgcaaaattgtcgtcagcaagaatgatatcagaagcggattttgcaacttctgttccagctattcccattgcagttccgacatcggcagctcttaagctgggtgcgtcattgaccccgtctcctgtcatggcgacgatttgttctttttcttgccagatttttacaatacgaagtttgtcttcaggacttactcgggcatagaccgaaatttgttcaatcatttggctaagttcatcatctgtcattgatttgagcgttaagccatcaataactttatctccgtcacgatagatgtcaatttgttgagcgattgcttttgctgtaagcgcgtggtcccctgtaatcatgattggtttaataccagcagcccttgcttcttgaacagcggcttttgattctaagcgtggagggtcaatcattcccacgattccaagaaaggtaagattattttctaattcagttaaatcttctgggactttatcgatgattttgtaagaaagagcaagaacacgtagggcttggtcagcaaaaatatcatgtattttttgggcttgactcaataaatcatttgataagtgagtggaagtctcctcgttatttgaagaaaggagctgtggatgctgtgcttgatgttgactgcttggttcaagtctatcaaaagcgcccttggtcagtacaagatatttttcattatcttgcggatgtggaatgacaacggtcatttttttgcgtgaactatcaaaagggagttcggcaagtcgttttggatttttttcgggttcatagaggtcatgagtaattaagaagcgaatgattgctgcttcggttgggtcaccatggatttcccaatcaccgtcaatgagttgtgcactggcgtttgaggcataagcaaaattttgtattaaggaaacttcagagcttgataattgacctcctgaccaactatcttgtccagatagccaaagtttttgaatggtcatctgattttgtgtgagtgttccggttttgtcagaagcgatgactgttgcgtttccaagggtttcaacggcagggacatttcggataatggcttttttctgagccatattttctacaccgtaaatcagactgagggtaacaataactggaagtgtttctggaacggcagctactcctaaaacaacggcggtcattaaattatcaacaaaaggaacgtttccatacaaaagattaatgacaaagattaatattccagcggcaaaggcaatgactgctaagcgtttggcaagtttatcgattcttttttgaagaggagtttttccttttatttgttcgccaataagtgtagcaatttgtcccatttgtgattcggaaccaactgcgacaacgattccttcggctgttccgttaaggatatttgttcctgagaaaaccatgttcagttgatctccaagaggaacttcgtcagtaatatcaaggtcagcattcttgtcaatgggttctgattcacctgtcagtgaagattcatcaacttgcaggctattacttgtgagtaagcgaatatcagctccaacttgtacaccggctgtcagctcaatgaggtcaccgcagactaattcacttgaaggaatagtttggcgttttccagaacgaataacagttgatgttggtgaggaaagctctttgagtgcagcgagtgcattttccgccctattttcttggaagattgaaacgaaaacgttgatggcaacgataagtaaaacaacaattgttttagtatagtttccattactgatataagccaaataggctgagagaacaccaactaaaataagaatgatattcatgacttctaagaggtgatgaagaagtttttgaaaaatatttgggccactttgttcttcaaggttattatgaccatattttattcgagaatttgtgacttgagttggactgagaccagttttactattaatatcatagaatttttttatattatcaatggattctgttttatatttcatattttttagccctttcttttggaaatttacactataatataattataatatatttttaataattcctagaacaatatgcaaataaaatttttacaaaagtctgtataattagccgaaaatatggtattatggatgatatgaaaactaaaacagtaagtgaattggcagagctttttggagtgactcgccaagcgatgaataaacgtgttaagtcgctagatactaaatttgttgaaaaaaatgagaagaatgtaacagtcgttaatgctgagggaattcatgaacttgagggactatacggaaaagtggtgactgccaaggcagaggttctggaagaaaatgctgacaaaggttctgaggttgcgcttaagacagatgatgcaacatccgcagcttacgaaatgattagcgctttgatgaaagataaaaacgctgagattgaacgtttaaacagtcaacttatctcaaaagatcaacaattaaacgtaaaagatgctcaaattgctgaaaaagatgtacagattaaaaaacagcaagagttaatggaaaaagctttgacagaccaaaaacaattttttacggatttgcaagaacagctaaaaaccactgacaataagggcttttttgggcgtttatttggtaagaaataaatcataaatttgctgagcgtttcatcagtaaatttttttattgctttttatagaggtggaagaagaaactattcttaaaagtacgagcttttttaatgttaaacgctttcaagagaagtggacttcttttgcttttgtagagcgctttctaagggagtttatgtttgcaaattttaaaaaaagtgttaaaataaaagagtaagttaaattgttaacttagtcaatttaaaaggtaagccttttataaaatctaatccctataaggaggaaactactaatggtagttaaagttggtattaacggtttcggtcgtatcggtcgtcttgctttccgtcgtattcaaaatgttgaaggtgttgaagttgttgcaatcaacgacttgacagatccagcaatgcttgctcacttgcttaaatacgatacaactcaaggacgttttgatggtaaagttgaagttaaagatggtggttttgaagttaacggtaaattcgttaaagttactgctgaatctaacccagctaacatcaactgggctgaagttggtgcagaaatcgttcttgaagcaactggtttcttcgcaactaaagaaaaagctgaacaacacttgcacgctaacggtgctaaaaaagttgttatcactgcacctggtggatctgatgttaaaacaatcgttttcaacactaaccacgaagtacttgatggaactgaaacagtaatttcagctggttcatgtacaactaactgtcttgctccaatggctgatactttgaacaaacaattcggtatcaaagttggtacaatgactacagttcacggttacactggtgaccaaatgactcttgatggcccacaccgtggtggagacttccgtcgcgcacgtgctgcagctgaaaacatcgtacctaactcaacaggtgctgctaaagctatcggtcttgtattgccagaacttcaaggtaaacttcaaggacatgctcaacgtgtaccagttccaactggttcattgactgaacttgttactatccttaacaaagaagttacagttgacgaaatcaacgcagctatgaaagctgcttcaaatgaatcattcggttacaacgaagaccaaatcgtttcatctgatatcgttggtatctcaaactcttcactctttgatgctactcaaactgaagttacttcagctgatggagctcaacttgttaaaactgtatcttggtacgataacgaaatgtcatacacttcaaaccttgttcgtacacttgcatacttcgctaaaatcgctaaataattttccgattttaacggtataaaaaccagtcttcgggctggttttttttgatttaataaaggagagaagatggaaacaccaaaatgtattcattgttcaagtgaatatacttatgaattatcagatacgagctttggctgttctgaatgtggaaatgaatttactcttgaggaaattgaggcagctggaaaatttattgtccttgatagtttaggaaatgagttagaaactggggatgaccttgttattgtacaagatttgccagttaagggaatgccaaaaccaattaagcagggaacaaaagtgaaaaacattcgcattaatccagaagggaaaaatgaacattttattgattcaaaaattccgggctttggagcaattgctttgaagggttcagttgttaagaaagcataaaaaataatcagagtaatttctgattatttttttactgacagagctttctgtcagtaaatttttaaattctctgtcagcaaattatatttgatttttgaagcatttaaccttatatattggtataataaaagtatgaaattaacagattcagtgcaatttttaaaaggtgtgggaccgaaatctgtggaaaatttccataagttaggaattttcacggttcaagatttattgctttatttcccttttcgttatgaagatttcgcaagtcgttcggtttttgaacttgttgacggagaaaaagcaacaattattggaacggtagtgacaccagctaatgtccagtattacggatttaaacgtaatcgactttcatttaaaattaaagaaggtgaggccgtggttgctgtcagcttttttaatcaaccttatttggctgacaaagtggaagttggtaaggaaattgcagtttacggaaaatgggagcaggcaaagcaacaactgatggggatgaaagttgtggctcaggtggacgatggcttagaacctgtttatcatttgacagctggtatgaaacaaagtcaattggtcaaagtaattcatcaggtttttgaatcagaccttctatcagaattacctgagaacttaccagaatttttgattaaaaaatatcgtctgatgaaccggcaagaagccgttttggctatgcattttcctgaagatatggaagctcataagcaggctttacgtcgtgtaaaatttgaagaattattcatgtttcagttgaaattacaggccttaaaaaataaagaaaagtcgggccgagcaggattagaagttgtttttgagcaaggagaaattgatcagaagatttctgaattaccttttgaactgacaggtgctcaattaagcgctttgtcagagattctgacggatatgaaatctccttatcacatgaatcgacttttgcaaggtgatgtgggttctggtaaaacagttgttgcttcccttgccatgtacgcggcttgtttggcgaattttcaagcagcaattatggtaccaacggaaatccttgcccgtcagcattttgcaaacttgaaagctctttttccagaattgcaaatttcacttttggtttcgggtttgaaagtggcagagcgccgcgagattttggctgatttagttagtggtcatacacatatggtagttggaactcatgcgctaattcaagaaggggttgatttttataatttgggtttggtgattacagacgaacaacaccgtttcggagtcaatcaacgaaaaattttacgagaaaaagggcaaaatccagatgttctaatgatgacagctacacccattccaagaacgcttgcgattacggcttttggggatatggatgtttcaattattgatgaactacccaagggacgtcaacccattactacaaggtgggtcaaacatgaacaattttccgaagttttaagttggataaaagcagaggttgctaaagattcacaggtttattttatttcacctttaattgaggaaagtgaaacgttggacctgaaaaacgcagaagctctttttgcggaattaaatgaatactttggattatttgccaaaattggtcttttacatggaaaaatgaaaaatgatgaaaaagaccaaatcatgcaagaatttaaggctaaaaaattagatattttggtttcaacaacagtgattgaagtgggagttgacgttcctaatgctaccattatggtgattatggatgctgaccgctttggactttcgcagcttcaccaattgcgtggtcgtgttggtcggggaacaaaaaaatcttatgccattttagtagcaaatcctaagtccgattcaggaaaacaacggatgaaaattatgacagaaacacaaaatggttttattttagctgaagaagatttgaaaatgcgtggttctggagagatttttggacttcgtcagtcaggacttccagaatttattgcggctgatttagtcaatgattataatattttagaagtggctagaaaagaagcagttgaaatttttaaaaatgcagatgagtttcctgatttgattgctcaagttagtgttgacgggggctttgattgatgagtaaaatggataatgaaaaattagaccacttgattttagaaacgtggacagattttatcgacttaaaaaataaagctgagctgtcagaagttttgattccaaatagtatgccacttttgtggtttggtgacttagccaaatatgaaaaatcagacttaaaaatactgacggtcagtaaaaatgcttcttatgcagaatttggtgaaaatcaacgttatgaaaaattactgacagaattttcgtcagtaaatttggaaacttacaagtcaaatctcaatcggtattttgaatacaatcctagtccttggttcaatcagttagcaaaatttttacctgtttttgattcagcttataaagaatctgaaaatcaaattaatcgagccttacacattgatttgtttaccccaattgcgacacatccagtttggccaggtttagctaagagccaacaagaacaattcaagatgaaatttccgcaacttttgcaacttttagaaccagatattttactgacaagtctgtcagtaagtaatttaaaaattttacttaaaaatgctggaactgaaatcgaagaaatatttgataaagaagaaataggaaaagctgccaaatacgttcgagcttatcgcgtcgataaaaaattaatcgtgattaacggtcgaaactttcaaggaacttattttggtggaatgactgaccagtttgttagaaaatgtctgacagaaattaaagggatgatttgatgattgaccaatttctgtcagtaaaaaaagagttcatttgaactcttttttattttcccaaacaaaattgtgaaaaaagttgtgtaatcaattcatctggggcagcttcccctgtgatttctccgagtaattgccaacaatgtgtgacatccacttgaattaaatcaacaggtaagcccagagcaagcccagagtttgcttctttaagagccttcaaagcttcttcaacaattgaaatgtggcgggcattagataataccgttgcatctttggcttctatttcaccggcaaagaaaatttgattgattttttcttcaacagcatttaagttttcatttttaagagctgaaattcggatataatcaccagaaatttgagtgctatcaattttttctggcaggtcggttttgttgagtagaacaatgcgatttgaatttttagacagttctaagagctctaaatctttgtcagtcaattcatttgaggcatctaaaacgagtaaaactaaatcagcttcagccaaagcttttttagaacgttcaaccccaatcgcttcgactaaatcatctgtttcacgaataccagcagtatccactagttcaagaggaacaccgccaatattggcaaattcagtaatgacatcgcgcgttgttccagcaatatcagtgacaatggctttttcttcacgaagcaattgattaagtaaacttgattttccaacgtttggccgaccaataatcgccgtttttaaaccttctcttaaaatttttccgcgtttagctgttgataaaagattttccaaaagctgttcaaaatgagccgttttttcaaggagcatttgtgaagtcattgtttccacatcatcatactctggatagtcaatattgacctcgacttgtgccaaactttcgagaatctcttgacgaatgttattaatcatttttgaaagactaccgtcaagttgttttacggcaatgttggcagccttatctgttttagctcgaattaaatccatcacagactcagcctgagccaagtcaattcgtccatttaaaaaggcacgtttggtaaattcgccaggttcagcgagtcttgcgccattacgtaaaagtaattgcaaaatttcttgtgtgactgcaattccaccatgcgtatttatttcaacaatatcctcgcgtgtaaatgttttaggcgcacgcatgactgaaaccatgacttcgtcaacgagacgttcttcttcaaaaatatggccataattaatcgtatggctagcaacttgagttaaattttttcctttatagacagattgagcaatttttagggcatctgtccctgataaacgaacaatggcaattgctccttcaccaagcggtgtggaaatcgccgcaatcgtatcaaattcttgtgttaatgtcataaagactattttaacgcaaaaaggctgaatttcctagcctatttaatttatttttttataaaaaataaaaatttataataattgagtttgcaccaataaaaagtgataaaaaaaataaattttgaagctgactaaaaatagaaacaaaaaattttctattttttcttcgcattttcccaatttatgctcacatcttgatataatagtagatatgacctatcaagtaaaaattatctatccaaaagaagaagccgctgaaaataacaaactcactgagcgtacatttaatgagtttattgatggactcgaattagaagaagtcatcacgcaatatgagcaattactgacaaaaggttattcaatctcagtcaattttgctccacctcaacttgatgacaagggaactgagccagacccatttatgattgcgggtcgcttagagcttgctgggattccttataaagccactttgaaattaaaagcaagtggtgattatgaatcaatggtaaaaattgctaaaatgattgaacagcaagattatgattatgatatctcagctaaattgcaaattcgtgaaaattcatcagttgattttgaaaaagaaggttcttggtttgataaagattacaccaaatatacaattttacccaaagccagcagccaagatattgccgatttaaaaacactttatgacgcacttgttgaagaacatcaaaaagtgaccattaatatcaaagcaaaagtcaaaaaagatgatgatgacagttttgccaatcaattggcagcatatccaccagaaacaatgattatttttaagctgacagatgcagatatttatggagaataagaatgagaaaaattactgacagaaattccgtcagtaatttttttaattctgtcagtaactttttttccattattttactgacagacctgtcagcaaaatctgatataataaaagacatgagactagataaatttttagcagaaagtggcctcggaagccgtagtgaagtcaaaattctattgaaaaaagggcgcgtgacggttgctggggaagttcagcgagacggcaggtttcaagtagataagaattctagacaagtcgcctttgatggtgagattttagattaccaagaatattattattacttattaaataaaccgcaaggtcttgtttctgcaacaaaagataatctttttaagacagttgttcaattattatcggaaaaagattttcgtgaggatatttttccagtcggacgtttagataaaaatactgagggacttttaattttaacgaatgacggagcattgggacatgatttaactcaacccaaaaagcatgttgaaaaagaatactttgcgcgaattgatggaaaagttactgacgaaattgtcaataaatttgctgagggcttgactctaaaaaatggagaaaaagcacgaccaggagaattattcattgaaagtatttacaaaggggagagtcaatctggctggattagtgaaattcgtgtgattattcatgaaggaaaatttcatcaagtcaaacggatgtttgaagctgttgaaatgtacgttctctatctcaaacgcattcggatgggcaatttagcattggattcagatttagcgctaggagcctatcgtcctttaacaaccgaagaaatagaaaatttgaaaaaataaaaagttactgataaaaattcgaaggtatccgtaagttaaaaaacaacggctatcctagaagtttcatcagtaacttttttaattttcgcgattaatattgaccccaaggacggtcaaatggccattagaaattaatttgataatcaaatgagcaaaatctcgagcagacatttgggtagaagtgctgacccaccagtctaaagttcccaccaaaatcgagctgatataagaaattacaaaatcattgggaaccacaacatctttttctctaacttccagtttttcaaataactcggtatagcgttcagataaaatctccagaaatcgattttttaaccgttgatcatgcgctctgtcagtaatcatttgtgcaacctctggtttgtccttaacaaattcataaaagcgactcagaacagtttcaatttctttgacatgaacattgttaccatcgaccaaattttgttcatctaaaatgccagtgaagctagctaaaaattggtcaatcaaactatcatataaatcttgtttgtcagcataatgagcataaaaagttgcccgattaatcatggctgaatcggcaatttcttgaattgaaatcttttcaaattttttcttgcgtaacaaaccaaaaaaagcctgactaatcaattttcttgttcgtttcacacgtaaatcatctgatttaaccataaaaaaccatctttccagtttcaaaaagacccagtcccaatagactgttttgtctaatttttcacattgtactatttaactccattataatcaaaaaatagattaaagtcattaaagaatttagtcaaaagattttgtcattcgatgtcaaagtcttttaacataatcaacagcttgttttgaattgtcgtttatgtgacaaccacgccctttttgctggttgcttttcttatgacaaatgataaaatgaacatataataagataagcaacagaccgtctaaattactttttatcaaaattctgcgtccaaaagataagttagatttcaaatttaacttgccgaaaaaatattaagagcttagcggacttgttcaagtgatatttctcacataactaggagaccatcttgacacaaatttataaaacagggattgacgttggatcaaccacagtaaaactcgtcgtttttgacgaaaattttaagctcattttctcacgctatgagcgccatttttcagatgtgaaagcagcaaccatcaaagtattcaaagattttatagaagaacatggagatttaaatctagaactagccattaccggctcaggaggaatgggacttgcagaagtcattgatgttccttttgttcaagaagttatcgcttcatcaattaccattgaaaaattcattccccaaacagacgtgatgattgagcttggtggtgaagatgccaagatgaccttttttgataacgggactcaagaattacgtatgaacggaacatgtgccggtgggacaggtgctttcattgaccaaatggcagcccttttgaaagttgatgccaatggtgtcaatgagttagctaaaaactacgaaaaactctatccgatagcatcacgctgtggcgtttttgccaagaccgacgttcaaccgctgttaaatgaaggagtgcgtcgtgaagatattgctgctagtatttttcaagccgttgtcaatcaaaccattgcaggtttagcaagtgggcgaaaaatcaaaggaaatgtagcctttctaggcggtccgcttttctttatgagtgaattacgcaaacgtttcatcgaaaccttggatttaaaagaagaaaatattatcttcccagaaaatccacaactttttgtggcaatgggagctgcgctctatgaagaaacaagtcagaaaacagcaactgatttaattcatagtttagaaaatgatgattcagacagcttaattccacaagatacaatggataaactttttgaaaatcaagcagaacttgatgaatttcggacgcgtcatgccaaagcaacagctaactataagagcctgtctgaacatcatggagctgccttcttaggaattgatgccggctcaaccacaacaaaagttgttcttattgatgatgaaggaaatattctttatgaccattatggttctaacaatggagaaccgcttgaatctgtcattaatattttaaaagatgtctatgctaaacttccagcggacgtctatattgcaaaatcaacagtaactggttatggagaacacctgattaaagcaggacttcatgttgattatggtgaagttgaaacaatggcccattataaggccgctgattatttcaatccaggagtagatttcattcttgatattggtggacaagatatgaaagctatgcgaattcgtgatggtgctctatcaagtattcaacttaatgaagcttgttcatcaggttgcggttcattcattgaaacctttgcccattcactaaaacatgatgttcgtgaattttcacaaaaagcacttttggctgagcatccagttaacttgggttctcgttgtaccgtcttcatgaactcaaaagtaaaacaagttcaaaaagaaggagcgactgtcggagatatatccgcaggcctttcatacagtgtcattaaaaatgccctctataaagttataaaagtaaaacgtccagaagaacttggtaagaaaatcgttgttcaagggggaacattttacaatgaagccgttctacgtgcttttgaaaaaatttctgagcgcgaagtggttcgtccaagtatcgctggactaatgggagcttatggttgtgctttgatttccctagataaccaagaagcaaataaagaatcagaaattctaaaacttgatgaattagaaaaattcacaactcataaagaatttatggtctgtggtctttgcgaaaataactgtaaaatgaccctaacggtctttaatgatgggaataagtttgtaactgggaaccgttgcgaacgtggtgccgaaaaagctacaaaagttaaagtcgctaaaaaagataaaaaagttaacttagttgattacaagtataaaaaacttttccgttaccatagcttaagcaagaaaaaacaaaccagaggagaaattgggataccacgtgtactcaatatgtatgaaaactatccgctttggcacacgatgctgacagaccttggattccgtgttgttttaagccctcgctctgataaagaactctttgaagaaggaattgaaaccattccttcagatacggtatgctatccagccaaaatgagtcatggacatattatggctttgattaagcagggcgttccaaatatcttctatccatctgtcctttttgaacaagaagaacaaaaaaatgctcaaaaccattttaactgtccgattgtgcaatcttaccctgaagttcttaaaaataatatcgatgaaattcgtgaagggcaagttaattatcttcatcctttcattaatctagccaatccggaaggagtagctgttaatgttcataaggctttaaccgcccaagggatttctgtcaatcttacggaagtacaagctgctgtccaacatggctttgaagaaatggataaatttaaagaagatttgcgtcttaaagctgaagagttgctcatgcaaattaatttaaataatgaaaaagccattgttctcgctggacgtccttatcatttggacccagaaatcaatcatggaattgctgacatcatcactcaagaagatttccacgttttgtctgaggattctattagtcatttagccgaagtttctggtctgcgtgtggttaatcaatgggtttaccatagccgcctttatgcagctgcaaatgttgtttgtaaaaataaaaatctagaacttgttcaacttaattcctttggttgtggtcttgatgccgtaacgacagaccaagtagaagaaatcatgcgtggacacaataagctttataccgtcttgaaaattgacgaaggatcaaacatgggagctgttcggattcgtttacgtagtctgaaagcagcagtttcagagcgcgtgcgtcataatattgaagcaagcaccgaagttcacgaattagtacaagaaacaccagctttcacaaaagaaatggctaaaaaacacactcttcttttaccaatgttgtcaccaattcaccaagaagggctattagatacagcttttgccgctgcgggatataatgtcgtttctctaccagaaagcaatacttctgtcaataatgggttgaaatttgttaataatgactcatgttatccagcgattattacaataggtcagctcattgaagctcttcagtcaggagaatatgaccttgataatacttcggtcatgatgactcaaacaggtgggggatgtcgcgcaacaaactatattcctttattgcgtaaagccctaattgatgcaggtttcccacaagtacctgttgtttccctatcaatgggtaatcaaggaacagaaaaaggatttaaattcacagttccacttttaacacgctttatgattgcagttctttatggagatttatttgaaagagtcgtttatcgcactcgaccatatgaagccattgaaggttctgtcaatgaattacatgcgaaatggttagaaaaagctcggaaaaatgtagaatctggatcaatttttgaatttaatcgtaacatgaaaaaaattgttgctgaatttgaccaaattgaacttttggatattcaaaaaccacgagtgggtgttgtcggtgaaattttggttaaatatagtaaaacagcaaatgatgatattgtgtcaataattgaagaagagggcggcgaagcagttgttcttgatttaattggcttcatgaactatagcttgtacaatcaaatctggaaagcagatgagattggctttagtaagaaaaataaactcatggctaaaactttcattggtattattaatatgttagaaaaaccaatgaataaagccttgaaagcctcaaaacgctttgactccattgaatcaatatacgatattgcagcatcaactgaagaagtgatttcaattgggaatcatactggtgagggttggttcctcactggcgaaatgattgaactcttgcaaaaaggggtgaacaatatcatttgtcttcaaccatttggttgtcttcctaaccatatcgttggtaaaggaatgatgaaagaacttcgtcgtcagtacccaggagccaatctcgctcccattgattatgacccaggagtttctgcggtcaatcaattgaatcggattcgtttaatgatgaccacggctaaaaagagaatgaacactacttccaattcagtcgaagaatcagaaagagagtcagaaatggaaactgctcaagcttattaaagaataaagattaaatactgacaaatctgtcagtatttttttatataaagagtaacaaatgttatcaatgatagatatcaatgcttgatatcaaaaattgtggtcgcgcttcgtatcgcttttgtttaaaataattgagtaacttaaaaacatttgagaacaacaagattcccgtttctcaaaaatagaaattattgttaattaagaaaggaatttcgaaatgaaatttgaatttaaaggactttcttcatatgaagaaaattcaacaccaaactatgtaggcgatactaaagtacgcagtgtcattcaagacttcgttaacatggatgaagcaattgaatttgtttcaaatcaccacggttttataaaaactgaagatggaaaatttgcttttgaagtaagaaatatctcagctatcggttaattagataaggacagttagcatggaacaaaaatattcaagaattttagttggtatggatggttcagcagaatcacttaaagcgtttgatgaagcagttagagttgctaagcgcaatgacgctgagctcatcttagccaacgttattgaaaaacgttcatttcttgccgtgaatacttacgacacaattgccgaagaacagcatgaaaatggaacaaaacttttattgcaacaatttgctaaggaagcattggatgaaggactaacaaatgttagaacacttttggaatatggctcacctaaagtagcaatggcaacaaaaattcctaagcaagaaaatgttgatttgattgtaattggcgcaacagggattagttatatagagcgtgtagttgttggttcagttgcatcttatattgttaatcatgccacatgcaatacactcatcgttagaaaataatagtcttacttagtcactcataaaaagagcagagactcttttacttagaaatggaaaaaatcatgaaaaaagaaagtatttttactcctactttcgttattaacacgcttattagttttttattttatattgttttttatgtcttaacctcctcaatagggacttatgcgcttcaacaacttcatcaatcaacagttgttagtctttctttatcaagcgtttttgttattggagcccttattggtcgagtttggacggggattaatatcacacgtatcggaatgaagcgattgctctatattggtggacttatttttcttgttttaacttttggttattatttgacaactaatattcccttactctttttgattcgagtgattcaaggagcaggttttgggattggtgcaacagcctcagggacaattgcaggacatgttgtccctgcttcacgtcgtggtgaagggattggttactacgctttatctgttaccttggcagctgcagttggtcctgccctttcaatcatgatttactcttcacttggttttggttctttacttggaattgctcttggtttgttggttattaccttcatattaattttctttgttcgtgtcaaagaattttctgcagaagagcgtgcctatgccctggcgcatgagcctaaaggtgtcgaacgatatattgaaaaatcggccctccctatttcaattattgcctttttagccggatttattgactcagctattttaacaggaatgggttcattttcaacagatcttaaaattccacttgcgggatcattgttcttcacgatgtatgccgtattaatctttgtttcacgtccattcacaggtcgtttattcgatactaaaggggataactggattttcaatccaacatttattttctttgcagtggcaatgcttcttgttggcttagccggtttcttcagtccagctattggctttgttgtcttattaattgctggtggagccttcggtcttggttacggtggtgttgcaccatttggtcaagcaattgctattcgtgattcaagtaaagatcgtatcggtgttgcaacttctaccttctttggatttttagatttaggtgttggtggaggacctattgttcttggagcaattattccaatgcttggaaatggtatgcttggtttcagaaatttgtatctgtacagtgctcccgcagttgtaattgtttggattatatactatctcattcatggtaaacatcaaaaatcaagttctaaagtttgattttaatgatttacataaaaaatgatataataaaatggctacagccttatataggcgaataaatgaacaaattagcgagtagatgagttttaacaagatggaagaaatggcaaacgtaaacattgaatatctaatcaatacactagagcaaaaaaaagtcagtgtcgtaacacgtaaaaagcatagctatattatgtatcaaggaattgagtcagaatatatctatgtccttaaagatggtgtagcgaagattagcaatattttaagagatggtcgtgaatttaatatcgcgtatgttgcgcagccagattttgtttctttattggaagaaaaacgaaatgatggaatctcagcattatttaatgtcagagtagaatctccaacggctaatttttataaaatttcgcggagcgatttttgggattgggtacgcgaagatttaaatttatttagagttgttgatgatttttataaaagaagattggcacttaatttagaaattcttcaaaaaatgacaattaatggtaaaaaaggagcagtttgtgcttgtctccatagtttaattgatgattttggcattcgtaagaaagatggaattttgattgatttcacagttactaatgaggatattgcaggcttctgtggtatttctacaagaaacagtgtcaatcgtattctccacgatttaaaggatgagaaagtaattgatgtgattgataataagatcatgatttataatcctcaatatttggaagaatatattagttaatataaacagataaaaaagctactttaggtagcttttttgttataattaggtcagcatgatatcaaagtattcaaggaggtaaaatggataatttaaaaaaacaagtcggcataaaagctgctgaatttgttaaatcgggaatggtcgttggtttaggaactgggtcaacagcagcctattttgtcgaagaattgggtcgaagaattgccgaagaacaattggaaattacgggtgtaacaacgtccaatgtaacaagtagccaagccagagctcttggaattcctttagcctctattgacgaagtagattatgttgatttaacagttgatggcgcagatgaaattgattcttcactaaatggtattaaaggtggtggagcagcacttctaatggaaaaaattgttgcaacctattcaaaagactatatttggattgttgatgaaagtaaattatcagaaaatctaggctcctttaaaattcctgtagaagttattccttatggctcacaacaagtttttaaaaaatttgaagcggctggctatgctccaacttggcgtctaaatgaggaaaacgagagattgttaacggatatgcatcactttattattgaccttcatatctctcaaattaaagaaccagaaaaacttgctgaagaacttgatttaatggttggagttgttgaacacggcctctttaataatatggttaaaaaagtgattgttgctggcaacggaggtgtaagaataataaataagtaaataaaaaaatcgtctgattgacgatttttttatttctttaaccactcttgaactccccatttgtgagagccgcgtttgagtttactaatagctgtttctgggtcaaaccagctaatatgattaaaatcctcgagaggtttggaatcaaagcggacattcttagtattataaatataggcgggattataaaaatatttatcacgatgcgaactataaaaatattcatctgcttgccctaaaaattctccaatttcagcggtagctcctaactcttccatgagttcacgatgaagtgctttttcttgattttcacccgcttcaatttctccaccaggaagaaaataagctccattgggtgcctggacgagacaaatttctttattctctcttgcgacaatcgaatagacaccatatcttgcctgataatttttctcttcatttttttcaccgaaaactggaatatgattcataaaaaattctccccaatactgattattatgataaacataactattttaaaatagttaaaaaccgcttacagaaatttattactactattctatcaaaattctgtcaaatttgataaaataaggtacgagtaagaagaacttatacgactatcggattgaaagtgaagattagttcaaagagataaacgatataagaattgcttttgcttatgcaaagggctatgtgaaatcacagagctttcaaatttaatttagagagtttgaaacatattaccgaagggaacatagaatagtgaaaaaaattaacttaagtaagcttattattattgcactcattatcattattgcagcgatgtcagcaatttttatctctgccaaaaattttaagtctaaccgtaatccgtcagcaatgactcaaaccattaatgatgggacaagttttgttgacagagtacttgtggcacctatccactttgttcaagacaaggctaatgaattgtcgaatctgatggatacctaccaacaaaaccaaagtttaaaaatacaattggcaaagtcaaaagatgatgataataaattaagcggccttgagtcagaaaataaagagttgaaaaaagctttgaaactccaagaaactttaactgattatcaaacggttgctgcaaatgtgattactcgtgagccttcctcatggaatgatacactagtgattgatagcggtagtaaggatggcttgacaacaggcatgattgttatggcaaatggtggcgttgttggtcgagtaactcaagtgaataaaaatagttcaaaagttgcacttttgagttcttctaaaggaattgataataaaattcctgtaagaattgaaagtgacggctcacctatttatggcattttgagcagctatgattcccaacaagaggcttatgtagtcaaaaatatcgattcacaagggaaatttaaaaatggagattccgtctttactagtggtcttggaacgaattctggtagtcaaggtggaacaccaagtggtttacttataggaaaggttatcggtgaaaagcaagatagtgatggccttggtaaaatggtttatatcaaaccagaaacaaatctctatgatatcagattcgtctttgtggtcaaaagcaaaattgacggtcagtagtttttgctaaataagtattaattattattatacttatagaaaataaagcattaatttgttaaaaccaactagaatataaggaattaagtagtgagtcgatttacatttcaattttttagtccaattattctttttttactaatgattttggacggtcaaattacccatatattaacagggtttagcagcgggacatgggtaccagtgagtcatttatttttgatatttctgatgtacagtgtcactcagcatagaccaagctatattatcatcttagcggcagttttgggggcaatatatgatagttattacctagggatttatggaattgcgaccttattgttcccacttattgctctttttatatataatatacagataaccatatttactaatcgctggacacggttatttacaacaatcattattgtgacggcttttgaagtttttagtgcaatcattatggcagcttttggatttgcacatttaaactttattaattttgttgtttaccagttagcgcctacacttttgcttaatattatcttagctgtagccttgcaatttcctttagaaatcttctacagattaaagaaaagtcacggaagatacaattagaaagcgttttgtaaccataaagaaatattttgggtgggtaggaatagtataatatgtttattcaaccgaacttaatgggaggaaaaattaaaaaattacagttatgaaaaaaaagattatctcagctattttaatgtctacagtggtactctctgctgcagcaccgttgtcaggggtctacgctgacacaaattcagatattgctaaacaagatgcgacaatttcaagtgcgcagtctgcaaaggctcaagcccaagcacaagttgatagcttacaatcaaaagttgatagcttacaacaaaaacaagcaagcacaaaagctcaaattgctaaaatcgaaagtgaagcaaaagcgcttaacgcacaaattgcaacattgaatgaaagtatcgcagaacgtacaaagacattggaagctcaagcacgtagtgctcaagttaacagctcagcaacaaattatatggatgctgttgttaattcaaaatctttgacagatgttattcaaaaagtaacagcgattgctacagtttctagtgccaacaaacaaatgttggaacaacaagaaaaagagcaaaaagaacttagtcaaaagtcagaaactgttaaaaagaactataaccagttcgtttctctttcacaaagtttagattctcaagctcaagagttgacttcacaacaagctgaacttaaagttgctactttgaattatcaagcaacaattgctactgcgcaagataaaaaacaatctttattagatgaaaaagcagccgcagaaaaagcagcccaagaagcagccaaaaaacaagcagcttatgaagcacaacaaaaagaggccgctaaggctcaagcagcttctacagcagcaacaactaaagcggtagaagaagcaacttcaactgtttcatctagtcaagcttcacaatcaagttcatcaagttcaaacacaagtagcaataatacatcatcaaattcaagcagctcaagtagcaattcatcaagctctaatagctcatcaagctctaatagctcatcaagttcaagtagctctaatggtggtggaagtacaaatactggtaattctggtggttcaagttcatcaggtattaatagcacaccaatcggtaatccttatgctggtggtggatgtactgactacgtatggcaacactttgctgcacaaggaatctacatcagaaacatcatgcctggtaatggtggtcaatgggcatctaatggccctgcacaaggtgttctccatgtagtaggtgcggctcctggtgttattgcttctggattctcaactgattttgttggatatgcaggttcgccttatggtcacgttgctattgtaacagcggtaaattccgatggtacaattgacgttgttgaaggtggaagtggctttggatggggtcatacacgctcacacgtgagtgcagctggtgtaacattcttaatgccaaactaattcaaaaattttaaagatataaatagtgatttgatagtggggaattattttccttctgtcaaatcattttttattattgtggtataataataaggaaaaatgataaggggatagatacaaatgtgtggaattgtcggctttattgaccggatgaatcaaaatgataaatcaaaaactttagaagaaatgatgaatactattgttcaccgtggtccaagtagttcaggtgaatttattgatgagggtgccgcaattggttttcgtcgtttgagtattattgaccttgaaggtggagaccaacccattttcaatgaagataaaactaaattgattacttttaatggtgaaatttataacttccgcgaattacgtgaggaccttatctctaaaggtcatgattttacaactcatgctgatacagaagttcttttgcatggttatgaagaatatggtgtagaacttcttcaaaagcttcgtggaatgttcgcttttgttatttgggatagagaaaaacaagaattgtttggtgctcgggatcattttggtatcaaaccactttactatactcaaatgggtggaactttcatgtatggttcagaaattaaaagttttttgaaacatccaaacttcaaaaaagaattaaataaagaagctttaaaaccttacatgactttccaatactctgctcttgatgaaactttttttaaaaatgtttttcgtatcaaagaaggtcattactttacttacaaagatggggtcttggatatcaaaccttattgggatatgaaagttgatgaaaaagatatgagcttggaagaatcaattgatttgattgacaagactgttttgggttctgttgacgctcataaatttgctgacgtagaagttggagcttttgtatcaagtggtgtcgattctagttatgttgcttcaacgcttcgtccggaacatacttattctattggttttggtcaaggaactttcaatgaatctaaacaagccaaacaattgactgatatgattggtttgaacaatacttctcgtgaaatccatggagatgaagcgttcaagtatttcccacaaattcaatattatttggatgaaccagattcaaatccttcttgtgtgccactctttttcctcgcagaattagcagcacgtgatgtacgtgttgtaatgagcggtgaaggtgcagatgagctttttgctggttatgagtcttatggatttagtacaaattctcgtgcggttcgtgttttcgcagaaggtttgaagaaattaccaaaatctttacgtttctcaattgctcgtggtattgaaaataaacatttcaaaggtcaaaaacatctttatgaatcacttgcgcctgctgaagatttctttatcggtcaagcgaaagtatttgatgagtctgaatcagtagagcttttgaaagaagaatttaaagcagctccaactgttaaagatattgttggaaaaacttacaaaaaggccccagaaggttctgagcttcgtaaaatgcaatatcttgatatgcaccaatggatgccaggagatatcctgcttaaagctgataaaatggcaatggcacactcacttgaattgcgtgttccactacttgatattgaattgatgcatacagcggaacaaattcctacaaaatatcttttgaatgaacataatacaaagtatgctttccgccaagcagctcgtcgtcatttaccagaagaatggtcaaatcgtaaaaaattaggcttcccagtgccaattaaagactggttgcgagaagaaaaatattataaagttgttcgtcaattatttgaacaagattttgttgctgaattcttcgatcaagaaaaacttttgaagatgttggatgataactttgcagataaaaatgatgcacgtcgcaaactctggacaatttattcattcttgacttggtatgatgtttacttcatcaataatggtgaaaaacctgctgtggttaatttttaagggaggtttttgtgtcacaaacaaatgaatttcaacctatcttgttaggttctgatatcaacgtctatggaatggctcgttcatttcatgaagaatttggaattacttctctggctttaagtgcttctggattagctccaacaaagtattcaaaaattgttgaagtacaaactcatgaaaattttgaccatgaagaaacttttattcaggtgcttcgtgattttgcaagtaaacataaagacagtaagaagaaacatcttttagttgcttgtggggacggttatgccctacttgcttcaaaatatcgtgaggagctttcggaattttttgaagtgccttatattgactacgcgctttatcgtcaattagaaaataagcctgatttttataatatctgtgaacaatataatttaccttatccaaaaacggtattagttaatccaaaatcagaaatagatactttagtagatgagttaactttcccttatccaatgattttaaaaccagggaattctatttcttatttagatgtgcactttgaagggcagaaaaaagcgttcacgattgcatctaacgaagaaatgaagttgatgctgcatcgttgttatgaagctggttatcctgatgagatgattattcaagatttcattcctggaggggatgaaaatatgcgtgttctgaacgcttatgtagataaaaatcataaagttcgcatgatgtgtttgggtcatcccttacttgaggatccaagtccaaaagcgattggaaattatgtggcgattttgcctgattataatcaacaagtttatcaacaaattcaggattttcttgaaaaaattgaatatacaggctttgctaattttgatatgaaatatgacccacgtgatggctcttataaactttttgaaattaacttacgtcaaggacgaagctccttttatgttactttaaatggttacaatttgacacgttatttagttgctgaccgtattaacaatgaaccttttactgagacaatttatggaaaaggttcaaaactttggttaggggttcctaaaaaagtattgctcaaatatgtaaatcctagttttaaagaagaaattcgtcgttttattaattcaggaaactatgggacaactctattttattctaaggataactcaccaaaacgttatcttttgatgaaatatgcattccatcgttatattggggcatttaaaacgtactttcacaaataaaaattaagaataagaaggacagggggatataatggaaaacttctttacaatcttgggggggatgggtactcttgcgactgaaagttttattcatacgctgaatgaacgaacagaggcttatcgtgaccaagattatttgaattatatcgtagttaatcatgcgacaattcctgaccgaacagattatatcaagaatccttcattggaaaatccagaagaaaaattgattgatgatattaagatccacagtcaactttcaccaaaattttttgttgttccttgtaacacggctcattattattttgatgagatgcaaaaagcaacagaaattccaattctacatatgccacgcattgcggttgatagtattagccatcactttccaaaagctaagagggtggccgtgctagcgactgaaggaacaattttgacaggagtttatcgtgaggccttggaagaacaagggtatgaagcggtaattccagatgatcaattgcaagaaaaggtaaatcgcttgatttatcaagaagttaaggaaaatagaaatcttaattttgagctttataaggaaattttgtctgatgtcgcgtcagaaatgaattgtgaagtaaccattttaggttgtacagaattgtcagtcttatatgaagcctatgatttgacaaaagagtacaatataatagatgcacaagctgaaactgtacatcgaacaatatctatgatgggaaaaaaagatttattagatgactattaaaaagaaaaaactttttaaaaaaagaatcgtaattttatttgttcttgtggcctgtctacttatttttactctaattgtaaatcctaagaatcaagaagataaaaaattaacatctgcatcaaaaacttttgtccaaactgatcgtcagggtaagtacgattatgttttgatgaaaactggtgatgttaatcaaatgacaatcggagcctaccagggatgtgaaattgtttctttttacaatgcattggtctatttggataaaactcagggtaggacggttactgattggattgaatctttgccttatgtgggttggggaggtgatccaggaagtggttatgctgggaatccttggacgtctgatgaagaaattccggatggtggttttccaacgatttggcccacagctttgatgagttttgctcaagaaaataatatccaagttgctgacttatctggaaaaagtattagcgagattaaagatgctgttttatcagaacatttagttgaaatgtgggtgacgattgattttgctgaacctaatatcacttacgatgattattacggttataaggttgtagctaatacgcatgctgttattttagatggatataacgaaaagaaaaatgagtttcatgttactgatccaataaaaggaaaatattggttggctgaatctacagttgattcggtttatagtggaacaaatcaatttgcgatagaatttttatagtgtaattagcactcttataaaaagagtgctaatttttttgccaaaaatgaaaaaacgtggtaaaatagtgctattgaaaaattgatttagtaaaggaagtgagtaatttagaaatgaataatactgaatattatgaacgactaggtgtcgataaaaatgccagtcaagatgaaataaaaaaagcttatcgtaaaatgtccaaaaaatatcaccccgatttaaataaagaagagggtgctgaagaaaaatataaagaagttcaagaagcatacgaaacgctttcggatgaacaaaaacgtgctgcttatgaccaatatggtgaagctggagccaatggtggctttggtggcggcggcttcggcggagcttctggtttctctggtttcggcggcggctcaggtggctttggtggttttgaagatatattctcaagtttctttggaggaggtggtgcacaagttaaccctaatgcaccccgtcaaggagatgacttacagtatcggataaacttaaaatttgaagaagctatttttggcgtggaaaaacaagtcaaatataatcgtgaagaactctgtcacacttgtggaggttctggagcgaaagctggcacacatccagaaacttgtcataaatgtggtggccgtggacaaattaatgttgttcgtgatacaccgcttggacggatgcaaacacaagtaacatgtgatgtttgtaacggaacaggtaaagaaatcaaagagaaatgtgaaacttgtcatggttcaggccatgaaaaagtggcacatactgttaaggttactgtacctgctggtgttgaaactggacaaaaaatgcgtttgcaaggacaaggtgatgctggtgtgaatggtggaccttatggtgatttgtatgttgttttccaagtggaagcttcagacaaatttgagcgtgatggtgcagaaatttactacaagatgccaatggactttgttcaagctgctttaggtgatgaaattgaggttccgactgttcatgggaatgtgaagttgaaaattcctgctggaacacaaacgggggctaatttccgtctaaaaggtaaaggtgcgccaaaactccgtggttctggtaatggtgaccaatatgttattatcaatattgtcactcctaagaatttgaatcaagctcaaaaagaagcactccaagcttttgctaaagcaagcggtgttgaagtctctggttcaggtaaaaaaggtttctttgataagtttaaataaaaataaaagtcgcttttggcggcttttttttgttctgtcagtaattttgttctctatttttttgctgacaagtttgtcagtatttttagggaagaaaacaggaatttctgtaagtttttgatataataggggcatgaaaattgataattataagcctgattatttagtggaagctgtctatcaactagaccctaaacgtctgcaagccttgaatgttcgtgccgtaatggtggatttggacaatactttaattgcctgggataatcctgacggaactccagagcttttggcttggcttttggatatgcgagaaaatggtttaaaagtggtggttgtatcaaataataaacaagcaagagttgctcgtgctgtggaaaagtttggtgttcaatatatttggcgggcaatgaaaccttttgcttgggggataaaaaaagcattgagattgcttgatgagcgtcctgaaaatgtgattatggttggtgatcaattgatgacggatattagagctgctcatcgtgccggcgtcagaagtattttggtcaaacctttggttgcatcagactcttggagtacacaagttaatcgttggcgtgaacgacgcgtttggaaaaaattgattgctcgagatggtgagcctgtgtggaaaacaagtttataaaaatagatttcaaaaaagaattttacctgtggaaaaataaattcacaagtaaaatcctttttttatcttattttactgataaaaacgaaaagttttccacagaattgtgaagtctttccacaaatgtgtggaaaactgtgtaaaagtttgtggaaaagataaaaaacctatcgttaagataggttttttcgttatttattgtagtaaccacgttcttgataccataaatcaggttgccaagcccattcgtgaccatttttttctagtaagtcaaatgcagccttaggtcccattgtgcgagccgcataagttgggagctcagaagtttctttatcccaagcttctcgaataacatcaataagttcccaagcgcgagccgcttcttcccaatgtgagaaatttgttccgtctccattaaggacgtctaggaaaagtttttcatatgcttcaggagaatttccaagaaattcactatcgtgtcggaaattcaaacgcaaaggctctaaatggaagccttgaccggccgcttttccatttactgaaagtgaaaaaccttcagttggttgaatgtaaatggtcaaaacattttgaacggattggtcatcgcaattttctgcaaagagattgtctttatcttttttgaaaacgatattaatacgagttcctttttcagtcatacgttttcctgagcgaacatagaaaggaacgcctgaccaacgctcattatcaatgacaaattttccagcagcgaaagtttcagttcgactgtctgttgcaacagaatcttcttcgcgataacctaggtaatcttcaccgtcaaaacgtcctgcgatatattgaccacgaacgaagttttctaaagcttcctcagaagaatattgacggattgcattaagggctttaactttttcttttacaatataagattcatcaaatttttcaggtttttccatggcaatgagactgagtacttgtaagacatggttttgaatcatatcttttaaagcaccagaagtttcgtagtaaccgccacggtcttcgacgccgataaattcggcaaaggtaatctgaacgttatcaatgtgttgattattccagagtgattcaaaaattggattagcaaaacgaacagccgaaacagcttgaatcatttcttttccaaggtagtggtcaattcggaaaatttgttcttcactaaatacttttgcgaggctgtcattaagtgattttgccgtatcgtagcttgttccaaatggtttttcaatgacgattctctcaaaaccttcacctgtcaaaatattttctgatttaaggtgttcagcgatagtgccaaaaaattgaggagccattgctaaaaagaagacttgattgcccgcagttttatactgtttacgcaatttttcacccaaatcttttaagttaatgtaatgtgagctgtcgctaacatcgtgactttgataataaaaatggctggcgaaattttcggcttccgtttttgagttcattaaatctttgatagactctaaaacaacttcacgataatattcgtttgtccatggacggcgagcggtaccaatgactgcaaaattgtcagctagctcaccttttttgaaaaggcgaaagagtgaagggtagagctttcttttagcgaggtcaccagttgctccgaagatggtgaaaagtgcttgtttttgttcggtcatattttttccttttttaaaaaacaataattaatttactgacagactgatttagaatttctgtcagtaaaatttaaccatttgtattagtttcattgacgtaatcatgagcgtactgttcaatatcggctttgagttcagctttcatttcttgaaattcggactcgctataatcgcgctcggctattttagcattataaaagggaattgctagctcttgacgaagtcgtgtctcaagttcttgtctattcattttaacctccaataagttgcttcaaaaactcttgtgaagcattaatcttataagaattatatcataaattggggttgtaaaaaatagaataggatttaaatgttcttgataaagtatcttaatcaaaggaacaagcagctttaaaaagtttttggtagaatagggttattagattggagaaacacatgtctttattagtatttactctgttgatgttacttcttggtttcgtcgcaggggtatttggctcaattttgggtcttgggggtggaattattatcacgcctattattacgacattttttggtgttgatattaaatatgccattggggcaagtattgttgccgttattgcaacaagttctggtgcggccatttcttatttgaaagatgatatgattaatgttcgtaccgctatgtttttggaaatatttaccacaattggtggtttagttggtgcaattttagcaggattttttgatgctacgattttaaatattttatttggttgtcttttgattttccaaggctacaatatgtggcggaaaatgcataaaggtgaggaagttgttcaaaaggttgagtcagataagatagctgagaagttaaaattaaactcaagttattacgataaacaacttggcaaagaaattccttatcaagtagaaaaggttccaggtggtgctgctgtaatgcttggtgctggtgttgcatcaggtcttttgggaattggttctggggtctttaaggtcatggcaatggattcaatgatgaaaatgcctttaaaagcttcaacagcgacttcaaatttgatgattggggtaacagcagcggcttctgcaacggtttattttttcaatggctatgttaatccaagtttagcaggtccgcttgctattgggattgttgccggtgcagctttgggctcaaaaattatgcctaagttaccagcaaaaacaattcgattgattttcattccagttattttaattatggcattgcaaatgttgcttaaaggattgggggtatcgttctaatggtaaataaagaattaacaaaagaagagttactcaaaatagagcaaaatatcggaaaaattcttaggattggtgtatttgttagtactacagtcattattattggaattttgatgtttctcctaagcggccattcaggttacgctgaaggggtttggccagataaatttaatgaaattttaagcggtttagttgaatttaaagcattggcttggttgatgactggattattcctcttaattttgactcctgttttgcgagtagttgcttcaattgtggcttttgcaaaagaaggtgataaactttatgtggcaattacaactttggttttgattatattaattgttgcgatgtttgtagggcacggaggtgcttaaatagggcgtcatagcggattttcaacttgcattttttctattaaactgatattatagaaaagtgttatgacccataggggagtgcctttgaagtagttgctttagcgacttacgtaaaatgacgagcttatgagaattcgcaaggggaagtggtggaatggcagacacgcatgcttcaggtgcatgtgcgagaaatcgcgtgagggttcaaatcccttcttccccatgattaagtggacggttggctggaagctggccgttttttgctcttttgagctttttaagagatggagaaatatgactagattaacaagagaagaactagagaaaatcctttacgctctttatcaagcattggcgaagaaacaggaaattcacgagtggctattgaaaaatggttgaaaacttatcaattggatgaatatcgtaaccgaaaaatcaaacggttgcggggagataaagcccgtaaacgtcgtgattaccaaaattagacgaaacagattttataaatctgctaaataaaggagaagaaatgtcaaaaatagcatttattggtacgggtgtgatgggagccgcaatggctggtcatcttatggacgcaggtcatgatttaattgtttataatcggacaaaatcaaaaacggacggtcttgtggcacgtggtgcaacttatgctgaaaatccacaaaaggctgcggctcaagctgagtttgtgattacaattgttggttatcctaaggacgtccgcgaagtttattttggtgcagaaggaattttcaaaaatgattgttcaggaaaagttcttattgatatgacgacgactgagccaactttagcacaagaaatttatcaagaagctaaaaaagttggagctttcgcacttgatgcccctgtttctggaggagatttgggtgcaaaaaatgcgacactgaccattatggttggtggtgattcagaaacttatgagaaagctttacctttatttgaaaaaatgggaaaaactattactcatcaaggggtggctggaagtggacaacacaccaaaatggctaaccaaatttgtattgcgggtacaatgactggaatgactgagcttttagcttatgcccaaaaggctggtttggatttggataaagttttaaatactgttgggggaggttctggtgccacttggtctttggctaattacggtcctcggattctccgtgaagattatagtgcaggattttttgttaagcatttcatcaaagacttagggattgcactttctgaggcagaaaaaatgaatcttaagcttcctgcaactaaaggggcaaaggaactctatgagcaattagctgataaaggctttgaaaatgatgggactcaagctttgattaaactttggtggccaaatggacatcgtccagaataataattgaaaaaatccaatagttggttaaactattggattttatattaagtttcatttcttaccttgcttaggattgggagttgaacgtctatgcgtttttacagtagctccgctatttttggtgtaggaatgaacataaacggatttttttccagattttgttttggccatgcttttcctctatttcacagtagtaaagattagttttgcattgtcatcagaaattttagtatcgtaataattagagttcataaatgaagtagtgataatctcaccatcttttagagaaacgacaacatcagagtttccaggattgtagtcttgacttctttcgtttccattttcatcattgtagattgaaaaagtccatcctaaatttgcgaattgtgggtccatggtcatgttggtgcttaatttataatttcctgctgggatatcacgtccaacaatgaaatttccgattccgagttgagttgatggagtgattttttctggaacagctgtaaattttattttagagatgttgctaaaattgagcgtgtctccatcgagaaggacaatacgaatatgtgaagcataaccgctatcatttcccggagcaccaccaagccagttaataaacattccattaacagattttcggctacctgtgatattaccactaccgcctgtaacgctaagatcataaataccaggactgacagtttgttcatcgccaactgtaatttcaccagtaacgtatatttcgtcagttgatttcgaagtggaggctaattgatttaaaagctcaagagtagtttgtttctttttgcttgtagaatgttttggtactttaacacttttgctgctggaagaggttttgatgttattttttccgatatcatcaattgctttgccataaatggattgggtgactaaaacaatgacgagggtgagtacagagataatcagtccaatgagtgagagaagttttttattttttctattgctaaataatgcgataatagcaagaattaaagcaagtactccaaaaataaaagcgatgttgttgacaattggaatccaagaaagaataagtcccaatcctccaagtgctatcgagacaatagcaataactttacgttctgttttcataaaatctcctagtttaaattttttcttctttattatacctaaagttagcattgaaatcaatttaaaaacgaaaattaaaattaaaaatgatttttctttgttaaaatccaaaaaagaggtaaataaatgggtatggaatactttggagataaacttcgtgctttacgtatgaaaaaaaatctcacgcaaaatgatttggcggctcgcttaggaattgttggggcttcggtatcatcttatgaaaaaaacaagcaatatccatctgttgaggtattaattcaactatgtcaaacttttgatgtatcagcggattatttgcttggcttgtcagatgataagaactttaatacatcaactttaacagaggaacaactacagattgttttgagattgattaatgaatttgagcaatcgaatgttctcaaagaaagataaatgatgagattatatacaagtcgagaatagtaaaattactgatgatttaatcagtaatttttgtttgaaaatcgcaagttttacaagtcctatgatgaaaggagaattcatcatgggtaaaaatatgattgatattacagatttaacagcctcacaaagagaattaattaaagaaatgattgctgaatttaagcgaatgaatcaaaagtaagaattagaaagcctgaaacatttaggcttttattttttgaagataaaaaaacaaaccatgaattgattgaaaaaatgttataattattttataaagtctaagagttttaatgaaagaaataattagtaattaatgaaattttaaggagggcttgagatgcactatgatgacttagtggatttgcttgttgaaaaaataaaaagtcttgattatgttaaagattttcaacgagctgaaacagcactaatggctaatcaagaactttttaaagctcaagaagaaatgaaagctctacaaaaagaggctgttttatatcaaaaaattgataaaatacaagcttacaaaaagacttcacagtcggctcaagtcattgaaaaacggattaagcatcatcctttggtagaagattatgctacaaaattagaggatgtcaatgatttagttcaatatatcactggtgaattagaagaaaaagtaaatcttttgttggaaactggtgaataaaaagtactgacaagaaattctggcataggataggctatgtaagcttgcttatggagatgctagaatttttgtcagtaaaaatataataaaaaaatactgacagaatttctgttttaggatatttagtgttaaattttcttacggatatgctaagaatttcgtcagtaaaatttagatgggataggaagaaaaaatggctgaaaaaatttcaccaggaatgcaacaatatttagacatcaaacaagattatcccgatgctttcttgctctttcggatgggtgatttttatgagcttttctatgatgatgcagtgaatgctgcccaaatattagaattaaccctgacttcaagaaataaaaattcagaaaatccaattccaatggctggtgttcctcaccatgcagcagctgaatacattgataaattggttgatttaggctacaaagtggctgttgctgaacaaatggaagacccgaaaaaagcggtcggaattgttaaacgggcagtaacacaggtgattaccccagggacaacgattgacactgcaaattcggttgataataatttcttggtggcaattgacttcaaagataaacattatgctctttcttatatggacttatcaactggggaattcaaggtgacagagctcagcgaattttcagcggtggtaggagaaattgcttcactcaaggcgcgggaaattgtagctggttttactttagatgaaagtcaattaaaagtttttgaaagacaaatgaatcttttgatttcagaacaaattgaaattcctgaaaatttactaatagatttgtcaggattgaccgccctagaaaatcaagtcgcttcaaaattgttggcttacgtaaaagaaacacaaatgcgtgatttgagtcacttacaagaagttgaacattatgaaattaaagactttttgcaaatggactttgcgacaaaatcatctttagagctgacggcaaataaaagagaaaataaaaaacatggcacactttattggttgcttgatgaaacgaaaacagcgatgggaacccgaatgttacggtcgtggattgaccgtcctttggtttcaaattcagccattcaaaaacgaatggaaattgttcaaattttcttagaccatttctttgagcgttctgatttgatagaagccttaaaaggggtctacgatttagaacgtttggcttcacgtgtttcttttggtaaggctgttccagttgattttttgcagctggctaattctttatcaaatgttcctgctatcaaaaatattttgggaatgcttaatgaagctccattagaagagttaaaaagccaattagacgaaattccagaattatctggtttaattaattcagctattagtgagaatgcctcaagaacgattactgaagggggcattattaaaaaaggctacaatgctcaattagataaatatcgggaggcgcttgaaaatgggacttcttggattgctaaattggaagcagatgaaaaagccaagacaggaatttccacactgcgaattgattataatcgtaaggatggttattattttcatattactcaaagtcagttgaatagtgttcctgaacatttttatcggaaggcaactttgaaaaattctgagcgttttggttctcaggaattaactgaaattgaagaaattatgttggaagcgcgtgaaaaatcatcatctctagaatatgatttattcatgggccttcggactgaaacggagcaatatattggcagactacaagctctagccaaaacaattgctgaaattgactgtttacaaagtctatctgtcgttgccgaaaaacaaggatatatccgtccgacgcttacagacggctcaagaattgttgaaattaaaggcggtcgtcatgcggtcgttgaagcggtcatgggtgctcaagaatatgtgccaaatgatattgaactgcctgaacaaacagatattcaactcatcacaggaccgaatatgtcaggtaaatcaacctacatgcgtcaatttgctttgacggtgattatggctcaaattggatcttttgttccagcagaaacagccaatttaccaatttttgatgccatctttacacggattggtgccagtgataacttgatttcaggggaatcgacctttatggttgaaatgtctgaggccaatcatgccattcaaaaggcaagcagtcgcagcctgattatttttgatgaattagggcgaggaacggcaacttatgatgggatggctctagctcaagcaattattgaatatgttcatgaccatattggggcaaaaaccttgtttgctacgcattatcatgaattgacagacttagatgaagcgctcgatcatcttgataatgtccatgttgctaccttggagcaaaatgggaatgtgacttttttgcataaaataacagagggaccagctgataaatcctatgggattcatgtggcgaaaattgcaggtttaccacagcctttgttagagcgagcagatttgattttgcagaagttagaaaataaacctttgcctgctaaaaaagttgctgatgaacaagaacaacttagtttatttgattttgctgaaaattcttcagaaattattgaaaagataaaaaggcaaaatgttgataatatgactgcaagagaggctttgaatttcttgtgggaacttaaagattcactttgaacttggtatcgaagcttattctgtaaataagctaaggaaaaaggctataattacttaaaaagagattcattgaaagatgaattgagtagaagctaacataaaaaggagctaaacatggaaaatgaaaaagaacttaaaggacaagaaattccagagactcaagtggagccaactgaagaattaaattctgagaatcttgcttctcaagaagaaataaccaagagtgatattagtgaatgggatgcctcagagcctgtacttgatgagccagtagttgccaaggctgaagtttcagaaggttttgtaagtgaaccagtgattgcagaaccagtaattgctgctagtgaaccacttgattcaaaagtcgaagagaaaacgagcgaacaatcagcttatgcagatattcctcagaatcgctcactagaaaatcaagatgaaattaaaactaaatggaactggggagctttctcttttccaatgtggtttgggattgccaaccgtgcttatttgggactcttgattttgattggattaatcccatggataggttggatttttgggattgtatggatgattgtttttggttttaatggcgaaaaatgggcacttgaaaatcgagataataaatatcgtgatgaggaagagttccgtaaggtcatggacggttggaatcgagcaggtttcgttgcattcattattggaattgtattatttgtgattgcaattttgattcttattttcgtattagtctttgcttttaacagctataataattttgataatggttaccgcaattttggaaactactaattaatgtaaaaatgatagacaattttcatcttgtctatcattttttgtcagtaaaaaatgaaaagcgagcccttgctttttgtgttataattagaattaatttaaaaaaacaagagagcgagattattgtgggaaaaattattgaactaaatgaagcgctcgccaatcaaattgctgctggagaggtggttgagcggcctgctagtgttgtcaaagaattagtcgaaaactcaattgatgctggaagcagtaaaattattatcaatgttgaagaagctggtttgcgattaattgaagttattgataatggtttgggtttggaaaaagaagatgtggctttggctttacgtcgtcatgcaacaagtaaaatcaaggattcggcagatttgtttcggattagaacactcggttttcggggggaggctctgccatcaatcgcttctgtcagccagatgaccattgaaacaagtacggctgaggaagaatcaggaacaaaactaattgctaaaggtggaaatatcgaaactttagaaccacttgctaagcgagtggggacgaaaatttctgttgctaatcttttttataatacaccagcaagactcaagtatatcaagtccttgcaggctgaactttctcatatcacagacatcatcaaccgattgagtctggctcatccagagatttcctttactttagttaatgagggtaaagaatttttgaaaacggctggaaatggtgatttacgtcaggttattgctgcaatttatggcatagggacagcgaaaaaaatgcgtcaaatcaagggctcagacttagattttgaactaacaggttatgtcagcataccagagctgacaagggctaatcgtaattatattacgattttaataaatggtcgatttatcaaaaactttttattgaatcgggcaattttagaaggatatggcaatcgattgatggtgggacggttcccttttgctattttatcgattaaaattgacccaacacttgctgatgttaatgttcatccgacaaaacaagaggtgcgtttgtctaaagagcgtgaattgatggctttaatttctaaagcaattgatgaggctttatcagaaggtgttttgattccagaagctttggaaaatttgcaaggaagagctaaagaaaaggagagtctttctgttcaaacggaacttcctttgcaaaataatcctttatattatgataatgttcgccaagatttttatgtcagagaagaggcaacttttaaaatcaataaaaatcaagcttcaaatgattcgtctgaacaaacttttgataattttacagaaaatcaacttaatacagatgctgtcagtgaaaaaatgactgacagaactgttgaaagtactactgaaattactgacaacagtctagaaaatactgtcagcaactttgaaattgattttgataatgaagtaaagataagtcagtcatcaacttttccgcagcttgaatacttggcacaattgcatgcgacttatttactttgtcagtccaaagaaggactttatttggttgaccaacatgcggctcaagagcgaatcaaatatgagtattggaaagataaaattggtgaggtcagtatggagcaacaaattttacttgcaccatatttgttcactttacccaaaaatgattttattgttttagccgagaagaaagatttgttgcatgaagccggtgttttcttagaagaatatggagaaaatcaattcattttaagagaacatccaatctggttaaaagaaaccgagatagagaaatcaattaatgaaatgattgatattattctctcatcaaaagaattttcactcaaaaaatatcgtcatgatttagctgcaatggttgcttgcaaaagttcaattaaagctaatcatccccttgatgccgaatcagctagagctttactcgcagaattagcaacttgtaaaaatccttatagttgtgcgcatggacggccaacgattgttcatttttcaggggatgacattcaaaaaatgttccggagaatccaagaaacgcatcgttcaaaagcagcttcgtggaaagattttgagtaaaaagtgactaaacagattaatgatgaagttggtcagtaaaaaaatagataaaaactactgacagacttgaataagggagtttgtcaatcaaaaaaattagaaaagtaaaaaaatgtttgaatatcttaatggaaaattagtaaaaatttccccaacaaatattgtaattgatgtagcaggaattggctatcttatcagtgtagctaacccttacgcttggtcggctttgatgaacacagaagtaaaaatttatgttcatcaagtcattcgtgaagatgcccacagtctctatggttttgttaacgaagccgaaaaagctttattcttacgtctgatcagcgtttctgggattgggccaaaatcagctctggccatcattgcggcggctgataacgaaggtttaatcactgctattgacaatagtgatatcaagtatttaactaaattcccaggagttggtaaaaaaacagccatgcagatggtgcttgatttggctgggaaatttgatgcgacaggaactgtaagtatttctcttcttgatgctggacctgctggcaatcttgctttggaagaagcgattgaagcgctacaagctttgggttataaagcaacagaattgaagaaaattgagaaaaaattagctcaagaaacaggcctgaccagcgaagaatatatcaaatcagccttaaaacttatgatgaaataaaaaagtttgaagaaagaactgacagacatcaaaaacagtcatgcaagtctttctgtcagtaaaatttactgacagcttctcataagtcatcaaaaatcatctctaaaaggagaattacaagataagatgaacgatatattaaacaaagagccaatggaagaagattacggtattgaaaaatctctacgtccgcaattttttaatcaatatattggtcaagataaagtcaaagaacaattagaaatctttattaaagcagcaaaaatgcgtgaagaagttttggaccacgtactactttttggtcctccgggacttggtaagacaacaatggcatttgtcattgccaatgagttgggagttaatattaaacaaacagcgggtcctgccattgaaaagccaggagatttagttgcgattttgaatgaattggaacctggtgatgtgctatttattgatgaaattcatcggatgccaatgcaagttgaagaagttctttatagcgctatggaagatttctacattgatattatgcttggttctggtgatggttcacgctcggttcatttagatttgccgccatttactctagttggggcaacaacaagagctggaatgctttcgaatccattgcgtgcccgttttgggatttcaagtcatatggagtattatcaagagcgtgatttagaagaaattgttaaaagaacagctgatatttttgaagtcgaagttattgataatgccgctttagagattgctttacgtagtcgagggactccgcggattgccaatcgtttacttaaacgagtgcgtgattttgctcaaataatgggggatggccgagtggataaagcaattaccgataaggccttgtctattcttgatgttgataccgctggtttggattatattgaccaaaaaattctccgcacaatgattgaaatgtaccacggtggtcctgttgggattggaactttggcggtaaatattgccgaagaccgtgaaacggtcgaggatatgtatgaaccttatttgattcaaaaaggatttttgatgagaactaaacagggacgtaaggtgacccaaagagcctatgaacacctaggttatgtttacaatgaagaagattgacagttagtatctgtcagtaaaaaagtttgtcagagcttgacaagcttttttatattacaaaaaaatcgctgttgtaacaataatgagaaaagtgtataatatgaccataaagttgcgactggagagacaagacaaatggtcaatcaatactatggtttaaaacttcaagaactctgtgaagctaaagaaatcacgaaaaatgaaattatcaaaaaaacaggaattcctaaaagtagcctctctcgtttttttagtggggaaggttatttaaatcttgaccaaattgatgctttacttgaatttcttcacctggaactttctgaatatgattattatcttaataattttaaacataatttttacgaagaattatttagtaaaattgaccaagcggcaacgaataataatattgaagaactaaaagatattgcctggcaatgtgagcaaattggcgaacatttgattgctctttgtgccaaagcacgcttagaaaagttgacagaaaacgaagtggttgagttaagttcttttattttaggaattgaaatatttagtttttatgaacttctcattttgtcagataccattgagcaattttcgtcagaaatgataaaagcgattattcaagatttgagccatcatcatcaaaggttagccaatcgtacacgttatcgcaaaattatttgtcaaatcgcctgtcgcggagcagtgacttgtatccaagaagggaaagaaaaggaagcgcaagaatgtctggctctggtcaaagcatattgtcatgaaaaagacgcatattctagattgatttatcgctttactaaaggttattattgtattttttatggtcaaggcgaagaacgacttctgggaattgaaagcatgaaaaaggtcatcgaaatttttgattgggaaggaagtataaatttagcaaaaacctaccaaaaactctatgataaatatgtgaaaaactataattttcctcaatggttaagtgatattctaggaaaagattcaatttgaatcttttttttgtgctttcgaaatcggtgctacaataaagttaaggagacaaaaataaaaacaaacgaggaaaaaccaatggacaaattcgcaagctactgagcgcagccaagaaaacaaagtaaaaaatgaaaggaagctctcaacatgagaaaaatatcatcagcttgattcagaaaagataatttctttctgaatttgggcagaaagaggtaaattatgaaaacaaaacaaattttatcaagtcttatgagttcggtggttgtcttgtcagcgttatctccgcttgtagttaatgcagatatcattacaaccgaaatgccacaacaagctacgttagttaattataaaactttgggtgaaaatgacactctagatttagaagtagagtcggaggtaatttatcaaaatcctcaaactggtgaaatctatacttctgatgaagtaattgtatcaggtgttcctcaaaacccacgcctacgttcagtatctgcaagccctatttcggtgggaattctttggaaatataatacaaaggctagtggtacattgatgcgagatacatttcgtaaatgtgcaacggccgaaggggcagtgggggttataggtgccattgctgcggtagggttggaaacaggtcctgttgacgctgtacttgctgttatactagctgccggaacgcttgcttttcattcacgtttctcagaagcggcagatatgataaaccaacatccaaattcaggaaaaatttatatgtacttggaccattgcacatatgccagctattgattggtggtgagagaaatgaaagaatattatattatttggtttatcgtttttttaatcattctttctaaaagtaaaaatagtactcaaaagaggagtttgattccatttcattggttactggtcttacttggagtgtttgcattacttccaataattatatcaatagtgtttattaacagtaaattttgaaataactggagaagacccagtcgggtctttttatagtgaggtaaatctaatgaaatacttcaaatttgaattaaaaaagtttattctaaacaaaagaaacaggtacttattagctttgatttcttctctaattgttgtttacagtatttatacaacaatttcgtttagcgatattgttggcgataatactacaacactccctcaagaggtccagactactgaaaaatcagttcaggataacatcaaaaatactaaagatattctaaaaacgacaaaagtgaaagcagagtttgctgatctgaatgattcgttaaattactatctgcaagaagataacatttatcaaaaacaaatcgcagttataaatgccaatgatattaatggatattatcgtttacaaaaagaagttgaccaattactccttaaacaatatggtaaccaatcatcatctggtcaagataaattcctgaaagcagaaattaagtatatcaagacagttcaagagagaaagttagattttgaagtaattcctaccatgcaatctcatgcttttggaaattttcatcagcagttcattccaattttaacgagtagtctattcattgtcttatttgcttccatggtttcaatccttgtcgccactagttatgaatcaaaagaaaacagattttatcgatttgcgggaattgatttgcagaaaaatttaattataaaagttttatctggaactttagcgacctttgcttggattattatttctagtatcatttattttctggtaattggggtggtgaatggttttggagcatggaattatcccgcctatcttggcaattcggatttgaaaacaggatttactttgactaatctcacaattccaaatggaattttggatttaggaagtatcctctatctgttttttgtcatctttttcttggcttcattaggtgccttgatttctgtttttgtaaaacggagtatggttgttgttggggttatagctctatttgtcatgggatattcgatgataggaaatgtttcttggataatttcaattagacattttgtgccactttcttatcttgaacctctaaaactttttggaaatcctagtgctctttttgggaaatattctatattaatcggggctggctatctactttctttaagtgtattatttttgctcatttctgtcttcattattaaaaatcaaaaaacaaggagaatctcatgatattaaaaataaaaaatttaaagataccagacattgctccgcttaattttgagatttctgaaaatggtttgtacggtctgattggacgaaatgggattgggaaaagtacacttttcggcattctttcaggagaaattggattttctcaaggagaaatagaaaatgggcgtgtcgcttatcttcccgatgtagaatcttttgaagaaagtttaaaaatgcatgattattttaaaattttgaaaaatagtgaacaggatagagcaagagagttaagtcttacttttggtgcagataaatttgcgaaaaagagaattggccaattttctttaggaatgaaagagctttttgcgacaattttatcattttctatcgactgtgatattttaatcattgacgagctattcagtgggcttgacgtttccaaaaaagccctagtttatgaagaagtgaaaaaaatcgctcaagaaaaaattgttttattaacctcacacaatctcaaggaaattgaacatttctgtgaccaagcttatctattgtccgaaaaaggactgactttggtgacaaattttgatgaagcggcaaaagaaatcggttatatggatgtatttttttagtgaaagggaattaatgcgaaagaatactacattatttggtttatatattttctaataattgtttccgattaagagataagtcgaatgaaagataaggagaacttatgtcagtaattacacctgcccctcaacctaaaagtgatatttttcgggaggttgaacaactccaaaattcttttaaaaataatgaaagtaaagttttggtagataacaataaaatttataaaaaattgaaggaaaaaaagaaaaaaattaagcagaaagattagttcgtctgtcagtaaaaaaatttgtcaaattttggcagactttttcattttagaattctgtcagtaatatcttgtgaaatagggtataatagaataaatgctcaaaattagttaatttataaatgatataaagtaaggaagtcatggaaaagattgtttttgtctgtttaggaaatatttgtcgtagcccaatggcagaatttgtcatgaaagatttagttgaaaaggcaggaaatgaatcaaattttttgattgaaaggcgagcaacttcttcttgggagcatggaaatccaattcattctggaacccaaacaaaactaaaagaacaaaagattgcttttgatcttcacaagggaagtcaaaaaatcagtagtgaagatttttatgaatttgataaaattatcgcaatggatgaatctaatttagaaaatcttagaaaaatggcaccagaaggaacgcgtcaaaaaatcgcgatgcttttagaacaaggtgttccagatccatggttcacgggcgatttccaagaaacttatcaacttgttaagacgggttgtcaaagattattggatgaaattgtataaaatatttcaaataaaataaaccgatgtgagaaaatctcacattaaaacttgactttgctaataacaaggtctataatgaaaggcatggaggcgagaattggtgaaagaacgtgaattaagacgctctatggcagtacttccaataggaactgtcatgaaactcactgacctaagcgcaaggcagattcgttattacgaagagcaagagcttattttcccggagcgaagtgacggtaatcgtcgcatgtattcgctcaatgacatagatgctctatttgatattgctgacttattgcaagaaggtaataatattgcagatatcaaagaaatttatgccaaaagggatgctaagaaggctcaaactttatctatcggagaagtccaccatgcacttgaacgcgaatttgcccaacaaggtagattcggaactcctgatcccactcattttacccaaccgcggatgtaagtttagtttactttatttgtcaactaagtttacagcgaaaatttaactaggagagtaaagcatgacaatcacagcagcagacattcgtcgcgacgtcaaagaaaaggatattaaattcttgcgtttgatgtttacagacattcttggaacacttaaaaacgttgaagttccagctacagatgaacaattggacaaattgtttgaaaacaaaatgatgtttgacggttcatcaatcgaaggattcgttcgtatcaatgaatcagacatgtatctttatccagaccttgacacttggattgtttttccttggggagatgagtatggtaaagtggcaggtgtaatttgtgatgtttacactccagaaggtgaacctttcgctggagacccacgcggtgtcttgaaacgtaaccttaaatcaatggaaaaattgggcttcaagagctttaaccttggacctgaaccagagttcttccttttcaaacttaatgaaaatgatgaaccaacacttgaagtgaatgataaaggtggttattttgaccttgcaccaactgaccttgctggaaacacaagacgtgaaatcgtaaatgtattgacagaccttggttttgaagttgaagcttctcaccacgaagtagcaatcggtcaacatgaaattgactttaaatatgccaacgctttgaaagcttgtgataatattcaaatctttaaacttgttgttaaaacaattgcgcgtaaacatggtttacatgcaacgtttatggcaaaaccagttcacggaatcaacggttctgggatgcattgtaacatgtctttatttacagaagatggtgcaaatgcctttgctgatccaacaggagatatgggactttcagatgttgcacatagctttattgctggacttttgaaacatgcttataactttacagcaattacaaacccaactgttaactcatataaacgtttggttcctggttatgaagcacccgtttatgtcgcttgggctggacgtaacagatcacctttgattcgcgtacctgcttcacgtggtttgtcaactcgtgttgaacttcgtgcggttgacccaacagcaaatccatatcttgcattggctgttctattggcagctggtcttgatggtgttgaacataaattggaagcgccagaagcaatcgaatcaaatatttacgtaatgacagaagaagaacgtaaagcacatggtattacagatttgccatctactttgcacaatgccgttaaagcattgcgtgaagatacaattgtgactgaagcgcttggagaacacgttttggttaactttgttgaagcgaaacgcattgaatgggcaagctatgcacaattcgtatcgcaatgggaaattgataactatttagaactttattaattgatataaaaaaatcactgacaaagcctgtcagtgatttttttggaccatttaaatattttagttgttttcagtaattgtcaaaacgttgaaggcagtttttccgtcttcggcaatcaagaatcctttgtgttcagcaacatagtcaatagctgcttggaaatcagcgaattctttgacgattgagcaagtgtttgtggcaccgacataattgttttctgagtcctcgtaataattgattcctttaaatttaaatttcataataaaaagtcctttctttgttatagttttattatagcaaatggcacttattttttactggtaaaactttaaatcaaagttgaaatcacaaaaagagccatattttttgaaaaattcacaaagtcagtgtaaacttgagataggttttatgaatttaatgcgagaaaggaagcgaatcttaatactttttactaaaagtagatttgcataggaaaatatggaactcaatgatttgaaagattcactaactgctttaaaatatggtgaaattgcaactgtcgcgatgattgaccgaggcgcatatgctgaaattgaagagtctattgaagcggaaagtaaagatcaaaagataaattctggaatctttaaagagcttgctgctacagttaaagatgaaaacgaggatttagtggtagttggtcgttcagatattgatcaggcactgactccagaagatttttcgcgatttatcggtcagatgaccaaggaaaaacatattatttttgttgagtgtctctatttgggaacaacagaaattaaaggttttcttaacagcttgaaagaaaataatcttttagaaaatagtaaattggttctgcttgatttgccgcaattagaatacatgatgttgcgagacagtttagctggacaatttaaattataaaaaaagttactgacaaaattatcgctcagtctgtaagttgcgtaagcaagcagataggagtgatagaattttgtcagtaactttttcttattgttcacggttttctctttgataaaggcgagaatttttcataatatctttaaaagtattaatgattgtttcttgataagcagaatttttaatattttggcgagccaaatctaatacggcttgttcgcgagagttatctaaaatagtaattttttgtgcttgtttttcttggctaatttcttgaacaattgtcatacgtttttcaagaagttgaacgatttcttggtccacttggtcaatgttattccggagttcttctagtttattcatggtttttattatatcatagctagcaacacgaaacaacgtttcatgttgctgacttctttctctcatttatgaccgaactcagcgagaacgataatttcccaccaagtgagtgcggctcgttatgttgctttagcaacataacgagagcggacaacgtagcgtagagaagtaaacttcgtttcacttcgttgtccatatcacaggtgtcccttttgtcagcattgctaaagcaacggacaaaagggctcactctaagccagcaagctggcaaggcgaaggacgccatatctggaagcgactgaaaagggagctttcagggtgcagattagaaaagcataacttttcaccttttcgtctgcgcattcacgctttagcgtgttgcctttttggcagttgcttcagcagttagtcaaaacggacagcgtagtagaagcagtgatgcttatatcaaaactaatctaaaatttgcctttaaaaaatgatataatggattatattatttttgaggagcaacaagatgaataaagaagaaaaaatcgaaggttatgagttacttaatttgcaactaaaagcgcttcttagtgaacaaaattatacactttcaaacttagccaatgcaagtagtttgctttggagctttttgcctgagcaagtttatacaggtttctacctctacaacggtgaaaaattaattttagggccatttcaagggtctgtatcttgcgttgaaattataatgggcaaaggggtttgtggggaatcagctcaaaatcgccaaaccattattgttgaaaatgtaaagaaacacaaaaattatatttcttgtgacggtcgagcaatgtctgaaattgttgttccaatggttaaagacggtaaattagttggggttcttgacttagacagttcagaaattggtttttacgatgaaatcgaccaaaaatatcttgaagaatttgctaacattttatgtgaaatgactgattttaaattttttgaagtaggttaaatcaaaattttaaagggtatcggagaaaaaatgagtgaaatagtaaaaaaatttattgctgaccgttttggggaaaaagaaggaacatctgtaaatccaggtaatattggagatgttcgtgaatttgcgcaagaattaggaagttttctctatcaattacatcggctaccaacaacagatgcaaagtcacctagttttgaaaatgcttttgctggttctgatttgattttctttgaagctgagatgatagaacttttgaaagtctatcaaaaagttgttcctgttgaccttttgcaagaaaaatttgattttgcagcaaaaacaaaatggtccaagaaacctgtttgggttttgggagaattgcttacgcaaaatttaaaagttactgacggaaagttagttaatgtcaaaatttctgacaaagctgttattggtgatccagcttttgatttagcaatcgcttggacgatttttgatgaaaaagcacgtaaaatattttttgcggcaaccgaagcagatgaggcaacgattaatcgagcaagaatgttcgccctcagacaggctctcagaaattatcaatcacaagatattgatgaattgattcaatcacgtgatgcttcaactgaaattttaaaagacttaaactatagtcttgggcaagatttctattgaaacaagcggatatgaaaagaatactaagtaaaaaattggaagagaaaaatggcatatcaagcattatatagaaaatatcgaagtcaaagatttgatgaaatggtggggcaagaagttgtagcaacaacattaaaaaatgcgattgtcaatcatcaaatttcacatgcttatcttttttctggtccaagagggacagggaaaacctcagcagctaaaatttttgctaaggcaataaattgtcctaatcaagtggatggagagccctgcaataattgctttatttgcgactcaatcactaaaggaagcttagatgatgtcattgaacttgatgcggcatcaaataatggggttgatgaaattcgagaaattcgagataaatcaacttatgcagctagtcaagccacttacaaggtttatattattgatgaagtgcatatgctttcaacaggggcttttaatgcacttttgaaaacacttgaagaacctacagaaaatgttgttttcgtcttggctactactgaattacaaaaaattccagcaaccattatctcgcgtgttcaacgttttgcttttaaatcaatcacaacaggagacattcggacttatttagcaaaaataatggctgatgaaggacttgaattcgacggtaaagcactcgatgttattgctaaagcagctgaaggtggaatgcgtgatgccctctctttattagaccaagccttatcgttttcatcaggaaaattagaagaaaatgatgcactacttgtcacagggtcgattgctgcagatgctttagtaacatatgttgcagcactttttgagcacgatgaagcaaaagcgctgatggaacttgataagatttttgctgaaggaaaaaatatgcttcgatttacggaagatttattagcataccttcgggatttactcttggataaaaattctcagtatgaccggggtcaaattttttcatggattgatattgcaattgaaagtttgaaaacgataaaggaaacgactcaaacaaaaattgcggcagacgtcatgaccatgcgtttggctgaaattggacaaaataatttactgacagctccgcaaggagaaatccctaatcagctgacagccgaaattgctactttaaaaaccgaaattaatcaattgaaagctcaaatttcagctggtcaaattcgggtaaattcagattcacaaaataatttactgacagaaaaagttaaagccagtccgaaaccaatagcgtctaaaaaacgccaaattaacaaagatttaatttataaagctttggctgaggcgacaaatgaagctagaaaagctgctctaagtgcgtggccagaacttgttgcttcggtaactaaaccggcagaccgagctttacttaataatacagcgcctgtcgctgcgtcagaaaatttccttgtggttacttttcctcatgagaatcttgctaaaagagtcagtgaaaatgaagaattgcaacttttttgtgggaatctcttgagttcaattgttggatttgcgccagaaattatctctcttgctgaacaagactggcaagaagttcgagcggaatatgtttctaatttaaaatctgaaaatgttcaagaagatgaagaagatgaaaaagagccggatgaaacggtaaacttagctaaagaactctttggtgaaaaagtagtcgaaattaatgattaaactaataaaaaagccgctcattgagcgacttttttaatctttatgacgacttaaatcaacctctttaagggggataagtttcgttttgtttttaaatttataacccaagtaaaggatgaagaagagtggaattgcggcatacatgatgacgccttgcacccaagttttaccaaaaagaagcattgggtcttggccgagtgtgactaaaacggtcataattaaggctaagattggaccgaatgggaatagttttgcatgataaggtaattttttaacatcttttccttgagcgacataggcgcggcggaaacggaagtggctaattgcaatcccaatccaagcaataaatcctgttaaaccagaggctgagacaaggaatgtaaagaagctaactccgtaaattgatgtcaagaatgtgagtaaagcaacagcagttgtagctaataaagcaatgaaaggaatcccgttttttgaagtttttgagaaaatctttggtgcgccaccatctttagctagtgaataaagcatccgagtagaggcatacattccagagtttgctgctgaaacgacagaagttaaaacaacggcgttcatgatagaagctgcaatagagagaccaacacgttcaaatacaattgtgaaagggctttgagcagctgaatctcctccaactaagtgggggtcagtaaatggaatgatagccgccatcacgaagatggataagatataaaagacaagaatacgccagaagatagagttcatagctttaggaattgatttttcaggattttcagcttcaccagctgtaatgccgagcaattctgttccttggaaagagaaaccagcgactaagagtacgccgagaatccctccgccggtagtgaaactaccaagtcctccgacaaaaccatgattaccaactgaaagatttttagcgacgtcaatatgaccgcccataattccaaaaatagataagaaaccaataatcaagaataaaacaacaacagtaattttaatggctgacaaccaatattcagtttcgccaaaagttttaactgataaggcattgattgcaaagacaataattaaggcaatcagtgaaaaaatccaacttggaacatctggtaaccaaaatttgatacaaagggcaacggctgttaaatcaaccgctacggtaattgcccagtttaaccaataattccaacctagagcaaaaccaaaagctgggtcaacataacgtgttccatagtctgaaaaagaaccagaagtgggtaaataagtggccatttcaccaagtgatgtcatgaggaagtaaaccattgctccgataagaacataggcagtcagtgcaccaaatggtcctgccgtgtgaatgacatcgcctgaagtcagaaacaatccagttccgattgttccgccaagggcaatcatggaaacatgacgtgattttaagccgcgttttacttgcgtctcagtagttgagtttgaagaattttccaaaattctctccctaataaaatttattctacaccgacttgtttgactcagactcaaccttactcctgtttagtttagaaaagtctgagaaaaacaaaaaaagcaatcctactagatagaatagattgctaaaggtctgacaaaattttaaaaattttcttgaacgaatagccctccgcatggttattaaccatttgcgacagtctagtgagttttcctcactagcccaagaaccttgctgagcaacaaaattctttcggcaacctctcctcctctaaatacgcgtctttgttgtgctccaactcggcgtagattcatatcagttgcgacctctatcgatgtgttatttgtaattctagcgcaattttaagatgatgtcaaggaagagaatgtaaaattaattacaaataatcactttctttgtaagtttattcatttgtcatttatgatatacttatgaggataggactgctatgtcagtcaataaaaatcagtctttttactgaaattttctaggagcaaaatatggattttattcgtgccattattttaggtattattgaaggaatcactgagtggttacctatttcctcaacagggcatttgattatcgctgatgaatttattcgtcttaatcaatcagcagcttttaaagaaatgtttgatgttgtgattcagctaggagcaattttgtcagttgttgttctttattttcataaactgaatccatttaataagttaaatccagctgacaaacaaaaaacaccacgtgaaattcaattaacttggcgtttgtggttgaaagttttgattgcggctttaccagcagcgattattggtttaccacttaatgactggttggacaaacatttttaccattttgttcctgttgccttcatgttaattatttatggggtagcatttattgtcattgagcgtcggtgggtaccaaaccatgaattttccgtaatgaatattgaccgtttgccttatcgtgccgctctttatattggattattccaagtgctttctttacttccagggacatcgcgttcaggtgcgacaattgtcggtgctttattaattggtgtaagtcgtgaagttgccgcagaatttacctttttcttgggtattccagttatgtttggagctagtttcatcaaaatacttcactttttcaaaaatgggaattctttaagttttgaacaatttggggtcttgttagtagcttgtatagttgcctttggggtatcaatggttgccatcaagttcttgaccgattatgtgaaaaaacacgattttactttctttgggaaatatcggattgtgttagggattatccttcttatttatgcaatgtttaaagcctttttgggctgagaatgagataaattatgccaactctctttagttggtattttttattttaaaatagttctctttgctgagggaaagtttaaatgtattcttgctaaaaatagaaaaaagtgatagaatataactctgtgggaaaaactcacaacttacgcaggactcaacctgcgtcattagtccaaaaggaggaaaaatcaatgactaaatacgaaattctttatattattcgcccaaacattgatgaagaagcaaaagctgccctcgttgaacgtttcgatggaatcttgactgacaacggtgctgcaaatcttgagtctaaagactgggaaaaacgtaaacttgcttacgaaatcaatgatttccgcgaaggtatctaccacatcgcaacttttgaagctgaaacaacttcagaagctttgagcgaatttgaccgtcttgctaagatcaaccttgacattcttcgtcatatgatcgttaaagttgaagcttaagagctttcatttctaaggagaagttcatcatgattaacaatgttgtattagtaggacgcattactcgcgatcctgaacttcgatacacccctcaaaatcaagctgtcgcaacattttcattggctgtaaaccgtcaatttaaaaatgcgaatggcgaacgtgaggctgatttcattaactgcgttatttggcgccaacaagctgagaatttggcgaattgggctaaaaaaggagctttgattggggtaactggtcgaattcaaacacgtaactatgaaaatcaacaaggtcaacgcgtttatgtgactgaggttgtggctgacagtttccaaatgttggaaagtagatctgctcgtgaaggtatgggaggcggagcttctgctggttcatattctgcacctagccaatctacaaataatactccacgtccacaaacgaataacaataatgcaacaccgaatttcggtcgtgatgctgatccgtttggtagctcaccgatggaaatttcggatgatgaccttccattctaatagggtaaaataattgacgctaaagcgcctaattatttcacggaaaccgctatggcggatttcctaaccctcttactagttattatgaaaagcagaatcggcttttcataataacgtcgtaatcctaaggaaactttaaacagacatctaaaaataatataaggagaaataaaatggcacaacaacgtcgtggcggcttcaaacgccgtaaaaaagttgacttcatcgctgcaaacaaaatcgaagtcgttgactacaaagacactgaacttttgaaacgtttcatctcagaacgtggtaaaatcttgccacgtcgcgtgactggtacatctgctaaaaaccaacgtaaagtggttaacgcaatcaaacgcgcgcgcgtaatggctttgcttccattcgtagctgaagaccaaaactaataaatgaaaggctgcttcggtagtctttttttgtataaaaatttgacaaatagagttgatatttactgacagaatgctcggtttcgtccgaatttactgaccagaaatttgtcagaaaaagagaatagattgataacttcatcaagtatttttgattaatactatgtttttgtcagtgaatttatgataaaatggacaaatgattgaattgataataggagcagtgctcttaagtttgttaatttatggaatttttatagagcctcatttgatgaaagtgagacatgtaaaaatcgctcaaaaacaaaatttaaaaattgctcattttaccgatacccactttgcttggcacacgactagtcgtcgttttaaaaaatttgctcgaaatattgctaatgaacagccagatttaattattttttctggagatttatttgataaggttgcttgggcaaaaaatcgagattggactgatttactgacgatattgtcagaacttaaagctcctcttgggaaatttgcgatacttggtaatcatgattttgatgatgaaaaatcgtcaaggtttgttgaagagtttctagaaaaagctggttttgttctgttgaaaaattcatcagttgtcaaagagaatttatctatttctggggttgatgactggcgggagggacggcctgattttgaacttgagcctattgatgcaacattttcgcttttagcccttcacgaaccggatactattttagacatggaaacaattaaggaatttgatttaattctttctggtcatagtcacggagggcaaattcggataggaaattggcgtttacgcaataaggggtcaagtagtgctgatgctggtttgtatcagctcaatgaccgaacaaaattgtatgttaatcgtggaattggtttgactttcttacctattcgttttggggtgcctccagaaattgtgtattactacatctaaaaaaatctgtcagtaattttgacagatttttttatttttttatttaaaaatttactgacagctttgttaaaaattctgtcattacatttctcttgcagtcatgatcgtttcgcgtcccatattatcaacggctcggtagtgtagaggccattcaggattaaaagggtagccaaaatcaacgaggatggttgttggactattgtcttgagaaaaacgaatagaaagtaaattacccgaattaaccaagtcaaagttgataattgtttctagtggaaaaacgcccttgaggtgatggtcaataataaaccaaaaggcatcaatgacttctccgggaattgacgcaacagtatcaaaacttgcgtagcgtcgtctagtgttagaaaatgccataaaatcacatcctttctataagataaatggataaattctaggaaatacgggaatctcgaatgacttttcggatttcagataaagtcccttcagaaacatttttcattttcattccgtacatcataaacaaggcatcaagcaaactaatttgagaaactgtggaagcaacggcttcaggtcgaaatgaaatttcttcggaaattgaaattagcgcaacatcggccactttggctaaaggtgaactcgcaaaagaagtcaatgcaataattggaaccccgcgactcttcaaaatttcaaccaagtgcattgtatctctgttttttcctgtatgtgaaataacaaaagcacaatcgtcgctcgttaattttgcagcttgcatttgttgaaaatgaaaatcctgatgataaacgcagtgcaaaggcattctcaaaaatttatgaaaagcaatcaatgcaacagcgtttgaaccacccaaaccaaaaaaaccgcaagtgctggcattgagcaaaatttccatggtttggtcaagttgtctgttagtgataaggtttaatgtagaatttaatgatgaaatattgccgttgaagttttttgtcagtatttctttgtaatcgtcagttggtgaaagttcgctaaaaaattcatcatttcgtgtcgagtcagtggcatgaatggcgagttttaattcttggaaggaattaaagccgatttttttagaaaatctggaaattgtagccgtagagacatgagttttttgagcaaattcctgaattgaaagcctcgctgcactatcaatattcgcaattaaatagtcagaaattgcctgatctgatttactgaggttatcataataacttcggattcggctgattaaagtacgcgacatatcaagcctccttctaattgactacattatatcatagccagtaacacgaaacaatgtttcatgtactggctatcattttattgggaccgaacgatgcgtaggatagctgttatcagtttactgacttacagatatgctagttgttacacctagagcggagtaataaggtatctagggagttcgctatagcgtgttataagtagtgatactcaagatttctcgatttctcaaaaattccaaactcctaacttgaaatttttttgacaaatcagaaaatattttacaaaaaatattgttgacaaatgaaaaaaaattacttatactaaagtaataaaatgaaagcgatgccacggagggaaaaatgatgaaatttggtatgattggtttagggaaaatgggaatgaatcttgtgaaaaatgccgttgaccatgagattgaagttgttgcttacgatctaaatacaaaagtggtagaggaagctaaggattactcagacaaaattaccgctgtcagcacaattgaaaatttactgacagaattgccagcaagcaaaattgtttggttgatgcttccggcaggaactcctacaaattcaacgattgaaatgctctctgaaaagttgtcagctggagatattctgatagacggtggaaattctaattacaaagataatttagaacaaaataaattactgacagaaaaaggaattaaattttttgatgttggaacctctggtggaatggctggagctcgtcaaggcgggaattttatgattggtggagatgatgaaaaatcttggacaatcatagaaccaatcttcaaagcaatctcaatggaagatggctacctctatacagggaaacttggcagtggtcattacttgaaaatgattcataatggaattgaatatgggatgatgcaagcgattgctgaaggatttgaaattttagaagagtcaccatttgattatgactatgaatccgttgcaaaattatggaatcatggttcagtaatccgaagctggttgatggagcttgctcaagaacaattttcaaaagaccctaaactagaccaaattatcggtcatgttcaatcttcaggagaaggaaaatggaccgttgaagaaagcttgaacttaggcgttcctgccccagttattgccttgtcactaatgatgcgtcaacgctcattacaagaagataccatgaccggaaaagtagttgccgctttgcgcaatggctttggcggacatgacgtagaacaaaaataatttactgacagatgagaagcgtaagctaactaggacaaaaaacttctgtcagtaaaaaactactgatgatgaaagaattttaaagtctgtcagtaaatatatagaagaaaaggagcctaaatgcaatatttaataggcgtcgatttaggaaccacagcaactaaggcagtgctttttgagaaaaatggaaaaatagttgcaagtagtagccaagcctatcccctctatcgtgatgctagtgggatggcagaagaatctcttgaagaaatttttgaagcagttttagtgacaatcagggaagtttcaattaacttagaagatgaagacgaacttttagccgtttcatttagtacacaaatgcactcactaattgcttttgacgaaaattggcagccacttacaagattaatcacttgggctgatacaagagcagtaaaatacaccgaacaaattaaagcctctaaaaatggttttgatatttatcgaagaaccggaacgcctcttcatccaatggctcctttatctaaatttatctggttagaagctgaacatccagacatttatcaaaaagcagtccactatttggaacttaaaggatacattttccaacgactttttggaaaaaataaaatggatttatcaaccgcaacaggtacaggtatcttcaatatatttgaacttcattgggataaagaagcactagagatgactggaatcaaagaaagtcaattgcctaaagtagtagaaccctatgagatagaagaaaaccttcctcacgaatatgccaagaaaatgggaattcaaagcagcaccaaatttatttggggtgcagccgatggtccgttgtcaaatttaggagtaaatgcgattaaaccgggtgttgcagccatcacaattggaacatctggtgcgattcgagtagttactgacaaacctaaaacagatgaaaaaggacgcacatttacctatgcattagacaaagagcattgggtagtcggtggtcccgtaaactctggtggagatgttttccgttgggctcgtgaccaaatttttgatggaaaaatttcttttgatgaagtcacggaacttgcagcaaacatttccccgggcgctgatggattgcttttccacccctatcttggaggcgagcgagcaccgatttgggatgccaatgccagaggttcattttttggcctaaactacggacataatcgtagtcatatggccagatctgttcttgaaggggttatcttcaatatttatatggttgcgcttagccttgttgaagtagtaggtgacctaaatatgattcaagcgacaggaggatttacaagctctgaactctggacacaaattctagcagatatttttgaacaaccaatcaatgtgccagagagccgagaagctggctgtttagccgccattattatggctgaaaaagccctcggcctaattgaagatatcagcgaaatcgaaacgatggtaggaacaaacgaaacctaccaacccaatccaaaaaatttcgaaatttaccgagaaattagtccaatatttatccgactttctcgctctctcttggcagaatatgaaaatattgccaatttccaaagaaaatttaaagaagaaaaataaacttatattctttaaagactcaatacttccacatatcacaaaaaagtattgagttaatttttaaaagcaaattgtaagcgccagcaatcgtgcttacacagtatattcaatattttttgaaaggaaaaaatatatgattgatttacttgtacttttaattggggtcttaatcctcctcctgatgattatcaaatttaaaattaacacttttgtgtccttgattgtcgtagcggttttagttgggttaggacttggaatgccactcggtcaaatccctgtttcaatccaaaacggaatcggaggctcattaggagagttagcaatcgtttttggttttggagcaatgcttggaagactaattgctgatgctggtggagcctatcgtatctcaaaaacgcttattaacagttttggtaaaaaaagaattcaatgggcaattatggttgccagctttattattgggattgccctcttctttgaagttgggatggttctcttgattccgattgtctttgccgtcgccttagaagcaagtgttcccttgatttacctcggaattccaatggcagcaggactttcagtaactcacggattcttacctccccatccagcaccaattgcaattgccggtgtactaggcgcaaatcctggaactgttctcctttacggaattattgcagcaattccaacagtcattatcgcaggcccagttttcacaaaaattgctaaaaaatgggtcccagaggcctttgttgtaaaaaataaactatccgcctttggtgaaatcaaagaatggaaattagaagaaactccaggatttggaatttctatcttgacagcattaatgccagtaatcttaatggcaatcagcaccatttattctatcgcgactaatgatgggaaaccctttgccgcagtaacaacaagtgcaatgaaagcagggaaggtagtaacgaccactacttacccatcaagttttgttgaaaatgtgatgatgtttattggtaatcccgtatcggcgatgattatttcactactctttgccttagttactatgggttggatgcaacgtaagaaaaattcagaaattgcagtatcaattgcagattcagttaagtcaattgcgatgcttttgttagttatcggtggtggagcagcccttaaacaaattcttattgatggagggatatcagtccaaatcgccaatatgtttaaagattcaccactttcgccattgttgcttgcttggattattaccgtcattctacgtgtagccctaggttctgcaaccgtggccgctttaacagcagcaggtttagttcaaccaatgcttgcatcagcttctccaaatacagccgcactaatggttttggcaataggggcaggttcaattgccgcatctcatgttaacgatgcaggattctggatgtttaaagaatactttgatttagatgtcaaacaaacattaaaaacttggacagtactagaaacgattatcgcagttgtaggtttaggaatggtcatgttgatgagtatctgggtacattaataaaaaaataagtcaattttgacttatccctttaaatctaaaagtcctgacaggctgacaaatggtcgaccttttgtcaatcccaaataagctgctaaatgtccacctgttgagccaccaataaaagcgatgttatcagccttgaaatctgggatatttttaagaagccaagtgtaggcagcttcaacgtcctcatcttgggttggaaaaagatttttagcttgtgtggccaaacgataattcagagctgcaacctgataaccttcggcagctaatcctgtagcaacttctttttctttgcctttgtctccttgccaccaaccaccgccatgaatcaatactaaagtttttccgttccattcttttggctgatagaggtcaagcgcttgtaattcatctttaccataattaaaagttttcatcttatttcctcctaactacattgtatttctaattcaactatcacaagacctcctcaaagttagtttgagaaggtcattttgtttcttaatttcgtttgtaaatagattatttgtttaatttgaagtacaaatcagcaatatttcctgtaaaatcataaggtttttcatcgataagaacttcaactacttttgcagaatcatcaattgctggaatttcaagattttgttgacgaataaagtcattagcatcaataaattctttgttcaatgtgcgaccatccaaagttttaaatgtaattttcattttattacctctttcacatttaattataagtcaaaagcaaattgatgtcaattaattacgatataataatacgaaataaaaaatattacatcaaagaaaatctatttaattttttatcttttttaaaaatggcgcaaactgtactaaatttggcgtcaaatgtcattttattcttgctaaactttatctataatagttttataattaataaaggagaaaagatatggcaattatattaatcacaggagcaagtagtgggattggctatcaaacagcagagtttttagctcagaatgggcgtaaggtttatggtgcggcacgaagaatggacaaacttgagaaattaaaaagcgtaggtgtcgagccaatttatctagatattacaaatgaagattcttgtagtaaattggtagatacaataattgacaatgaaggacaaattgatatactaattaataatgcgggttatggttcttatggcgcaatcgaagatgttccgcttgaagaggctaaacgtcaatttgaggtaaatttatttggactagctgctctaactaaactagttttgcctcacatgcgtcaccaaaaagctggtcggattattaatatttcttcaatgggcggtagattcacaacctattttggtgcttggtatcatgcaacgaaatatgccttagaagcttttagcgatgccctccggatggaagttaaaccctttggcattgatgtttctttaattgaaccaggaggaattaaaaccgattggggattaatcgcagccgatcatttagcggattctgccaaaggaggagcttacgaagaagccgccttaaaaacagctaccggtatgagaaaacagtattctgggaacatgatgtctgaccctaaaataatttcaaaaacgattttaaaggcagtcagctcaaaaaggatgagagctcgttatttaatcggttttggagcaaagccccttgtctttcttcataccattctgccaacaagaatttttgattggctaatcatgcgggccagttaataaaataaggaaaattatgaaaataagtattgaccaacagtttcaaaactttctcgaattacatcatttagatttgaaccttcttttagaagaagcccaaattccaaatttgctttggaaagaggaaattgttttaacgaatcaacaattttataaatttcaagaggtcctatcaaaaagattgactgatgaacaacttcttttgataagtgatgtccaaaattttggattatttatgcctatttttttcgtcgctctttcttctgctaatggcttacaagctataaaacgtttggcaaaatataaaaatatcattgctccagttgaaattaaagtcagtattcaagaaaaacatgttcaagttgaattaaatgatatttctgaaatacaaaatctttcacgtttttctctatttaatgagcaacttattattttaagtattctaagaactggaacaggccaaaatattattcctgaaaaagtaatcagtccttatccattcagttcttcaattttggaagtttttgggatttctcctgagctttcaaaaaatgataatcttttgagttttaatctccaagatttagaactaccttttttgaccagaaataatagtatgtggcggatgatagaacccgaactgaatcgtcagctagaagaaatcaaaactccttctgacttcatcaatagccttcataaagaagttcaactcttgattccttctggggactgttccattcaaaatgtagcaagaaaactgggaattagtagcagaacccttcaaagaaatcttgcacaagctggtactacatttaaagcagagttacaatccgttcagaaaaaaatggctctccatttttcaaaggatttaaatctcacaactgatgaaatttcttatctcttaggatattctgaggtcagttctttcactcgagcttttcgcaaatggacgggaatgactctaaatcaatatcggaaaaagctgacctaaaataaaaactaggacaatgtcctagtttatttcatttatcgtctaacttttggattagtaaagatgtcagaagagtcttcacttgaagaagaaaactctgaaataattgccccgtccttcccagcttggaaccaatgaagtatgttgggtgcaatcgtgaattgttcacctgcattaagaatgatttcatgtcttgctgtataccactctttgttaccactgggaattttggcaattattgttttgacatttggttctcctgtaacataaagataaacttgcccttgacgaacccggaaggtttcttcttttccttcaatctctagattctgacctcgatgtggatgtttatgttctgggcaggtttgtcctgccaaaagaaccatttcctttgcacaatagcggtcgttattaatatagatgattaaattcaaaccttcttgcttaatattatttaacccaaaatctgcatattctattctatctagttcttctcttgtaaaagctatttttgaatctttaaaagctcttctaacactttcttcgtagttcattttctctccttatgatattttgaggtctttgaaatcgatttcttcctcttctttttcttcgaattcaatcatttcatctgggttaactggtttcatgatgataataaaagtaagagcttgagctactgaaccgatgacgagggcaagaataaaaagtaggccatgattacctgtcatagttggtacagcaaacatacctgacgcaggaatatggctatcgcattcccaaaacattgataatgctccaaaaactcccccaccaattccggttgcaatcatattttttaaccaattcttgaaaacaattggaaaacatccttcagtaatttgacagaatcccattggaatagccgatttcaatgtttctatatcttgtttatcaaaaacattttttttgaatattttttgaaaaatcactgcaaatccataaccaaaaggtgtaatcattgaggctccaattaacacagtgaggggtggataaattccttctgaaaacatagtaaatacaaccgcaaatactgttttgttaattggaccaccgtaatcaatagatgataatactccaatgattaaaccataaatcaaaagctgcgatgagtctagattcatcaaataatctgttaatattttgaccaaataattgattggtgtgccaagaatatagtacatgaccattcccccaagaaatgaggaaacgaaaggaacaatgagagtaggtaacaacccctccatccatttcggaactttaatattctcataaaagaggagggtgataatcccaacaacaaaacctgaagcaatccctccaatgaagcctgtattaattccgtgggcaacaaacccaacaattaatcctggagcaattcctggcttatctgctatcgaataagcaattgcggttgaaacaatcataggtaaaaaaccaagaccatatccccccatggtggacatcgtatcagcaaaagaaaaagtctgtgaaaaatcatcaatactttcgccacccatgatattacctatagccagtaaaaaaccagctgcacaaataacaggtagaaaaaaggaaattgctgtcattaaatgtcttttaaaacctagtgtttttaaagtgttcattttcaggctccttggtaaatttcttctaatttttcaatcaacttattaggtgatttcacaacaagacttgttggtacttctacaatttttttgcctttaaatcgctcacgaccactaattttaatgtcagctgcaattattacaacatctgcctctgcaatttctttggagtcaagtttattttgaagtccagccaatccttgggtttcaatgtggacttcgtgaccatgttctattgcggattgagtcaatttttctttagcaatatatgtatgagcaataccagctgtacaggctgcaattccaacgattttcataataagattccttatctctaaaaagtaatcgcttacttttgtatttttaagttatccctttgattaaatttaaatcaaagggaactttttattaattttattgtttagtttattggaaataatatttagctttatcaactgctccaaaaagttgatttttatgatgaactactttttctgtttctttcataggctctgggaagagcacatttggttctcttttttctaaatttccatcgtttaattcgtctcgtaatttctcagcgaatgcaatcttgatatctgatgatatatttactttgttaattccgtgagtcactgctgctttaatttctgaatctaaattatttgatgctccatgaagaaccaaaggaattccagtttccttaacaatttcttctaaaacatcaatggccaattttggttgcatgccttttggataaagtccgtgagaggtaccaattccgacagccagtgaatcgcaaccagtgcgtttaacaaattctttggcttgttcaggagcagtatagatgcctttttgatttcctccttcgacattgtttccagtatttccaattgtccctagttctgcttctactgagacccccacggcatgtgctgtttcaacaactttttttgtaattgcaatattttcttcaaatggggccaaggatttatcgatcatgactgatgtcatcccaagttgaatggaatgaatcacttgttcataagttgctccgtggtccaaatgaattgcaataggcaattttgtcttattggctgcatcaatacatgaagcgacaaaattatcttctaaaaagcttaattcgtctggatgaattgcaataataaacggactttgatcttcctcgcatgcttttaaagtagcatttagcaatgggcctgagccacaattataagctggaattgcaaagtttttctcttttgcgactgcgagtagttcttttcctgttactaaaaccattaggatctcctttataaaaattattattttaaggcaaaattgccatgtacgcttaatgagtttttgtcagtaactgatataagttatcgactgtttctacttctcccagtttattaagaaaatcatcgtgtgctaagagttgagcgacttgttgcaacaataaaacatgagtggtagttgcatcgatatttttaacagcaaacataatcactacttttactggttgttcgtccaaagtttcccactcaatttcgtcttctaagacggcaactgtaattgttgtatttttgactgataaggattttccatgcggaatagcgacaccttgaccaattcctgtgacaccttcggtttcgcgtagatagacatctttgataaattcttgagcatcattaacataacctttactgacaagtaaatttcctagttcctgaataacttctgatttacttttcgactttgacggaacaaccaataaatttttatgaactacttttttcaaatcgatttcggtcatttttttccctacctttttctaaaatataatttattttttgaacatcattttcggttagcaatggattgataatcataattggaatattaccaatagcctcaatcggtgtgtcaattgttgtcaggattaaatctgtatttccagcaatataatcttgattttttttcgcttgtcgattgctcatcgttcctataatatttagatttggaactttttgctgaattctgacttttaataattcgcttgtcccaatacctgttgaacagactagtagcactcttttattagttttaatttctaaataatatttttcaaagtaaagtgtaatatagccaatctctgactcatcaatttcagtttcaaatgcaagttcgtgattaattgaagcaattatttttgatattttttcaaaggatttattatattttaatttgacttcatctaataaattattttcaatatgaatgccaagtcttaaacgtgagagcatgggcaaaatatggtgatataaatcttcacgaagcctgtgactgaactttaaacttgtgacttctgatatttcaaaaaaatcgagaatcagatttttagtaagttcatctgccaattgttcatcgattttcaaactttcttgtctgctcaaattaatggcatataaggtttgaaacaataaaagtttctcaacttcatctaaggaaaaattaagataatgtgataggttgtcagtaatttttactgacagacttgagagatgtttgttctttaacataatttcacgctctctatcatcaattttactgatagaacgttttatattgccctctctcacgcgtttaactaatactgatagatgaagctttaccatccaatcataaggataattgagatattgttccatttgttcttcaattagctctacttgatgatcaataaacttactatctcctgaaaagagtcgaaggcctattttatgaatacttttatttttatttatcagcataattaagttattaattgcttttctaatccgtggctcttctccctcaatccagacataatgttgctcagccttaaataatagttcatcctttttgaaaatttctttaattttcttcaatttatttgttttagcactcgcagataaataatcagtttctaaaacatcatctcttctcttatagggatgactaaataatatcgtcaacatgattctgaataaatcattgtcattatcttcatgctcattatgttctaactctttataaatatctttatctttatagtaatcagaaagtttaaatcctttgcctgcttgagaaataattaatggttttccatgatattctaaatatccttcattaattttaataattattcttctaattgttttatcagagacaagtaactgtttggctaaagctatggcagcaacataattttcaaaatttagaaggcccattacctgtcgttcattggtatttaaaaacatgattgttcctttcccctcttttccttgttactcttatcttatatccttattttatcctactttctagaacgtgattacttttttttgtccagaactctggacaaatttttaattaatatattttagagtacaaaaagactctaactgtgagatataaattagtattcttatttgaaaaggaatataactgtgatagaatattaataaaattgaaaataggagatatcataatggcaagagctcaatccaaagaggaattaattactttttctgaagaaagttggcagaaattatgttcactaatcaattcactaaacgaagaaacaaaaaatgataattttacttttaatgttgaagataaaaaagaaaagcattgggcaagagataaaaatctaagagacgtcatggttcatctctatgagtggcatcagttattaatcaactttgtcgaaaaaaataaaagaggagagaaaacgccctttctgccctctccttataattggaaaaattttggtgaaatgaataataattttcaaataaatgggcaaaaaaaatcattatctgagataacacaacaactttctgaaagccatatggagctaatcaccctcattgaaaatttttcaaacaaagaattgttcacaaaaaaatattttgattggacaggttcaactagtctggggcaatattttcagtcttctatgtcatcgcactacgagtgggcttataaaaaaattaaattacataaaaaaacctcagaactatgaggttttttatttttattattagtttcttgagtttaatcatttctgtcagtaaattttactgacaagaacagtcctgacagtcttcttcacatccgagattttgaaaacttaagcccgtgatttctgtcaaatcttccaccgttggatagtcaccaatcaatgtgatttctccatctacaagggttagaggtaaaacatcctttttttccaacatctgtgtcacttgaggatagttttgaaaaatttctgactgattttttaaattgtaacgtgccatttgcaagtcttcaccacatttaaaagtggcaaaaacttgggttaatgtcatcatttcattactaaattcgggaatatcttcctcaaaaagttcaattttcatcttaatgtcctgtcttttgtcattaaaattattatatcaaaagagcaggtcaaattcactaacggagacgccaaggaataaaggtccgaatatcttcgttattataacctataagtaaacgacggtcatcaaaagtaattggtgaacgtaataattgctgatttttcaaaataaattgaatcatttgctccgtcgaaatttggtccatatcacaagaacttcttagttctgaataaggtttgggtgcttttgattcagaaacaataatttcctcaaaacctttatttgaaagctctaaaactctgacaatatcttctttacacaatgaagttttggaaatgacaacataaggaatatttcgctttttaaaccaactggtaacgcgctcagctgactggtttgaacttgatttttggtagattttaatcatcttcacgctcctctcctttataaaatctattgtaactcatttttgcgattaaaaattcagacttgagatgtatttcttaattttaatttatttttgtcagtaaatttttagaatatttttactgacagattctgtcagtaatttttgctccaaaaaaagtccttggtcagtaaaaccaaggacttatattaggaaattccgtcaattttaatttcaactaatcctctgacagcatttgtcatataaaaacaatcgtaagttttcaaatcagaaaggtcaatatctttatatattagcgtatgatttttcgcaaataaatctaaaaaagttccttttagagcatatttggctggcgtttcgtactgattacccttttttgccacaaaatttccgattgataattcactgaccaaaccatctgtatgaaatagaatatcttgaaacccttcttttttcgcatctaagacttcctgacgaaagaccttttgaaaatctggacctgaaagtttaaagttagacaaaagactaggttcgtcattaattgacgacagtttaactcgatagtcctcatttgaatgcgtcagttgacgaatctcaggggtcaaagaatctccgtcagtactgacacgtaaaactctgtcagtaacattttgagcaaatattctcaatttttcttccaaatctggatgatggtattgttttttcaagcgattgacatgcccctctaaatttaacaattcaccatttttgacaagacctgttgtaaataaaatacttggaacatcttttacacctaatatatctaaaaaaggttttgcttttagtaatatctctgaaaactctgcttctgcttcgctctcgaacgtaattccaccgcctacaccaagctgataatgctcaccgtcatgaaataatgtccgaatcacgatgttcatatccaaatccatttctcgacttaaccaaccctgcatccctgtataaattcctctgggttgtttttcaacttccttaataatctccattgcccgcttcttaggtgtacctgtgattgaccctcccgggaataaagccgtcataaattctgaaaaagtcaaatcttctttaattctactttttattgaagtcaccagttgatgaacatgagaaaaagtttcaatttctgcaaatttagggacagacaaagaaaaaggttgactaattcgggcaatatcattacgcaataaatccgtcaccatcagtaactcagaccgttctttactactattggaaagtatttccttttgtaatctatcagcgacaacattttctcctctggcaattgttcctttaatgggttttgaaattaatgctccattatgaatagaaacaaagcgttccacagaacttgatatttgcgtcattttccattcaggatattgtaaaaatgatgagaaaggagcaggaatttgtttccttgttttcttaaaaacatcaataggtttttgatcggaccaaattttaaattgttgcgtcaaattggcgacataaatatcgccagccttcatataatcttgtaatttttttattgaagcaatatattcttgcctcgtttggtcaataaaaacagcccctatgccattctgaccatcaaactcaatctctgaatccacttcaatttcttccgattcagtcagccaatattggccatcagtttgttcaaattgcacgacccgtaacagttttgttatatggtcaaaaagtaaaacttcatcataagctgcaaaacaagccggatcttgctcataacttacaaaacccaataattctggataaaaaggccaatttttaggtcgttcaactctctcatccttcagcaaatctaccgcatctaaaaaattgaacttctttttttcaccattaaaaaacacttgacccttatattttgaaacctttttataaggtttatgagctaaaatactataatgctcattttcggtcacctgactactatgtaaaaaaacaatttcttcatctgaccgataatattttaggaaaattttccaaatatccgtattttttattataaattccttcaaaagactacaccactttcaaaaaattatttaacatttcatgaccatattcagtaactaaactttctgggtgaaattgtaaagcccacaattttaattttggctgatgaatcgcctgaataacaccatcctcactttgcgcatcaatttcaaaatcattaggtagtttatcgacaatcaatgaatgataacgtgcaactttcaaattttgtggaagtccattaaaaattccttgacaattatgacgaatgacagaaatttttccatgcattggcctctcaccaagaacaacatttcccccaaaacattcagcaatgacttgctgacccaagcaaattcctaacataggaatttttccagcgtataattgaactacatccctactaaaaacggcttcttttggtgtttttggacctggagaaatgataatcgcatcataattttcacaaataaaatccggagaaattctaattttctgactcattttatcttggtcattaaccactgttacactacaatctaattcctcgaaatactgtaccaatagataagtaaatgaatcataattatcaattaaaagcaatctcatttcagcctccttcttcaattatactaaaattatctagtcaagacctctactggtatcttatctatagattgtatttcatatatttggattaaagtcatgaataacttttatggaacgaacccaaagtatgcttccaaaggcaaatttgcttaatatccattaccaaataaagtaagaattgacgaatcttttttgccaaaaagtctgtagcaagagctgatacagctggcgttctaatccaagtaattacattagcgttaaccaatacaacaggaagtccatttttgaatcaaataacattacttctccaacatgagaaaggagatttaaggcatgattaaccggaaaagcagttataattttagcaccaaaataacgattttcaccaagacaagctagcattaaatcaaaaacacttttattttttccatcaggtaatatttcgacaattcgttctatttgagcaattgttccgttctcatgaccttttaaacaatcactcattaactgaattgattctttaaaacttaaaagttcaactacttcatcataacttacttgtttcattctagttccttttgctaatatataaattttcttcgattaatattatagctttacactaagtgagatacaatattaatattgtatggtatatcattgattgattttattcctcaggaacttcatactataataaaaaagcaactatcgcttaatagcgatagttgcttatatagaatattaaattcgtttagccaaatctattatttaactgcaaaccaggctgtctcaccatatttccatccgatgctgagcaatgaattttgttcgaatgagctcatagtatagttgtgggcacctgtttcagcattagggttataggcaacatatactgctttgcttccgcctgaatagaatacaggtttagcattgttatcccatttccatcctttagatacaagactttttgcttcatactggcttgttgtatagtagtggtctccacctttagcgtttggattgtaaacacggtagattgctgtaccacttgttggagcagtttctaatgttccttcatttctccaaccagctttgatatcttggtcacgttcgtaagctgatgttgggtagaagtgttccccagtatttggattatacaaacggtaaactacttgagttttatctggatttggagttggttctcctggaatagtagcattagccgcaactgatgtgtttccactagcatctgctgcttttgctgaaatttttgccccacctttttgttcagtaatattaacagttacagtagcttgtgttttaccgtcagcagttcctggaactttagcactaccaattttagcacctgatgcattgtaaacagtaactgttgaaccagcctctgcttttactattagagatgattttttaacattgctaagaacaggagtagctggagcaacaatatcagcgaatactacatctttgtttgcatctgctgtattttcaaaaatatcccagctaattcctgaagtattttcaataccagcagtaaagtttgttgtcaaaccattaggagcatattgttcaaaccagctcattggtagatttaagtctacagggaatttaattgttgctgatgtaaatacacctgcattaccaaacatacttgcaatatttgctgaaccgttgataatactcttaattgaattaagagctgcattgatacctggttttacaatatttgtaattgtattaccgatagttccgaaaatcccgcttccccaattaaccatattaattgcattttgaaggttatcaagcatagtaataatttgatttgcaatatgacgagcagttgcatcgtcgaatttagcagtcgcaacaccatcttgaacggtaatatttgaaacttgcttagataaatccatattttggaaagtttctaaaacattaagagcatcataaactttatccaagttgcttccagcaaattgaggattattcaccataattgcaagttgttttttgattgcattatctgttccagtagcaaggctattaaaaagatctccaagtacaggaattttagtgatattaatccccatttggacagaaacatcagcattatcatcaaatttgatgttatttgctaattcagcagggattttaatttcagcagattttaatgtttgaagtaaaatatttgcttgagcaccaatattattcgtaacagtaagtgtccccatatgtgaacctgttgtattaattggtgaaccataagtagaatcaagtttagttttagaagctagtgtaacgtctacttctgaggcttgcgcagtaatagatgtagcattcatcaaaggaactgccactgcacttgcaccgatcaaagctgttgagaatagtgcaactgcactagcctttttgaattttttcatttttctttctccatttagtttttttacttcttccctctaaaataattttagaaggtgacaatgagtcccattatctggacggaacaatatttattaaccttttaccccctttcaactaacaaacaatcatatatcgtgtctaaagcttcaaaattaggattttaatatctatttaagacttgactcttttagtgagagtatccagtctaaacttaactcaaaaatctcttttctttgggccatgtttaatctttcaaatatctcttttatagatttaacttctttatctagactcttaccaatcaagaattctggaaatacttcaaaataacttgctaattctagcaatcgaacagctgaaggttctcctctacccttatagttatttaaggcattacggggataaccgagttctctttctacctgattatttgatttatgcgataggcgaacaagttcttctaaacgcaagtaaaaattactattctcttccatactctcctcataaactaaatattattttattttaagataacctctaattttgaatcttaattatattaaggaattcttttctataatttcaagtactttcggaaaaagattagtttttcttaaagactagccttatttgaaatttttttacatttaaaacttcttctatgaataagtttgataaattaccttcattattcctataattacagctttaaatccctgttatatatattgaaatcaataaataaaatggtatagagtacatgttgtaacaaattaactacaacttttatggtttacacttatataactttatgttctactgtttacaataaggttgatgtattatatcgcaaacactttagtgtttgtcttttttttattttatagaataattttttattttttattcattattttttaccaaaatagatataaaccctttatagagccattcctactttctataaaaaaagaaataatgacataattgtttttatatgtcattattactcatattgaatatcgtttagaattttatttttacgattttataattttttttatatgtaaatactattcaacttataagtaataacaaaaaggacctagataaagtcctttttttaaggctattacatatattcttcaaacataaaacagctaaaattaatcaagaagactatctatcaagccctttataaattttgtctaaattccatttcatcatactatagtagctatccccattttctccttttttcgccactgaatctgtaaatattgttgaataaattggaattcctgtatccttagagacagttttcattggtcggttatcaacactactttctacaaaaagcgatttgagttcagtagctcttaactttctaaccagattttttatttggtctggtgtgccttcttcttctgtatttatctcccaaatataagcagagggaatattataagccttagaaaaatatttaaaacaaccttcgctcgttacaatcatcttttcattttcaggtattaaagaaaatttggattttgcttgctgatcaagatcagataattttttaacatatttatctaaattatgtttataaaagtccttattaactgggtcttttttagataactgttgttcaatattttttgcataaataatcccattctctaaattgagccaagcatgcgggtcttcttttccttcagtgttatttccttcaagataaatgacctcaactccagtgcttacaggaaaataatcaatattttcttttttatttgcattattcactagttttgtaaaccatgcatttccacctgtttccaagtttaaaccattgtaaaagattaaatctgctttagaagttttttgaacatctacaggcaatggttcatattcatgcgggtcttttccaaccggaactatactatgcaaattgattttatcatcagcaatattttttgtgatatctgccaaaattgaattagtcacgaccacatttatttttttatctgtgacttggtctgtttttttatttgagcaacctactagaaaaacgatagcacctagtgctataaaagttatcaatatatttttatattttttgttcatcaattttaaccttcttttttataaaattttgttttggtgaaactaaaaaactaattgcaaaaatgatagctgaggtaataacaatgcttgagccgacagcaatattaaagctataacctataaataaacctaaaacggaagaaactgcccctaatgatgaggagagaattatcattttcctcaagctattagtatataaatatgctgttgctgctggcgtaattaacatagcaacaattaaaattgttccaacactttgcattgcagtcactgatacaagcgtcaataaaaccatcaaaagatagtgataaaaattaactttcattccaattgctcttgccattaaggggtcaaatgatgtaattaaaagttccttaaaaaatagaacgatgacgactaagacagctattgaaacacctattgttaaccatttatcaatatcttgcactgctaaaatatttccaaaaaggatatggaataaatccgttgaactattggcaattccaattaatataacacctaaagctagaaatgaactaaatgtaattccaatcgcagtatctcctttgataatactattattttttatgaaagtaataattatcgaggaaagtaatccaaaaataattgcccctacaaagaaatttattcctaaaatataggaaatagcaacaccgggaagtactgcatgagaaatcacatcacccattaaggacattcctctcaaaatgatgaaacaaccaagtgctcctgaaactacgcctatcacaactgctgtaactaaagcattctgtaaaaaatggaattcatataaaccatttataaaattctgtatcatttgattcttaatctcctataaatatattatctccatatgccgcttttaagtatttttgattaaaactatctcttactgaaccataagaaattaattctctatttaaaataataatatcatcaaaatactctcttactttgcttagatcatgatgtactattaaaatggttttcccttgactttttaaatcttgaagaatattcataataatcttttcacttattgagtctatccctacaaatggttcatctaaaaagatatagtctgcttcttgaactaaacaccttgccaacaaaaccctttgaaattgaccacctgatagttcacctatctgcctattttcatattctgataagttaactttttgtaaagcgttagaaacccttgaccattctttatttccaagtttttgaaacagctttaatcccgtataagtaccaagagatacgcactccttaactttaattggaaaagtatgatcaatatcacttttttgctctacataagctatatttttcagttcctttttacttaccttaccatttattaatatttttccagaatgtggaataatattgagaatagccttgattaaagtagattttcctgcaccatttggtccgataataccagtgattttcccaggtttaacttctagttgaatatccttcaggactttattttcattatagaatacatttaaatgtttagtacttatcattgttctctccttatgctggtaaataaaaacttataaatcttttcacaattatagcatacgctaaatatttaatcaatatattttgcgtaggctatttatcttttaatattaattaatatatttgaaaactcacagttttctttccatactaaattgcagatttcgttctcaaaaagtttaagtcataagtttggattcctgcactattatctgttatacttcaagtaagatcttttagagaacgttttcatttacgcaaggaggcaaacaatatgacaactatggttcttgtaaattttccagtatctgatattgaagcatcaactagtttttatgaaaaaataggtttcaaaaagaaccccgatttctcggatgagttagttagttgtatgatttgggatgaaaatttctttatcatgctattatcacgcgctcgttataaaacatttattggcgaaaaagaaattgcagatacgaagtcaacaagttcagcattaatttcttttacttttgcaaacgctcagtccgttaagaatttcggaaaattagcggatgaaaatggtggaaaaactatccatttagataatggtatttctgaagaaatgatgtatggtcttgaagtccaagatctagacggcaactgtttagagcctgtttggatgaattctgagatgggaaaaaattgatttcatgaaaaaatttctctaactagtaaaaaggctctcacaaacgagagccttttttattttaaaaaagaaatcttatattttattttcaaaagaaactagttaattatctttcaaatttattctttctccatgcaattcctccaattgtcaatactgaaagcaaacctaagccaagtgccatcaactctgaactcattaattcatctgagcctgtagtaggaagtgaagctccaaatggctccgatactataggcgtactaagaacattcaccttgttacgaagagctgaattattaccagtcgatattgtaggaacagagagtgcagtgttcccaacttttgaaaatggtactttttctattacttttactctcatattatttccaagagtgtcatctgtattcactccatctttaccattttgaccattggcaccatctttacccgctacacctgctggcccttgcgctgaaactcccgtatcttttccattgataaagatatctccattatttccaattgtaaatgttggactttctccatctttaccatttgtaccattttgaccatcagcaccatctttacccgctacacctgctggcccttgtgctgaaactcccgtatcttttccattgataaagacatctccattatttccaattgtaagtgttggactttctccgtctttaccatttgtaccattttgaccattttgaccatcggcaccatctttacctgctacacctgctggcccatgtgctgaaactcccgtatcttttccatcaatataccaatcaccattttctccaatgctaatatctggctctttaccctcaggacctgttggaccagttactcctggatctgtggttccggtaggagggacaaccgtgagtgatccttcaccaggaagtgttacacctcctgttgcagctgaactacttatagaacttgaggaactactagctatacttgaattattagttgcactagaactttcagcactgttattagaactagatgcaacattactgctattacttgtcgagctagaactatttgaattgtttggtgcaacaaccgtcaagcttcctgatccaggtagagtaattgggtcggcaaaagtaactgtacttgtcaatatgtctcccacaggaatacttgaagcatcaaagttataagtcaaaacaacatgaccagcaccgatattatcaactaccatatttccatgggcggtagcaataattttacctgtatggctgtcataaagggtcccttccgtaggttgagaagtatttgcgtccatcatatcattttcaacttgaacaaaatcataggctagttggtttccatccgcataaatttgtccttgtaaatacgctcccgcaagttggtgattaccagaagcaacataaactggcgcagatgatttataaattttaccagttataggatcaatgtaactataatctactgtataagttccgactgagtttgtattaacgtatccagatacactgagttcatccaatgataaactcttacctccagtgatgattgcagaaacgaagccagcatctggagaatattgatccccaacaaatacggtttgagattgggtcgtaattgttacagcactagttggagcaattatagggttaatattttcattgttcatttgatagacaatttttgtataaccagcctgtgtaggagcgctgtttaaacttactcccgcagtattccctccttgcgtagatgctgcagcagttcccattgttgtagttgctccatttaaagttggtttaactacaaacgtttcgggtacaaacataccatcctgatttgatcctgtaacagctttttgaccttgataataatagttttcgtatgcaaggttttgactaatctgactggttgggtcttgtgctgtaaacccaactgtcatagttgcagatgctgttattgtaggaatagcagctgttcctgtaccatttgcaccaacattcccaccaaggctgagaacaccatcaatcacaccaataccaaattggatagcatcaagtgggctgcttaaatttccttgtattgaaccagcaatagcagaatttgataaattagcaatattgcctattcctgctaaagtttgacctaaagaataccctatactattagttccgtttgttaaaccatttgtaatatctgcttgtaatccttggacaatagaattatatccttttaaagcggtactataagctgccgtggttgtattgagtataccattcaaaaagttatctacaatagcaagccctgtataagaagtattacttgagtaatcatcaaatagatttgtaatcgaacttggtagagtaacaatcgttcccagttcattacctactgattgggtataatttgtcacaagattagttgcccagttagctacagcagtaataaagccatgaccacttccttgaacggtaaaggtaccatcaccgttatcaacaactggtgcaagataattttcagtaaatattccgctcgttggggagctagcatttgccaatacctttccagattcattaatagaatttattgcaaactgaacattattaccatactgttgtaaagctgtcgctgcaaccgtagttatagactgaatctgagtagcaacattataaattccttgttcaaaactagtaggattaatttttaaaagttcaccaatagtaggtccagagaaaagtgctcctccagtaagtggatttggaatagatatttcattacctaaaacggtagtaattaaattattaagttgttgttgaccgccatttaaaatagaattaaatgacaactggttaaaaggcgaaagaatagtatttactgaacttgaaataattccattcacataatctgttgctgagagtccaacatacttaaggacgttgtctggaacacttacagctggatcaataacagcctctaaagcaccagtaaaatatgttgcaagagaggaagctaagttaccattcaaaatttgattgattgtatcagtagttgaaacccaagcagagcccgcacctgcagctatatcatttacaagggaagccacacttcctactgcacctccaagagtattagctaaagcttctgtcgtacttgagtcagcagtatattgaatgctaaccattgcagtactggctgctgaagtgacgatatagccagtttcttctgcgctcatcatattttgcattgaagcaatggctgtactatttgcagtaatactagtcaatagattcgtcatctgtacaagtaaagaagccgcacttgcattaaatccacctgctgcaattacttgtgattctgcggcagacaatgaagcataatcaatcgccatagaactagtagtttttgacaaatcagcaatcgaggatgcaatagcagaattttttgtagttgtagaagttgattgaacaaactcttcacttcccaccacatcgttcggatagtaactttgagctccttcatttattatttgataagaaccaccaattgtttgtgccgttgcattattttttacagcgagagttgttgtagtcccttgtaaattagctgtcgattcctgatttgctgcataaattactttggtatctgctactgatagaccagcctctactaaatcagaaggggcttcaactgtccatgaataatttcccccagacagaatatcattagctggttctcctgaaggtactatttgagtttgcttaatatcaaatgatgttgaagagtttgcactactaccagcttgtactgccccattattatttaatgctgtgctatttgtaactcctaaagctggtgaggctgaggaatcaactctgttaacagaactattaacactataagttccgtcagtattagttgtatttttagtttctggaagtcctgttggagctgcagtagagcctaaagagtttgaaattactgaagttccatcttgtcttaaaacaacgttactcgtactcgttacagttgtagaactagccacacttgaggtagctgctaaactacttgcaaccaccatatttgaagaagtgattgaactttgcagtgaattagcatatgaggcattatcagcgcctgcggttgcattagatcctaaacctccggttgcggtattttccgtcccagtagcacccgctgaactaagaacttgtccatctgcatgtacgtctagttcagttcctaaagcacctactaatataaatgcaataactgcagaactataaagccaatttttaccagatttccaagtacgaaattgagtgtttacttctttgagattttctttcttaagtttctccatagtttattccttttcgtttaaaataaaattgtttcacaataacataatacatttaaattaataataattcaagtgtttggaagtattattcatgatttgcttttataaatagtttcctttttgatatttttttaagacataaaccctctattataaacagttttatatagattacactatagaaaaatagtttctattcatcaaaaacccactttctataatgtataattattcacaattgttaaaaaatcgagtaacagcctaataccaacctaatagttgcattaaacaaattattttctttcattaagaatccaataatacttgttgtattttttttaaagcgaaataaaaagatttcgacatacaaaaattcttatttttcgccatcaacagtaattgtagacaataaaaaaagcaaaagatataaaacctcctgccttttcatagaactaactccataatcttttcaattaattatctaaaaaacccatttgaaaaatataaacaacttcttcttgattaaaataacgaatcgatttgagatttttatatccttctggtattactattgctgaatagtctagctcactatttgaatctaactctacttgcttataaccaatgatcatcaatttttcacttcccccagcaagtaaaactacactcccaagtggcagaaaatcctttaactccctcataatttacaatttcccttattgcttcttcctataattcttatacgttagagtaattataacatttacttgaacacaaagctacaactgaaatagaaatattacatcatttttagttagcataaaaaaaattatttaataacagatttaatattacttctaccatcccccattttatttatgataatttgttgtccaatagttgctttcatttcctctacatggctaattactccaactaatctattttcaccaatttgttcaagagcttgcattgctttttgtaatgtttcttggtcaagagaaccaaatccttcatcaataaatagtgcttctatttggacaccattagctgtattttgtacgacttcacttaaagccaaagcaattgacaatgcggctataaatgtttctccacccgataaggtatcagctgaacgagccgcccctgtttcattatcataaatattaatatctaagccatgatccattcgtcgattatttccctcgccagcaagttcaaatcgatatctattgtttgacaactgattaataaaatgaaggttagcataatcaagaattttttctaaataattttgaaccacatatgtttcaagccttagtttatcttcggaagctctaccagaaattgcattataaagcttagtaattgcagcttttttgctagcatccttatcttgttcttttataagtttttttaactcactaagaatcaacttcgcttgctctacttcattttcagcagataccaattttttttgcaaaaaaacatagttttcatttgtctgtttcttttcttcttcaatcaatgcaagatttggtcgctttttattttgaattaattgctgaatatttttaatttcgactttcaatcttgctttatccgctttatattgttcaactttttgggaaatctgaattaaatcatcatcataagcccactcttttaatatttgaaattctgtcgtgaatgcctcttgctcagaaaatttttcttttatttttgctttattggtacttatcctttcaagtaatgttgcttcttgattttccaatgaatttaagctggcagtttgtgaagaaatttttattttaatatctgaaagttgtgccattagttctgacagatgtttttcaaataaatcagcttcttctattagcctatttcgcttccttatcaaattataacttgtttcagtaatccctatctccgttatttcagcgtttaaattttctatttgtctattaaactcttgattactatattcaaagtcttttaccttttcctgtaattcaagtttttttgactctaaatcagcaagctttacttttgtttcatcattttttacctcttccaactctaacgatttcgttaaatttaaaagactttcctcaatagatacttcatcaaagtaatccggaaatatttgtgaataatcagcaataaattcactataaagaattgaaagttctttttcaaactcatctgcctctatttttttcaaatcaagactagttttaagttcagtctttaattgttgtaattgtttatttttctccaaaaggactgtttgtttcttttgtgattcatcaatctctttcaataaatttccaagttctttataagagctttcttcaatagtttctgtaaacggatgttctaatgcaccacacacgggacatgcttcgccttcttgcaactcagattgcagctgtacgatcattaagcgccttctaccttttaatttttcattataagcaaatttagccttttctagattgtccttattttcagaaagcgctattgtgttttcatttaattttaattctaacccaacaatatcatcttttgaatgtttcactttctgaaaggtcggaattaatttccctcgaaatgttaattctaattgatttctctcttctcttttattaataaagtaatcatcagaaataacatcatcttgaagagttgaaatattttcggctgcttgtcccaagttagctttaaaactttctagtagtgtgagattatcagcttgctctaactttaactcctctacctttgattgttttttttctacttgaagtgatagctgaatctggataaatattttttctgctgcttttttattctcattaatattttcttgctgtttatttaggtcctctttttcgtttgttaattttttcaaaagaatttcatcttttgctttttcagaaattatcccagcaatattattttttaaactttttgactgttttatatcttgttctaattcatgaatactttcttttaagggagaggcccatttcaatttttttagatattcggaattttcttcaaaaatagctgacttttcaataatattctgctggtaatcattttctaaattatttagatttttaaactgattttctaattccaacgcggatttataagctatttctatcgaagttactttttcttcttgttcaaaagtttgaccttctatctcattttttctcgcaacacgatccttccatagagacgtgactagatccagtttttcttgttcagctgcatcttctagttcttttaattcaataggattccaaattgatgattcatataaattttgttgttttcgatcatgttctaaataaacagcattcatctctgaatttttagcctttatctcattgctaaaagatgtaaaaatgtaggtaccaaatattctttttaatattgcctctttatctggagtagaagacttcaaaaatctcgaaaaatcattttgaggtagaagaattatttttttaaattgttcggcattcagatgtaaaagacgagtgatttcttctccaacgtttttaggatttattgcaatattatttttctcgattccttttactctatctacaatagctaatttcgctgttgatttttgaagagtagatccactgcctcgtttctttgagagtttttgttcaggacttctttcaattctgtataaaagatttccttgttcaaaataaaaagtcacgcttgtcctatcatcagctgttgcaaactgacttctcatttctttggcatctctatcacccgttgttgttccaaacaacgcataagtcatcgcgtcaaatatcgtggattttccagcgcctgtgtccccactaattagaaatataggagattcatctagcagtcgaaaatctacgacagaattctcatgggggccaaaataattcatttccaaatatataggcttcatttttatttttctccttctaattcattaaatgtactttcgatgattgctgtttgtacatcatctagcgtttcccctgtagtaaatttataaaaactagaaagaatttccacattatctaacgtttcaatatcttgactcctacttcttgttaattgttttttttcaaattgatagtcaaattctataattgttccataaatcttttggagttgggcacgtaaattttgtcccacgagtttcgtccgatcaaaatttttaattgtaatcgcaaaccaagctttattaagtggttgcctttcataaaaatcacggtttattagttgctcccattcttcttcaagaactactaaatctgttttaacttgtagtggaagaaagttagaattgagcattttttctttaatttcaacaacaaaaattcctttttgtgttgacgcttctttggtattaaattttactggacttcccgaatactgtactttatcacttggggaagctaacctagtatgaatatgacctaacgcaacataatcaaaatctgcaaactgtgaaacatttaaggtcgataatccacctactttagatgaggtttcacttgttaaaacaatttcttctttatgaggactcaccgcaaaatgagtgactaaaacctgattcttcttattattgaactgacttttcatcttagaaattaccaatgtcatcgcatcatcaattgtcttaatttgctttgtgtcctcttcatctaatccctgattcgaaaaatatattcttgcatccattgggtcaaaaaagggaagtaaaaaaatctgagtttcttttgtttccactggaataaaggcttcctcaagggatgttcgtagatgtaaattattataatccaaccagtccttagcataacttagtcttttggctccatcatgattccctgaaatcatataaataggaaacttttctataatattcatctctctcagcatctgattgaatgttatgactgattctgcactcggaactgctcggtcataaagatctccagcaatgataattccatcaacttgattttgttttgccaaagataaaatttgctcaaatgcatatttttgttcttccaataaagaaaaaccattgagtgttcttccaatatgccagtctgatgtgtgtaaaaatttcatatctctatcccccaaaaataatcttaatccttataatattcacctttcattataacattatcaaatagttttatattattcattgatagaatatctgataaaacaaaaatactagcattaacactagtatttcaataaattcaattatttattattttgcttttaataactcttctttgctgtgaactaattgtgttaagaaatcacaataaggtgtggctacattatattttttacctttacgtgaaacagccccattaatatagtcaatctctgtcaatcgattatttttaatcaaatcctgatacatagaagggtaatgtaatccaattgtggatggatcaaaacaggtttcaacgtgctgaactacttcagcaatatcaaggtttacattctcaaattttgctactgctgcaaattcattaacaatagtaacaaccatatcatgtgctggttttgtttcacctaatccggccatattagtgtctaaaatagtacaaagcccattcattgttccattaacacaagcttttctataaatagaataatgaatattgttagaatatttagcattcagtcccgattctgataatatttctgctaactttttagctgtttcttcctcacctgaaataagattttgtagctcaaccgaaccatcaccaaataatttagctttacctggaccttctaatccagcagtccacatagtattaccaataaagatattatttttcgaaacatatttttctatagtatcttcgtgcccaattccatttagtaagcaaagtaccttggtatgctcgtcaattaatggtttaatatcttgtagcatcttatctaattgcatggcttttgtaaacaaaataattaaatctgttttttctttagaagaaatctcagattgtaactcaaccgatagatgagcggtgagttcttctccattgtaattagctcgcaaaccatgctctttaatcgctttaacgtgttcaggccatccatctataagggttacttcattgccacctttatgaagcattaaaccaaaacgactccccatcgctcctgcaccggcaattgtaattctcattttatctctcaatctacatattttttccataaaataactgaattcgctatttttaaacgagttcagttatagtaatttatagataacaaattatttatagttaaaattgtagctttttattagtcaaaaatcaaaaattaactttcaaaatataagacagagatattttgaaaattcaacaaaccctcactagatattcttattttgcctgatcccaaattcgaacattttcaatagcggtcatcaagccaagctgcctgacttttcgtggcagaaatttacgaatatcatcttcattatagcctacttgcaatctatgttcatccaccacaagtggacgacgcagcaatttttgattctgaacaattaactctacgagtgaatttagagtgagcgcatcaaagtcaatgatttttgatagttttttataagcactacttcttttagagataatttcctctactccagtttctgttaatgagagtattcttaaaatatctttttttaataaagtattttctaagatacttatctcttcaaattctaatttatttgtaattaaccattgtttcatttttttacttgagctacagtttgtcgaagaaaataatttaatcatggcataatttccttttttgtttttttattatttttttctcatttacaaatatattatattaaatctttcattttttgtcaatatatattattattttaatttaatttttttgttatttaactatagtttttatgcatacctctattaaataataaaagccatcattttgatggcttttgtttaatacttattttctccccccagaagttaatgtcttaaatttatgcttccattcattttggaaccatcgattttcaaaggtgtctgcaagcagagtatttctctctgtttgttgtttactatttttgaccacttttactgatatttttttagacaattgatttcctcccattagtgctcttagatgattaaccgaacaggccacctctaaaactactatatagcttaaaaaaaatctaaaggatatagagaatcatttcattctcttaacgtaattataccaaaaaaataacattttatgaagaaaaaagcttacttttgatatagataatttgaataccccattaaataacaaaaaagccagtcgaatggactggctcaatgtttgtaatttgaaaagaatttcagagatgtcaaggttggatatgccttgactctcttattctatcgtattttataaactttaactaattatttgtttgaaaaattttattgatgttagctttcatcctcctttttattcttacgccagaacaatagactaccaagcagagatagaatgactgttccaattacaccaagccagccagtttctgcaccatttgttgctggtaatttaccacttgagaaatacttaccacccatattatccccactattacctattgccattccagaagtcaagaccggaataataaagtctgttggatcacttacatttcctgcagcatcagttgaggtagccgaaagttgagtacccggtttaacccccatcggaagtttaatgctatagtttccatcttgatccactatagtagttcccaaaatctcaccagttgctgggtttttaattgttattgtagatccaggttcccccttaccaccaaccgtataacctgtatcagggttaccagtcacggtatctacacttggaggattaggagctgtagtatctgacggagccttaggatcagctggagtggtcgctggagttggatcactcacatttcctgcggcatcggtcgctgtaacactaattggtgcgttaggaccgactgagcctgggagggtaaccgtataatctcctgtttcattcgcagttcccgttccaacggttgcaccactgccatctttaattgtgatagttgatcctggttcagccgtacctgtgactgtataaccattcgtgctgttgcctgtcacattgcctactgttggtgcatctggagcggtggtatctgctgggtctgtaacaactagggtttgggtgacatcgtcataccctgaagctgagtatgtcacagtataagtgccagccgacaagctaccattagtgactgcagttcctgaagcattcgtgataactgctgtaaccggaacatcggcaccttcactgtctttcagagttgctggaagagtagccatggcatctgaggcaccaaccgctgaggttgttgcggtcaagttaccagttggagctacgagaactggacttactgggtctgctggagttgtcgctggagttggatcactcacatttcctacggtatcggtcgctgtgacactaattggagcgttaggaccgactgagcctgggagggtaaccgtataatctcctgtttcattcgcagttcccgttccaacggttgccccactgccatctttaattgtgatggttgatcctggttcagctgtacctgtgaccgtataaccattcgtgctgttgcctgtcacattgcctactgttggtgcatctggagcggtggtatctgctgggtctgtaacaactagggtttgggtgacatcgtcataccctgaagctgagtatatcacagtataagtgccagccgacaagctaccattagtgactgcgtttcctgaagcattcgtgataactgctgtaactggaacgtcggcaccttcactgtctttcagagtggttgcaagtgtagctgttgcgtctgtagcaccaatcgctgaggtcgttgcagtcaagttcccagtaggggctacgagaactggattaatcggatcggctggtgttgttgttggagttggattacttacattccctgctgcgtctgcggcggtaacattaagtggggcattggggccaactgaacctgggagagtaaccgtataatctcctgttacattcgcggttcctgttccaacgattgccccactgccatctttaattgtgaccgttgagcctggttcagctatacctgtgaccgtataaccattcgtgctgttgcctgtcacatttcctactgttggtgcatctggagcagtggtatctgctgggtctgtaacaaccaaggtttgggtaacgctagaatagcctgcggccgaatatgtcacggtataagtaccagctgacagctgaccattagttactgcagttcctgaactattggtaatgactgaagttaccggaatgtctgtaccagcattattttttaaagtcgctggaagggtcgctgtcgcatctgacgctccaattgccgaggttgttgcgctcaggtttcctgtaggcgctaccaatgttaaattaacatcccctgctaaataaacataggaaataccatttgcatcactaagaatattgacatccaataaattggtttgaaccgctgatcctacaaatttggcatcaatgttacttgcaatagtagttggtgctgtgatcttggtcggaattgtaatacttgtatcacccaatgctgaagcgtttaaaaggaaatctaaaattccaccagttccattaactaatggcactaatacagcatcgattgctgtaatgagtggaggtttaattaaagctaaggcagtattagccgcaggagccgccaaaccggttgcggttaggctattaacagctgttcgtaaattttgcaaaatagccgtgacgttttgggataaaatcgcccccattccgtcatttaaaggtgcactaagcattgaatttccattaagagtggtgggtgttgaaaaagtccctccaccaatattttggataccttttagtaaattcaattgtgtcgttacttgtgtcaagttaatactggctgccggattgttacctaaaatggtagctacccctgcaacgaaagtatcaccagcactcacaatcgcattgatgagcgcaatttgattgaaatcaattgtgagattagttgttacagaagtgtttccgttcgctacaacaaatccacgcaattcttgaggaatcgccaaagcagcgtatcttgggcccgaaagtaaagagacattagctaaagcatggcctgagattgtaaaatcgacgttgtgactccctgaattactggtccatcgatttgttgtacttgtaccactattattacttgaagtgatattttgcaataggtcaatattcaaggcagctgcttgtgctgtgatctgattagaaagaaggctgtaagctgttggaataactaccgatgtcattaatagagttcctgacatcgttgctgataatactttacgtttagtaataattttatttttcttacgtggtggtttttgtttctgcatttccattttgtcaaattcctcctaaatcgtttggaaaaatatcttatgttgatcaggcataaaatatttttaagcaacatgtattaagtaatctattctatacactatttatacatcatttctttataaaaaaacataaaaatacttttgtttttgcttgaccattgctgactttcacaagagcttgtgtgaaaacgattaagtcttaaatccccagttttcaggacgttctatcaattatagatgacattttcaaaataaaaaaaaccgccaatgacagcgatttctttatttttgtgtttttattttatttttgtatttttattctatatgattttattttgtattttatttatttctcggaattttcttctaacattttcattctacgcaaaagttgatgttctccaaataaaattagtaataaaaccaagctccaacctccaattagtcctgctgaatcgatgagtggtcgcccagtctttgaaatgaaaatacgagtaggatggtctttagccacatatacagtaatttttttgccatcatctcctaattttctaaaatatacatcgaaaggtcttttttgatattcttttccttcaaaactgtatgttacttcatggattgctttaacctctgttccgtaaacaatttttcctgaaacaggtattttctctaagtttttatttgtttgatgcaagcctaataaaaagagagctcctccaagcattgccacagcaacgacaaacatgataatccgtagaatacgctcaactatgccgacaattttattcatttaattatcctatattttctaatttactaattttcctgaacttatttctattttattttaacattttttactgataaaagttactttctcacttatccaaagctttttcaaaatttttgaaagaaatacaaaccattctttaataatagaagaaaaattactctttttttggtaaaattggcatagaaataattataaaacttctcatatttactgacaggtttgtcaataaatcgaaaagatataatcactccctaattaacagtgaaaactgcttataagaattataaaaggaaagaggcacctaatgtcctttgatggtatttttttacaccacatgacggctgaacttcaaccattggttggtggacgtattcaaaaaattaatcaaccttttgaccaagaacttgttctaacagttcggtcagctggtaaatctcataaacttttactctcagctcaccctgtttttggtcgtgttcagctgaccaaaactgattttcaaaatccacaaaatccaaataattttgtgatgattttacgcaaatatttggctggcgcttttattgaacaaattgaacaagtgggcaatgatcgtcagattattttccatatttcaaccaaagatgaaattggtgacagtttaaaaattgctttgattacagaaattatgggtaaacatagtaatattattttactagaaaaaacctcgcaaaaaattattgaatccattaaacatattggtttttcacagaatcaatatcgcacaattctaccaggttcaacttatattgcaccacctttaaatactgctattgaccctttcaaagctactgacgaagagatttttgaagctttacaaactgaacaattacaacaaaaattacaaggaatcggacgtgattctaaaaatgcgttaacaagtctgtcagtaaaagaattccatgaaaaattactgacagtcactccatcaatttatcctaacgatactttttccagtatcaaacttgctgatgaatttgtaagttttgacagcctttctgaaatgcttgatacttactatgcggataaggccgaacgtgaccgtgttaaacaggttgctgcttctgtcattaaaaaaattcaaaatgaactgaagaaaaatcgtgataaattaaaaaaacaagaacgagaattacttgcgactgacaatgctgaaattttccgtcaaaaaggtgaactgcttaatacatttttaaatcaagttcctaatgataaagcaagtgtaactttggaaaattactatactaatgaaccaattgaaattgctctaaatccagctttaagtcctgttcaaaatgctcaacgttactttcatcgttatcaaaaattgaaacaagccgtcaaatttttaggagagcaaattgctaaaaccaaggaaacgattcattatttagaatctgttgaatcaaatcttgaaaatgctgacgttgctgaaattgctgatattcgtgaagaattaattcaaacaggctatattaagcaaaaatatcgtaataaaaagcaaaaaatgctcccaccagaaaaatatcaagctgaagatggaacaattattttagtaggtaaaaataacttacaaaatgaacaagtcagtttcaaactttcacgccgtggcgatctttggtttcacgttaaggatattccgggaagccacgttttgattacaggaaatgcaaatccatctgatgaaacaattacttttgctggggaattagcagcttatttcagcaaagcacgctattccaaccttgttcaagtagatgttttagatgtcaaaaaattacacaaaccaacaggaacagctccagggtttgttacttatgaccgtgaaaaaacgattcgagtgactcctgacgaatctgtcattaaatctcgcaaaattggtaagtaaattttactgacaaaacttaatttttatattggagaacaaatgtctgaaatcatcagctgccctgtatgcagccacttgctcataaaggaacaaaatacttataagtgtgaaaataaccatacttttgatttagctaaggaaggttacctcaaccttcttttaaatgccaaaaaaacttctggcgactcaaaagaaatgatggcagccagacgcgactttctcgccaaaggctattatgaaaaactatcagatagagttaatcaaagacttaaaaaatctcatttaactgaccaagctatccttgatatcggttgcggcgagggctactacctttcacgcttccaaaaagagattgctccgaaagcctctaatttctatggaatggatatttctaaattaggaattcgcatggcggctaaaaaaaatccgatgattcattggttagtcgctaattttgccaaacttcctttcaaggaaaaatctgtcagcaccgttttatcaatgtttgccgaatactctgttccagaaatcgaccgaattcttactgacgacggaaatattattattgtcagagccgcaaacaatcatcttatcgaattaaaaaatattatttatcccgaaattcatgaaaaagtaaaaacttcatctatcaaaaccttccccggcttttgcgttgaacaagaaaatttttcatataaagttaccattcaatctaccgaagatttattaagtctgctattgatgacaccacattattggaaaatcaaaccagaaggaattgaaaatttaaagaaatttgaatccttggaagtaacaatcagtattgaaattgatttattaaagcgacaaaaataaatctttttaactgaaaaataactgtattttaaccaagtttttttaaaaaccaattattagaaaaagcactctcagtattggaatgacggggctttcataaattggacaaatttgatataattaaatttgtaatttttacaatttacattattatattattttataagaaggagccaatatggcaaatgaaactgtcattcaaatgattgatgtcaccaaacgttttggtgattttgtcgctaatgacaaagtcaatcttgagttgaagaaaggtgagattcatgctttgctcggcgaaaatggagccggtaagtcaaccttgatgaacattctctcaggactcctcgagcctagcgaaggtgaagtccacgttaagggaaagctcgaaaatatcgactctccgtctaaagcagcaaacctcggtatcggaatggttcaccaacacttcatgttagttgacgccttcacagttactgaaaacatcatccttggtaatgaagttactaaaggaatcaatctcgatttaaagactgctaagaaaaaaatacttgaactttctgagcgttatggtctttctgttgaacctgatgcgctcatccgtgatatttctgtcggtcagcagcaaagggttgaaatcttaaaaacactctatcgtggagctgatattttaatttttgatgaaccaacagcagttttgactccagctgaaatttctgaattgatgcaaatcatgaagaatttaattaaagaaggcaagtcaattatcctcatcacacataaattggatgaaatccgtgcggtagctgaccgtatcacagtcattcgtcgtggtaaatcaattgatactgttgaacttggtgacaaaacgaaccaagaacttgcagaattaatggtcggacgctcagtttcattcatcaccgaaaaagctcccgctcaacctaaagatattgtcctcgaaattaaggacttaaatatcaaagaaagtcgcggttctctaaaagttaaaggattatcacttgatgttcgtgccggtgagattgtaggggttgccggaatcgatggaaatggtcaaacagaattagtgaaggctattactggtttgacaaaggttgattcaggttctatcaaactccacaataaagatattaccaaccaacgtcctcgtaaaatcacagaacaatctgtcggacatgtcccagaagacagacatcgggacggacttgttttggaaatgacagtagccgaaaatattgctctgcaaacctactacaaaccaccaatgagtaaatatggtttccttgattataatcaaataaatagtcacgctcgcaaactcatggaagaatttgacgttcgtggtgctggtgaatgggtttctgctgcttctctttctggtggtaatcagcaaaaagcaattatcgcccgtgaaattgaccgaaatcctgacctcctaatcgtatcacagcccactcgtggactcgatgttggtgcgattgaatatattcataaacgtttaatccaagctcgtgatgaaggaaaagcagttcttgttatttcttttgaacttgacgaaattctaaatgtttccgaccgaatcgctgttattcacgatggtcaaattcagggaattgtaagacctgaaacaaccacaaaacaagagctcggtattttaatggttggaggaaacataaatgaatagtaaaacgaaaaaagtccttgttcctctggtggccattgtttttggtttcttattgggagcaattatcatgctagcctttggctacaacccaatttggggttatgaagatctcttcatttctgctttaggaaatacaagagcaattggtgaaaccttgcaaacaatgggcccactaattttgacagctttatcttttgcagttgcaatgaaagtaggcctcttcaatatcgggatgtctggtcaagcacttgctggttggattagctcgatgtggtttgctttgagttttccagatatcccacgtttattgatgattcctttagttgtaatcatcggaatgttcttcggagcatttatgggattcataccaggtattcttcgtgctctccttggaacatcagaagttatcaccacaatcatgctaaactatattatgttgttcttctcaacatttatgattcatagcatgttccaaaaaagtatcctgatggataatactactgaccaaacaaaactaattagtgccaatgcttctttcagaacaaattggatgtcgtcattaactgataattcaaccttaaatattggattaatcattgcattgattgcccttgtgattatggcgattatctttacaaaaacaactctaggatttgaaatcaaagctgttggtttaaatcctgatgcttcagaatatgctggtatttcagcaaaacgtacccttatcctatctatggttgttgctggtgcccttgctggtcttggtggtgttgtttacggatttggatacatgcaaaactttgtttctcaatcggcatccctcgacatcggatttaacgggatggccgttgcacttcttggtggtaatagccctatcggtattctctttgccgctcttcttttctcagttcttcaaacaggtgctcctggtatgacaaatgatggtatcccaccagaaatcgttaaagtcgtcactgcttcaattattttcttcattgcagtgaaattcattatcgaagtcatgttaccaaaagctaaagaaatcaaagcatcagaagctactaagaagaaaggagaaaaagcatgaatcttgtaaatactttacaaatcattgtcgctaatatgctcatctattcaactcctctaatctttacaagtattggtggtgtcttctccgaacgaggcggtatcgtcaatgtcggtcttgaaggaataatgactatcggagctttcagttccgttgtattcaacttaactactgccggaatgtttggaagtatgactccatggctctcaatcctttttggagctttaattggtgctctcttctcttctcttcatgcggtggctacagtgaacctaagagcagaccatatcgtatctggtactgtactcaacttgatggctccagcactcggagttttcctacttcaagttttctatcaacaaggtcaaattaatatcaatgaacaaatcggttattggaacgttccactactatcaaacattcctgtcattggtaaaatcttctttagccaaacttctctaccagggtttcttgcaattgttgtagccattctcgcttggtacgttctatttaaaacacgtttcggtcttcgccttcgctcagttggtgaaaacccacaagcagctgatacccttggaatcaacgtttatgcctaccgttgggctggtgtgcttctctcaggtgtcctcggtggtgtaggtggtgcaatttatgctcaagcaatttctggtaacttctcagtttcaacaattgctggtcaagggttcatttcacttgcagctatgatttttggtaaatggaatcctattggagcaatgttatcatcacttctctttgggctctttacctcacttgctgttgtcggtggtcaaatccctggaatcaaagaaatcccttcttcattcctacaaatggctccatatgtctttacaattattgtcttggcactctttcttggaaaagcaattgctcctaaggctgatggtgttaactacatcaaatctaaataaatttacaaaaataaaaagtctgttgatgaacagactttttttattagacttttagcttaacaaatataatttaaaataaaaaaagagctagttgaaatctcaaccaactctttttaattttagtttttaactgcagaagcaaattcttctttagcaaaagcttcgtcaatgattgctttcaattgagcaccagaagcttccattttttgcatttcagcatcgttcaatggaatgtggattgggttaacaacaccttcagcaccaactacagctggttgaccaaggtagcagtcgcttacgccatattgtccatcttggaatactgatacaggaagtactgcatgttcatcatcaagaattgctttagtaatacgagcaagagctacagcgacaccgtagaatgttgcaccttttttagcgatgattgagtaagcagcatcacgtacagattcaaacaattcaacgatttcagcttcgttaaggtagtcattttcttggaaccattgttccaatttaacaccagcaacgttagcgtgtgaccaaacggcaaattctgagtcaccgtgttcacccatgatgtatgcgtggattgaacgagcgtcaacatcaactttttctgccaatgcttgacggaaacgtgcagtatcaagtgaagtacctgaacctacaacgcggtttttagggaaacctgagaatttccaagtagcatatgtcaagatatcaactgggttagcagcaacaaggaagattcctttgaaacctgaagcaacaattttagttacaacatctttagtgatacgaagatttttttcaacaaggtcaagacgagtttcacctggtttttgtggagcaccagaagtcaagacaacgaggtcagcgtcgcttgcatcagagtagtctgcagagtaaatctttttaggtgaagtaaatgccaaggcatgagaaaggtcttctgcatctccttgagttttttctttaaaaaggtcaacaattcctaattcttgtgcaatcccttggtttacaagagcaaaagcgtatgatgaacctacagcaccgtcacctacaaggataacttttttacgttgtttatcagccatgattttctttaattcctttcaaattataaacgagtattttataaaatataatcttttcaacaatagggcctgtcgatagcggcaggcattattgttttaagattcttaattgacaaattatttaacagtgcggatacgcattgtatttgtacgaccagtaccaactggaacaccagcaacaatgatgatattgtcaccagattcaactaaacctgaagccaaagcaactttttcagcaacttcaaacatgtcatctgtagatgaaggtttttcagtcatcgttgggattacaccccagttaatcatcaatccacgttcaactttttcgtcaaatgtaatagccaagatgtcagcattaggacggtgtttagaaatcaaacgagcagtattaccagattcagtcaaagcaacaatcaatttgatatccatagcttctgcagcgtttttaactgatgcagcaactacttctgttacagttgatttgtcgtaacgttctgggtgaagacgtccgtattctttcaacattgtttgagcgtttttgttaacagtagccattgtacgaactgattcgcgtgggtatttaccattagcagattcacctgaaagcattgttgcgtcagttccgtcaataacagcgttgaatacgtctgaaatttctgaacgagtagcacgtgggttgtaagtcattgattcaagcatgtttgtcgcagtaacaacgattttacctgctttgttaactttgctgatgatcaatttttggtaaactggaaccatttcaaatggaacttcaatacccatgtcaccacgagcgatcatgataccatcagctgcttcgatgatttcatcaaggttttcgataccttgttggttttcaattttagccaaaagttgtacgtgtggatttccagtttcttcacaaatacgacgtacttctttaacgtcatttgcagtacgtacgaatgagatagcgataaagttgattccaccaggttgtgaaagtccgaaacggatatccgcatcatcacgttcagcaagagctgggaaaggaattttagtgttaggaatgttaacacctttttgtttaccaataacgccatcattttgtgcttcaacttcaaactcacgagttgctgcatctttaccagtcaatgacaaaccaagtttaccatcgtcaatcaaaatagtttgaccaatttcaacatcatcaaagatatcaagaccaccagctacgttcaaagcaatcaattcaggagttgatttaagaccttgtttagttgcaacgcggaatttatctccagtaacaacgctgattgcatcagcaccgtcagcaaagagttctgtacgcatttcaggacctttagtatcaagcaagaaacctactttatgaccagcgatttcttcagcgcggtgaactgttgccatacgagcaccttgttcaggatggtcaccgtgtgagaagttgaaacggaagacatttgcgccttcttcaatcaaagctgcaatgttttttgctgatgcttcgacgtcaagagattctccccaatagccgctttcaccaaattttttgccaccacgaatttcgacagcaggtccaagagttgagacgatttttacacgtttattcattttgtgtttttctcctataatgattaattatatatctctgccctaattatgcgtttaacacttaactagaaacagatttgcagtaacttagttaaggttaagattgttgagtgctgagttaagacggtaaagttcaagacctgctttatgcgggttatttactttgattccaccttcagtagtcaaactaaagagtgctccttcttcagctgttccgagaattggactttctacaagttcttcattacggataccaacggctacgcccccgattccatcacgaagcaattcaacggcacgagcacccatacgtgaagcaagaacacggtcacgagctgttggtgaaccaccacgttggatgtgtccaaggacagaaacgcgaaggtcccctttataaccagcttctttaagttttgtagcaaattcttcaccagtcattacaccttcagcaagaacgatgatgtggtgatttttacctttttcgtagcctttgttaatgttgttaactacgttttcaaacttaaattctttttctggaatacaaatatcatctgcaccagcagcgataccagcattcaaagcgatatctccagcattacgtcccattacttctacaacgaaagtacggttatgtgatgatgaagtatcacggattttatccaaggcatctacaactgttgaaacagctgtatcaaatccaattgtaaaatcagttcctacgatatcgttatcgattgttcctggaagtccaacagctgggaaaccatgttctgtaagacgcatagctccatgataagaaccatcaccaccgattacaacgacaccttcgataccgaattttttaagttgctcaatcccagcaagttgtccttctacttgagcaaattctgggtagcgtgctgaatacaagaatgtaccaccacgaccgattttatcaccaactgaagctgacgtaagcgggaaaatatctcccgcaaccatgcccgcatatccgtgattgataccgtaaacttcgataccttcagaaattgctttgcgaacaactgcacgaatagccgcattcattcctggggcatcaccaccagaagtcaaaactgcaatgcgtttcatttaaatctgtcctccgaaattgagatacatagcaaaaatacgtaaacgttattaatatttttaccatgttcatttgttgtctagttcattatatcacgtatttataaaaaaatctctttacaaactgtatgaaacgttttcattgtttctttttttctaagccttattttgcaagggttttctagcattttcaaataaaatttatagacttcatttgctcttaattcttctataatatgacacaataatagccattctattcttttatattttaacaaaaaagtaaataatcttttacctttttgtttatttttctgattattcaacttgaaaaatgaaatattttcataaaaaaatgaattccttgcgaaattcattttttatattacgcttcatagcgtttttcaccatcaagataagttgcaactaaatcaaaatcattgtctaaaacgataaaatcagctgacaaacctggttttatttgaccacaaacatcatcaatgtttacagattttgctggtgtcaatgaagccatcataattgcttctgctggtgtggcaatcccccagtcaatgacatttttaacagcagttttaagagttaaaattgaggcagctgggcgtcctgttggaagccatgcggctccgtcacgaacttctacttcgtattcgccaagcatataaggtccatcaggaagtcctgcggcacgcattgagtctgtaattaaaacaacatggtcagcgcctttcattttcattacaatttcagctgcttctggacgaacatggtgaccatcacaaattaactcagcataagtgtttggtgtatttaaaattgctccaaccattcctggttcttggtgagtcattccagacattccgttaaaggtgtgaacccaaacagatgctccagcttgtaccccagcaaccgcttgtttataagtggcatttgaatgtcccaatgcaataacaacacctgattcagtcgctttacggatgaagtcttctgaaccatcacgttctggggcaagaccgatttttttgagcattccatgtgcagcttcttgccaatcttcaagttcccacattttggcatcgcgcatgtatttagggttttgagcccctttcttttcttctgtaaagaatggaccttcaaaaaaaataccacgaactttggctccgcgagcttcttggtaatgttctcctacaaccgtgcaaaccgctttcaatccttcgtggtcatcggtcaaaggacttggtaaaaatgaagtgacccctgctgacaacaagccttctgacattgttcccataattccttcaacttcagcatcttgggcatccgctccaccaaaaccatggatatgtgtttcaacaagacctggggcaattgattgacctgaataatctaaaatgtcagctcctgctggtgcttcttctgtccactctccaaattttccatcagtaatttctaagaaaccacctttttttgtttcataagcgtagaaaaattgatctgctttaatatagtaagtcataaatatctcctcttctttttctttaattttagcaccctttatcttttttgtcaataaacagtatataccaattatcactataaaaaattactgacagattttgcctgagcctatacaaatcatactttagcagatgaaaatagcgctcaatttctgtcagtaattttaaaatttaatttaattgtttgttatttgataattgtaacaatttttctttaatttcttcttccattttagaaagttcaacctcaccttgttgacgtttttggcgtccctcagcctgaattctcatagtttcttgaatagtatcaactaagttttgttgagttaattttaatgtttcaatatctactaaaccacgttcattttcagttgcagcctcaattgttgatgctttaagcatttctgaatttttacgcaacagatcattggttgtttctgaaacaatacgttgacttgtcaaagcatctttttgttttaagagggtcaaagcaatcgcaacctgatttttccatagtggaatggctgtattaattgaagtttggattttctcagctaattcttgattggtattttgaatgagacgaatttgtggggcttgttgaattgtcaactgacgagcaagacgcaagtcatgagctcgtttttctaagcgatttttatatgattctaaatcattcactttttgaacaatcaaggcattgtcagtagaatcttgagcttcttttcgagcttgcggaataatttctgtatctaattcttggacttttaattcagcacctgcaatataaacattcaaagccttgaaataattcaagttttcatcgtaaagtttatcgagcatttcattatcttgcaaaagtccttgttgttcattgttcaattttgcagaaattttatcaatacctgctccaattttttggtatttttgcgtcacttcaaaaattgaacgtttaactttaccaaacattttggtaaaaatccctttgttttcagctaccaattcgtttggattggcttgttgtaagttaaacatcaaatctgtcagtgaggaaccaacttcgcccaaatcttgtgcctgaactttatttaagacactttgagaaaaagccgaaatcttatcttgggcgcttgctccatagttaatgacagattgagcacttgattcatccaactgttttgataattcttttgctttttctaattcttcagtagaaagaacttctactgctgctaaagaggctttttcgtgcatttttacaatttctgacttttgttgttcatctaattgctctgcctctttaatgactttatcattggtcatcaaatcatctaaaattggattatccatatctttaaattcctttgctatacttatatttctttacttttaattataaatgattcctgccaaaattgacaggaatatttgtttttttactgacagaatcatcagttttactgacaagaatttttaaaacgtctgtcagtaaaattatttgtcaaaatcaacttgatgtttgatgacattgacatcgtccatcaaaatttcatggtagtttttagaaattgaatgtgagagtgtttttatcaaaagtaaggtttcatctaaatcacgattgatttcttctgttcttactgattgtttcttcatctcaataaatttctctgacaatttgacgatgtttggcaagtctttatatagaaactcattttgttttgtgagttcttgtggattttgaacaatatatttaaacgtttgtttgctggcttctaaaccgcctgtcactgattcaacaacttgtaaatcatcttcttttttcagtaatttttcccaagttttgatattttcttttgcttctgacaagttttcacggaaaattttaatatccgtatctgagagtcctgcttcgtggtaacgttcaatattttcttttttgctcattcctttatccttatatccttcttctctttcatcagggttttttcgcataaaactaattccgataatcatttttataattaagaaaaagagaactaatccaaaaatcacattcacgattcctagatgaccataaccgaacatcatgtcctgatgattcataaataaactgactggcatattttttttcctcccgcttgcgtcctgttctcacaagtttctaatttttaaatttcatttttaagaataacctttcggatatatctatattttatcataatatttgaaccctaaatcatacttagggctgatttttattcttgcttatgttaaaatgtaaaggaaaccaaaacgaaagaaaggatcatttctatgaatccacaaaaaattgcagttttaggtccaggttcgtggggaactgcactttcacaagttcttaatgataatggtcatgaagttcgtatctggggaaataatccagaacagatggctgaaattaatgaaaagcatacaaatacacgctattttaaagatgttgttttggatgaaaaaataaaagcatttgatcgtttagatttagctttagaagatgttgatgctattttatttgttgtaccaactaaagtgacacgtttggtcgcaaaacaagtagccgaagtcctcaaacacaaagtacacatccttcacgcttctaaagggcttgaacagggaacacatgagcgaatttctactattcttgaagaagaaatccccgctcaattgcgaggagaaatcgtggtagtttctggcccttctcatgctgaagaaacaattgttcgtgatattacattaatttctgcagcttctaaagaccatgatgaagcgaaatacgctcaagcaatcttcagcaacgactacttccgtctttatactaatactgatgttattggtgttgaaacagccggtgcccttaaaaatattattgctgtaggcgcgggtgctcttcacggtcttggttttggtgataatgctaaagcagcaattattacgcgtggtcttgccgaaattactcgtttaggtgtggctatgggagctgaacctttaacttatagcggtttgtctggtgttggtgacttaattgtaacaggtacttcaattcactcacgaaactggcgcgcgggtgatgctcttggtcgcggcgaaaagctagctgatattgaaaaaaatatgggaatggttattgaaggtgtttcaaccactaaagctgctgttgagctcgctcaacagctaggtatcgatatgccaattaccgaaacaatctacaaagttctctatgaaaatctagatgcaaaaactggaattcttgatatcatgcgccgcgaaactcgtgccgaaaatgaattcattaataataaataaaaagtaaatacgatttatctaactataaaggagttattatccatgaaacaaaacactattccaactaaagccagaaaagtacgtaaagctgttattcctgccgctggtctaggaactcgctttttgccagcaactaaagcgatcgctaaagaaatgttgccaatcgtcgacaaacctactattcaatttatcgttgaagaagccttgaaatcaggaatcgaagatattttgattgttactggtaaagcaaaacgtccaattgaagaccattttgactcaaacattgagcttgaacaaaatttgcttgaaaaaggaaaaacagaattacttaaacttgttgaagaaacaacagatattaatcttcactttatccgtcaatctcatccaaaaggattgggacatgccgttcttcaagctaaagcttttgttggaaatgagccttttgtagtcatgcttggcgatgacttaatgaatattactggaaatgaaactcctttaactaaagacctaatcaatgattacgaaaaaactcacgcttcaacaattgcggttatgaaagttcctcatgatgatgttgataaatatggtgtcattgaccctaacggtgaagtttctaaaggcctttacaatgttgaacgttttgtcgaaaaaccaaatgttgatgaagctccttctgaccttgcaattatcggtcgttacctcttaactcctgaaatttttgatgttttagaaacacaagttcccggtgctggaaatgaaatccaattgactgatgctatcgaacgtttgaataaaacacaacgcgtttttgctcatgaatttactggaaaacgttatgatgttggtgataaacttggttttgttgaaacaacaattgaatatggtttagaacacccacaaatcggggcgaatttgaaaaactacatcattgaaaaagcaaaagagctttctaaagatgactcaaaaaatatcactaaaaaataagaaagagccgaaaggctttttctttttgatttcgtgaattttttcattaattttgctataattaaccttaatgaacttctttaaaaacacggttaatttttttaaaagcataaagacaaaaccgcttgattttgttattatttttctactgttcatcgcttctttttcaactttgttcttcttcgctactggttccaaaggagctcaggccgaactaagaattagtggtaaggtgattaaaacttttgatttaaataaaaatcaaacttggacctaccgtgataaagatggcgattataataaaatacaagttaaaaatggtgaaattgcggttgtcgaagccaattgtaaagaccaaattgacgtccaaaggggctatatttctaagactggggaaactatcgtctgtttacctcataatttagtgattgaagttatgagtggtcaaaaggatgaacaggtagattataaagtatgaatattaaagaatacgtttatgtttctctattgacagctgctgcggtagttatgggaattattgaaagctctttacctcctttttttgcttttgcacctggagctaaagtgggtcttgccaatttggtgatgattattgcagttttcactctaagatggcgacaagtttgggtcatgcaaattcttcgtctattaattacagcactttttactggtttttccgtttttctgtactcttttgcgggcggaatcttatctctattagccatgtatttgatgaagcaatttggaccaaaactggtttcaatgattggaatttcgacagttggtggattttttcataattttggccaattagcaatggcttctcttttagctaaaacaacttctgtgatgctttatttgccttggcttgccttttttggaatacttgctggttttgcaattggcattgctggaaatcaattaattacacgtgttaaacctattcaagaactatttattaaagaaagtaaacaatggacttaaaaaataacttttggaaagactatccagagcttgaaaaagaattggttcaagttcaacaattaatgaaaagccacgttaccatcaaaaattcagatgttaaatcggctatttttgatatatttgatgcgggcggaaaaatgttgcgtccagcttatttacttttattttcaggatttactgatctttctgaaagtgaaagattggcacttgcggcttctgtcgaaatgatgcatacagcgactttggttcacgatgatgtcattgaccacgcagacacacggcgtggcgtagctactttgtcagcaaaatacggaccagaaattgccgtctatgctggggactatttatttattgctgtctttcgtctaatgtctgaacactcattagaattatcaaatttaaccaaaaatattggttcaattgagcgtttattaggtggtgagcttggtcaacttaatcatcattttaatcttcaacaaactttagatgattatattgaaaatatttcaggaaaaacgggagaactttttgcactttctgcttctgttgctcctttaatttctaaaaataatacattgaccaaacgagcttataaaattggaatgaatattgggatttctttccaaattatggatgattatttagattatgcatcgactgctcaaacgcttggaaaaccggtacttgaagacattaaacaaggcatttattctgctcctgttctctttgctttacaggaaaacaatgctcttgtttctgaattaattaaaaatgaaaaatttgatgaagtttatgattttatcaaaacttctgatgcccttgaaaaaaccaaagcacttgcgaaatcttatactctttcagcattaaatttaattgataaattaccaaaaggtaaaaatcgtgagctgattgctgaaattactagaaaacttttggagcgaactttatgacccctgatgaatttttgtcagcactgacagaatttgatattcaactctctgataaacaaatcaaacagtttgaacgctattttgaacttttggttgaatggaatgaaaaaattaacctgacagcaattactgaaaaaaatgaagtctatttaaaacatttttatgattctattgcaccaattttatatggattgattactgaccaacctgtcagcattttagatattggtgctggagcaggttttcctagcttaccaatgaaaattattttccctgaattaaaagtgactatcattgattctctcaataagcgaattaattttttaagtttactgacagaggaattaggcctcgaaaatgtgactttacttcacggacgagctgaagattttggtcaggatactaattatcgtggaacatttgattttgttactgcccgtgcggttgctagactttctgttttgactgaatttacgattccctttctcaagaaaaatggtattttattgtcattaaaagctgctcaatttgaagaagaattgaatgacgctaaaaaggcaattgctacacttggtggaaaatttatcaaagaagtcgcttatgaattgcctaacggtgatgagcgtcacattgctctgattgaaaagaaaaaagaaacccctaaaaaatacccacgcaaagcaggaactcctgcaaaaaatccaataaaataaaaaaatcggccatttttagccgatttttttgctgagattaatcaccaatactgaaatagaaacaatcgcagtaaaactattcatgaccattgcaggtgccgtcagtgaaaggctagtaaagattgagagtaagataaaagtaatatgtattgaccgatagcgaaaccaaaatttagtaaatttattcttccacactttttgactttgtttttgacttttattttgaattttaaaccatgaccttacgacgaggacaacaattaagtctaataaaagcatgtaagcaaaaaccatgtaacacaaccaaaaagtgaagtaattttttcattttattgattccattctgcttttatcgcatgatagctagctactggatcttttgcttgggtaattggacggccgacaacaatataatctgaaccaattgttcttgcttctttaggtgtcattactcgtttttggtcgcctttacttgcaccctctgggcggattcctggtgtgagacaaatgaattctttcgatgtcgctgctttaattttttcaacttcatgtgccgaacaaacgacaccgtcaagtcctgcttgagcggttttttgtgcgtaattaataaccgattcttcaagactagtcataattttttggtcattttgcataatttcctcagaagttgaggttaattgtgtgaccgcaattaattttggcctttgccgtccaactggcgttccagcctctaaaccgcgtttagctgcgaccatcatttcaacaccaccagcggcgtgaacattaaccatatctactcccaaacgtgctaaaacacgcattgaggattcaacagtatttggaatatcatggagttttaaatcaaggaatacactgtggccgagcgattttacatagtaaacgacttggggtccagccgtgtaaaaaagttccattcctagtttaatatacaattgttctgacgggtcaaatttttcgagaaaatcttttacgtctgagaattcagggaaatcaagggcaatgacaggtctattttcttgcattttttctactttctttttctaaatatttaatgacagaatgatcagctccgctgacaattcttttatccgccgataaaatcatttttttgagtttttaacttcttgaatcaagttttctaagctatcaattccatattgatccattacctctggtaatttttcaatgatttttggacagacaaatgggtcagcaaaattggcagtgccaacggcaacggctgaagctcctgccatatacatttctaaaacgtcttgagcactttcaaccccacccattccaatgattggaatgtcaactacttgagccacttgatgaatgagtttgagtgcaactggtttaattgcaggacccgacaatccacctgtgatatttgctaaaacaggttttcgtgttttcaaatcaaaacgtacacccatcagtgtatttatcattgtcaatccatctgctccagcagcttcaactgcttttgcaattggaacaatgtcggtcacgttgggtgaaagtttcacatacaaaggcaccttactgaccgctttacaagctttgactaacgcagctgcaacatctggatctgttccaaaagcttgtccgccatgtttaacattagggcatgagatatttaattcaatggctttcacattgggtgcatctccaatttttgcacaaacagccacataatcatcttcttcagaaccagctacattagcaataatcggaaggtctggaaaattttcattgagccgaggcaatttttcggccattataacttctaatcctggattttgtagtccaattgcattaagcatgccactcgctgtttcagccacacggggtgtcggattgccaaaacgaggatgaagggttgttgctttgaccatgattgaccctaatttgttcaaatcataatatttggcatattcttcaccaaagccaaaacaacctgaagctggaatgattggattttttaaatcaagtccgggtaattttactgacagacgattattttcggtcattttttctcctaatttttttgtgacaatcatcagctctactgatgatttttttatgctgatagagtagtccaattatagtaatagttgttttcctaaaaatacagggccatcttcacagactttaagggcatgattctcatcttctttatcatgttcaacgcaagcataacatgctccgattccacaagccatccggctttccattgaaatataaagtcgttccaactggtcatatttttttgcaacagctttgagcatggctggcgcaccacatgtataaagagcgtcaacttcaaaatcaacttcttccattaacatcccaacatggccttttgttccataagagccatcgtcagttgcaattttcaagcttacattttttaattcagcaaattccttctctaaaatcttgaccttttcagaagcaaaacctagcaaaatggtcatttggcagtttttttcttcaagttgtttggccaattcatagagaggtggaaccccaattcctccgccgacaattaaaattttatcagtcgaaactacttcatctactggaaaaccattccccagtgggcccattacatcaatttttgcacctgtttgtaattttgaaatttcataagttccacttgtttcgtccccaattcgataaagaatcgtacaagtttttgcgactttatcccaactggaaatagagattgggcgacgtaaaagcatattagcattaggcaccgcaagatgtaaaaattgtcccggcaaatccatctcttctactagctctcctttaagaaccatctcgaaaatattagaagcaacctcacgttggctgacaatcgtcatcatctcttgtaacttaggcattatttctccattctttattcggacagaagctacagcttgctgaaccttcttttatttatcgataaaatactcatgttaatcgcattactgacagaaagttcagcttactgaaccttcttttattcatcgataaaatgctcatgttaatcgcattactgatacaaactaatatcgctggtcaatgactggtggggagggattgaatgaaatcaagctggaagaagcaaagacaagcaacaaaaaaacgtcaaattaagttattaagatggcgaaataattttgtcagaaaatatggatttaaaaacgttgctgaattaggaattagagctagtgaagctgctagaaaaatagcggatgctttctataaagttctaaaacaattaacgaaaatgaggacaaccaatgaaacttttgtgtaagctgttcgggcataagtgggaaaatgcactctatattcgagtgtgcaagcgatgtgaaaaaattgagtgggtttcaagtaattcagggcttgaagtctatgacataaacctaaaccgctcagaccttgacgagtcagagaacgtgttccctgaaaaatggcttgataaacacatggaatgaaagcaaaaaaagcccactgcaatgggcttcggcaactgaatatctaacttaattataccacaaaaggagaatttgattaatggcagataagttagatagaattattggagattacgtaaatggcagacttgaagccagaataaaatcaattgaaagcagatatctttataagcaaaaagtagataacttaggcattcgtacggcttattctggtggttcggaacctgaaagtcacgtcttaaataaagaagcacttgaaaatgatgaggaatacatcaaactcaaagacctgatgtaccaattcagcttgtggtacgaacctttaatcaaggaggaaaaagaaataatcaagctaaaacactgtggttacggtggttttacatggtacagagtaatgatggaacttgataatgaagggattgagatttcagaaaagaaagcgaagtttatttactaccgattcagaaaagatataaaccctcatattggatatttcatttgaaagcatgggtcaaattgggataaaaacgacacgaaaaaggcacgaaattggagtgttgctccttatttttgctgatatacttgtattatgaagtaaaaggcaaaagcaaaaaatatcataagtatcggtttgaatttgcttctaagcaagtcattgctcgaaccagtggcttgctatattattggtgctggcgattgaagttcagttaaatgaccaagagggagcaacagccaatacagttacgagttatagttatagggattgagcgtatcgtaacatagttagtggctatctagcatagcgaggggtgacaggcaccagaactaaacctgactgtaatgtccgatttaatggcggaatagcgttgctggacgagaataaccagcgtagcaagagagaacactgaaaagtgtggctgaggggctaggttcgaatcctagacttgctatatctacatatgttctatggctgattatactagtccagtcatgaataatataaattattagtgcggttggaactaattggcaagagtaaacgtgtgtggcaacgttacagcgaggtggatacctctatgctgtatggattcaagaacctgacttgctattcgattgcattgcttaataccgatgcatggaaaaatatttaaattatttattagtcagtttacgctggatatttttgattaagaggtaaatattatgaaaaagtttattaagatttctatccctgttattccatatttttgctatactagtattgaaaatataaataaggagtataagccaatggtatttaatgacccaaatgtgacggaacttagcgtgcgactagcagaagtagccgctaaaaatactgcctctgcagtatttgggaagatacgtgctgttaaagctgggcacgacaaagacaagactatttcagaaatgcaagaattaattcaggaattgttaaatgaaaaacaagaattagaactgattgctagatcatatgaagaagaacttgtaacccaaaagctaaaagaatcagatctgagttttgtggtggatacagtactgccggcagtaaaggactttatggggaaagcatcagatggagatacagaagcagataaaaatataaaatatattgaagctttagaaccactgttgtctctaaatacattgatggttcttcaaactttgggatttaattataaaaaaggaattggcgaaccacttactaaattaactagtaagctgattaataacactaaaagcaataaccaaattaggcttatggaattgaacacagaaagagaaatagagtatttcaagcttctacaagattcagaagcttttgaaagatttaaagctatgagtggtattagcgaataaacaaaaaattattattatattttattacaggttgtccaatgggcagccttttattgttggaaaggaggagaaatggcaaaagctaaatatgaagaatggattttagaagaaggtttactcaagattcaaggttgggcaagagacggcttaacagaggagcaaatcgctcataatatggggattgccgtttcaactctgggtaattggaaaaaaagtcatctggagattttggaggccctaaaaaagggtaaagaagttgttgacattcaagttgaaaatgctttgcttaaacgtgctttaggctataaatttgttgaagtaactaaagaattaacggatgatggtttattggtaacaaaagaagttactaaacaacaagcgccagatacaactgcagcaattttctggctcaagaaccgaaagcctaacgaatggcgggataaaactcaaacggagctgtctggaggaataaaggtttcaaacccttatgaagacttatcaacagaagagcttagaaagttggcgagtcgtgatggataaaatagcgctaggggcgaaaattgagctgtctaagcgctttttctttgattactgtaatctcatcatgccaagcttttataaacgtgatagggcttatttagtgacaatgtgtgaagagtttcagtcatttctaaatgatgatgaacacgatgttttagttttgaatcttccaccacgtcacggaaagtctctcacgctcggtaagtttgtagagtgggtacttggtaatgaccacacgaagaaaatcatgactggttcatataacgaaactttatctactgtcttttctaaaaatgttcgcaatacgctccaagaagaaaaagcagatgaaaacaaaatcgtttactccgatattttcgatgctgcaataaagtatggagatgctgcgaaaaatctttggagcttgtcagacggttataacaactatttggcaacctctccgacaggtactgcaacaggtttcggagctgacattattattattgatgatgttatcaagaatgctgaggaagctaacaatgcgactgttttagaaaaacactgggactggtttgttaataccatgctttcacgtttggaatcaggcggtaaaatcataatcaatatgactcgttggcatagcgaagatttggctggacgtgctttgcgtgaactgcctaagaatggctatcgagtaaagcatattaattttaaagcttacaatgagcaaacgaaagaaatgctttgtgatgatgttctgactcttgaagattataagcgcaaagtaaaaacaatgggtgctgatatagctagcgccaactaccagcaagagccaattgatgtcaaaggtcgtttatatagtgagtttcaaacttacaatgctcgttcagagtacaaaaagatttggaactattgcgatactgcagataccggtaaagactatctttgttcgattgtatggggtgagacctcagacggctttgcggatgtgctagacattatttacactcaaaagccgatggaatacacagaaaacgcagtggccaatcaattaattaataacagagtaaatgcatcaagaatcgagcgtaacaatggcggtcggtcttttgctcgttctgtcagagataagattcaaggtaaagttgcttgtgctgtagaagatttcttccaaggaaataataaagaagctcggatttattccaatagttattggattgaacagcacgttcgctttccaaatgactggcgaactcgtttcccagaatactatcaagcaatgacgacttatcaacgtgaaggtaaaaataaacacgatgatgcgccagatgcaacaacgggaattgcagaaacaatgagcggtaagcgaataaaagccgggttaaaatcatttaaaatataaaggagatttctaattgaaatacaaaccacctaaattaatgacattttcaaaagatgagccaatcacagttgaagtggttaacaagttcatggaaaaacataaattagaggttgctcggtatgagtacttgaaaaatatgtatcttggaatcatggatattgatgatgaaccaaaaaaagattcttggaagcctgacaatcgtttaactaataacttcgcaaaatatatcgttgatactttcacaggttactttaatgggattccagttaaaaagtcacattcagataaagaaatacttactaaattacaagaatttgataatttgaacgacatggaagatgaagagtcagagcttgcaaagatggcttgtatttatggacgagcttttgaactcttgtatcaagacgaggacactcaaacgaatgttgtttataatggtccagaaaatatgtttatggtctatgatgatacagtcaaacaagagcctttatttgccgtgagatatggtattgacgaggacaaaaaaattcatggagaagtttatactctacttgaaactattaaaatcagcggagaaaatgatgagattagttttggagaaaagacttacaacccatatccagatttaccagttgtagagttctatttcaatgaagaacgaatgagtatctttgaatctgttatttcattagtcaacgcttttaataaagctattagtgaaaaagcaaatgacgttgattattttagcgatcagtatatggttttcatgggagcagaaatagacgaagaagatgttaaaaatatcacagataatcgtctaattaattattatgataagaatcagaatgatcaaagtggttctgcttcaaaattagatgttaaattcttagaaaagcctgatagtgattctcaaacagaaaatctattggaccgactgactaaattaatcttccaaacaacaatggttgcgaatatctctgatgaatctttcgggtcatcaagtggtgtctcgttagcttacaagcttcaagcaatgagtaacctagctttgtcatttcaacgtaagttccaatcttctttgaatggtcgatacaaactattttgtgagttaagtacgaatgtttcgaacaaagacgcttggaaagatattgagtacacctttacacgtaatgagcctaaagatattaaagagcaagctgagaccgctaatattcttatgggaattacaagccaagaaactgctttaagtgtcatctctgttatcccagatgttcaagctgaaatggaaaaaatcaaaaaagaagaagcttctacagctatttttgacaaggataagcaacctagtgaaaagggaacagatacagtagtttctgaaacaaatgaggaatagtctatgaaaactcctgattactggaaaaaacgtgagaaagcttggcaagaacaacaaatcaaagatgacaccaaacgcatgaagcaaatcatggataagctatttgaagctcaagaagccattcaaaaagaaatcaatgccaactggcagaactttgcgaatgggcaagggatttctatcagtgaagccatgaaacgtgcggataagatggatgtcaaggcatttgccagtaaagctaagaaatacgttcaagaaaaagacttttcgcaccaagcgaatcaagtgttgaaactttataacttgactatgagagtgaatcgtttagaactcctgaaagcaaatattggactggagcttatttctgtatttgacgacttggacaaatatttctcaaagaatttgactggtgcagctcttacagaatttgaaagacaagccggaattcttggtttaagtgttccaaaggaaggatatagcagtttagttgaatcagtgctaaatggaagttataaagtcgaaggatttgccagtttttctgacaagctttggcaatatcaatttgaattgaaagctgacattgaaaaacttcttattcgttcagtaactggtggaatcaacccaaaagcactagccccacaactaaaaaggctaatgacagaaaagggaaagctcaatgccacttacaatgcccaacgattactagtttcagaaacaacacgagttcagacagctattcaagaagaaagctataaaaaagctgatattgaagagtatgagtatattgctgaaccgtcagcttgtcctatctgtggggcattgaatggtaaaattttcaagcttaaagatatgtcgcctgggattaatgcacctaacatgcatccgttctgtagatgtagcacagcaccgcatgttgatgataaaggtttctgggatgatttacttgataggaaagtaattagtcaagatgagtacaagcaagcgtttgatgacagggtagaagctgacaaagcgattgaagaattgagcagaaaaagaaaaggatagatttcaatgaataaaaatgataaaaaaatatttgttcttgcaaatgagctattgggagatgtagctaatcaaaaaattactggtgtttctgtagataatactaattacgaagatgaaacaaaacgactttccattgttattgattatgtagaaacatcagggactaattttaaaataaaaacagatggtcttaaaaatattaatttgggtgatgttgctggggatattataaaagcaggaaacctgaatattcaaaactaagcgtttgtcactgacaggcgcttttcttatgctcaaaggaggacataaaatggacgaattacaattcacaaacaaagcaaagcaaatggtagctgactatgccaataaaaagaacgaggaaaaaacgacaccattagaagtatatgtcgtgtggtcatgcaagactttgcagaataacaaagcgttactttctaccgatgccccagacggtcgctattatgaagtaacttacaacggagataagcaagaattttattttgacgcttatatcaaggaacataatcaactcattaaataataatttaaacccttgggattccatgggtttttcttatgtccgtttccgaatgttgtggacactaaataaaacacgagaaaatcagactcccaagtctttaaatgcgagtaggaggaaccagaaatggaacatacagaacttttaccccttaatttgcaactgttcgcagaagaagcagccgatgagacgtctgaagctggttcggaaactgaaacagaaacaaacgaagaagagcagcaagaacaatcaactgataatgacaaaatcgtcgaaaagcttcaaaaacgaattggtaaagagcaggctgaaaaaaatgaaacaaaaacacagcttgaccaagcgctggctcgtattgaagaacttgaaaaaggtggaagaaagtcagttaaagaaaaatctgacgaagaaaaagctgccgaacttcaaaaagctaaagacgatgaaatcgcaagccttaaagcacaaatcaaaatttcaaacattaccagccaagctgatgaagtattgaaagaaagtggaattgctttaagtgctgctgaattaggattgttagttgatgttgatgaagaaaaaacttacagcaatgtaaaaactttcctcaatttgcttgataatcaacgctcacaatgggaaaaaacacgaaacacagggacaacgcctaaacgtgttccaggtaacactgatgtcgatgtttttaaacaagcggcagctaaatattaaaataggagatctaaattatggcaattaaatatttcacaaaacaatacgctggtatgttaccagaccttttcgcaaaaaaatcagctttcttgcgtgcttttggtggagttcttcaagtaaaagatggtgtcactgaaaatgatacttttatggaactcaaagtaagcgacactgatgtagttatccaagcatattcaactgatgcaaatgttggttttggatctggaacaggtaatacttcacgctttggtcaacgtaaagaagttaagtcagtcaacaaacaagtgagttacgatgctcctttggcaattaatgaaggaattgatgatttcacagtcaacgatatcaaagaccaagttgtagcagaacgtttagcactccatggtgtggcatgggcccaacatgtcgataaattgcttggtaaactcttatcagatagtgccagcgaaacgttgactgtaaaacttgatgaagattccgtgactaaattgttctcagatgctcataagaaatttgtaaataacaacgtttctacagccgtgccttgggttgcttatgttaatgctgatatctatgacttgcttattgactctaaacttgcaacaactgctaaaaattcaagtgcaaacgttgatgaacaaacactttataaatttaaaggttttattttatctgaacttcctgatgaaaaattccaacttaatgaaggagcttactttgctgctgataatgttggtgtagctggtgtcggaattcaagtgactcgtgcaatggattcagaagactttgcaggaacagcacttcaagccgctgcaaaatatggtaaatacttgccagagaagaataaaaaagcaattcttaaagccacagtaacaaagtaattgcccctaagagcgtaacgttaaataaaacaacgttatcgcttgcagttggggcaaacgaaacattgacagcaactgtcttaccagtagatgcagatgataaaacagtaacctttgcttcaagcgaacctacaattgctacggtaacaccgaaacaagggaatgtagttggtaaagctgaaggtaaaacgaaaattactggaacaacagctaacggattaactgttacatgcgatgttaccgtaacttctgtataataaggagtaatttatggctatcactgatgatttaaaaaagcttttaggcggttcatcggatgagcgcttggaagtaatcgaaaaacgcactcgtgaacgtctattgcttattcttggttctgacattgaagaagtaccgccagaactagaatatgttgttttggacgtttccttgaagcgttttaatcgtatcggtcaagaaggcatgcagtcctactcacaagaaggattaagcatgactttttcagaatctgattttgatgagtatgccgatgaaattgaatcatggcgaaaatcaaaagaaactgagggcgataagaagattgggaggttcagattgtattgagatatttagatgaagttacttttatcaaagaatcgcccgactcacattatgaccccgatttgggcgaatgggttgaaaaggagcccaccagaactgtttttagtgcaaatatcactgatattggaactgacagaagtgtaaaagtttttggagatattaaaaaaggggcaaaagtcatgcgaatgatgcccctttttactatgccagaatatgattacattgagtttgataataaaaagtgggctttaacaacctaccgcaatccaagcgagcgaaacacttttattttgcaggaggtaagtcaatgaaaataactggaattgatgccttgcaaaagaaattgagaaaaaatgccacgcttgatgatgtcaaacatgttgtaaaaagcaatactgtaagcatgaacaagaatatgcaaaatcttgctcctgtagatacaggaaacatgaagcgttcaataaccagtaattttactgacaggggacttacaggaacgactggacctcatactgattatgctggatatgttgagcatgggacacgatttcaagctgcacagccatttgttaagccggcttttgatgttcaaaagaagatattcacaaatgatttagaaaggttgacgaaatgattaaaactcgagaccaatctatttttgacgaattgttcaaacgaatccaagctttggggtataccgtttatgattataagcaaatgaatgaagtgggctatccatttgttgaaatggagaatactcaaactattcatgaaccaaataaaacggatattaaaggcacagtaagtctttcattatccgtttggggcttacagaagaagcgcaaggaagtgtctgacgtggcaagcaatatatttaatcaagcattgaatataagtgccacagatggctattcttgggctttgaatttacaagcaagtaccattcaaatgatggacgatacaacaacaggtacaccgcttaaaagagcgttgattaacttagaatttagactaagataggagatttaatatggcagaattaacagctaaacagggtaaagatattatcttactctatcgtttgcttagtaaagcaacaaaagaagccgcttggaaactcgctttccaaacagaacactcgaatgaaaaaactcgagattacaacactacagcaaccaaagatgggacaataggttctcttgcagcaattgaatacagtttgtctgccacatctattgcagcaaatggtgacccacatcttgacgaaatggacaaagcgtttgatgatggagaaattattgaagtgtgggaaattgataaagctgaaaaaggatctgacggaaagtacaaagctaaatatcttcgtgcttatcttacaagtttctcttatgaacctaactcagaagatgcgcttgaattgagtttagaattcggagtgtttggtaaacctcaaaagggcaatgccacactaactgaagaacaagctaatgttgttcagtatgtcttcaaagatactgttgcgggataaagctgaaaatattactggctctgcctggagtacagttgtagaagtgacaatttaaatactataaacaaaaggctagagattcgctctagtctttattttttaaggagaaataaaaatggaattaacaattaatgacaaacagtatgtttttatctttggttaccgattcattaaggaattgaataaaaaaaatgaagtcacagagcgtgggatgactttaaaagccggcttagataatgctttgatgaacttctttagcggagatatcgaaacacttgttgaaatgctaaaaactgcgaatgcaacagaaaatcctcgtgtctctgagaaagggatagttgaatggattgaagaaaatggtattgatatgctttttgatttagtactcgaagagttaaaaaagtcggaatttaccaagaagaaaacgttgaacttcgaaaaagaagtgaacaaaaatctacagtaatagattttgacaaactctatgaacaagttcagttaaattgtttgcgttatctcgaaatttccaatttaagagatatcgagcgaatgaccatttcggagtatgaattaaggctgaaagcttataggctaaaaagacttgatgagcaagaatctatttaccaacaagcatgggcaaattggcaagttcaatcaactaagcaacaaggtaagaagcaagtccctgtttattcaaccttcaagaagttttttgataaggaaaaatttgaaaacgatattttaggaattgattctccgaacaatacttttaaaaaggacaataaattaattgacctcatgaaaaaagcaaataagtaagaaaggaggaaaaacatggaatcttatagtgtagaagcggttctgagtgctgttgataaaaatttcacctcaaccatgaataaagcagatagttcaatgggaggattagataaaagatcacaaaatacaaatacttctatcctagatattgctaagggtgttggggtttttaaacttgttgattctgcggtaggtttggttagaaattcattagatggtgctatagatcgatttgatactttgaataagtatcctgttgtaatgcaggcgcttggttattctgcttctgatgttgataaatcaatggcaaaactgaataaaggaattgatggcttacctacttctcttgatgaaattgtatccagtactcaacaactcgctatatctacaggaagcttaacaaaaggaactgatacagctattgcgttaaacaatgcttttctagcttctggtgcttcaactgcagatgcaagccgaggaatgcaacaatatgttcaaatgttatctaagggaactgttgatatgcaatcgtggcgaacacttcaagaaacaatgcccattgcaatggataaagttgctaagtcttttaaagaccaaggtgtaaattcggttagtgatctatatgatgctttacaaagtgggaaaattacattcgatgactttaatagtcgattaattaaattgaatggcggtgttggaggatttgcggaacttgctaagaaaaattcagcagggataaaaacctcgttcaaaaatgtaaaaacagcagtagtaaaaggtttggagcatgttttatctgcaattgataacggaatgaagagcgctggtcttggttcaatcgctcagaattttgacaagctaaaaattgtagttaatcaagtttttagtgcaattacaaaagctattccaccagttattagtgtaattgcaacgtttatcaaagtgataggaaatatagttaatgcgctaaaaccattattgccgattatgcctgcattgattacttattttactgcatttgcaacagttgtagcaatacaaaataagataagtaaaataagtgatgcgtataaaaagtggaccaaagcaactaaaggagctacagtagctcaaaaagttctcaatacggttatgaaagcaaactggatagccattgttattgctgctattattgccttggtcgctggttttatttatttctggaacacaagtgagaaattccgcaatttctggatagggttatgggaaggaatcaaaaaagcggttgatactgcagtaaaaggaattcaaaacgcttggaatgctactgtcaaatggttcactgatacctggaacaatatcaaaagcggagccaaagggctttgggatggaacaatcaaaggtgctaaagatgctgttgatagtgtgaaaaatgcttggaacggtatcaaggagtggttcgctaatctttggaaaggtacgacaagcggcttagctagtgcttgggatagcgttacaactacacttgcaccatttgttgaaacaataaaaacaatctttcaaccaattcttgaattctttagtggattatggggacaagtgcaaacaatctttggttcagcttgggagattataaaaacggttgttatgggcccagttttgttgctcattgatttaatcactggggactttaaccaattcaaagaagattttggaatgctttggcaaacactagcaacagcgattcaaacaatagtccaaacttttgtgaatatcgtagttggattttacagttcatttttccaaactgtagttaacatctggacaacaattgtaaacacaatccaaagtctttggggagctttcacaacatgggtcgttaatatggctaagtctattgttgacggaattgttaatggttggaattcatttaaacaaggtaccgttgatttatggaacgctactattcaatgggtcaaggacacttggtcttcatttgtacagtgggtcgttgactctgccaatgctattgtgaatggagtcaaacaaggttgggaaaatctcaaacaaggcacaattgacttgtggaacggaatgattaacggactcaaaggaatttgggacggtttgaaacaaggcgttagcgatctgattgataatgttgtaagtatcttcaataccttgaaaaacatcaacttgctagatattggtaaagctatcattgacggttttgtcaaagggctcaaacaaaagtgggaagatggtatgaagtttattggtggaattggtgattggattcgggagcataaagggccaatccgtaaggatagaaaacttttaactcccgctggtaatgccattatgaatggtttaaattctggtttaactggaggcttccgtaacgttcaatccaatgtttcaggaatgggtgatatgattgctaatgcaattaattctgactattctgtggacataggagcgaacgttgctgcagctaatcgctcaatcagcagtcaagtttctcatgatgtgaaccttaaccaaggcaaacagccggcttatgtaaccttaaaactcggaagccaagaatataaagcttttgttgatgatatttcaggcattcaaggattgcaaagcgtcatgatgaataaattctagtcgggaggtagaaatgtacaagtttagagatacgacaaaacaggaacattatcgcaaccttccttttattccaaccagcgccatgagttatgatgggacttggttagaggaactcatagaaggttatcaaacattggcagttgaggggcgagaaatgtattctctcagctttgaatcacaagaaatgcaagtaggaagtgtgataactaatgtgaaatatcctcctcgggagctgacgataaaatataagcttgaggatagggaccctcgagctttacaagaaaagtttgatactttaaaagcattcttgattcgtcaagaagatgttcccgttatttttaatgatgatctggaatatacgttttatggtcgtttcaagactgcagacaatgtggctggagatactaattcaatcatttcaagttttactgtcctttgtagtaatccatttaaacacggaaaaactcaaagtgtaaaaaataaagtgattgaagttttaccttatccagttaaaccagataggctgtcatttaaattactgacagggggtttacttgcaactgacggaaattatcgcttgaagtcatcacaggctaaaaaaggcgactttttggaatttgatttccaatctggcaatacttttctcaatgggaaagtaaataacaacctcttaaaccttgattctgattttaaaaatatcagattgacaactggaacagatttttcaagttcaaactatgagttaacgattcaatatagaaaggcggtactttagtgagtaatatcttatttttagataagatgcaacaagtcatcaaaagttgtgattccaacgagttcatagaatgtgttcagacaaaagaaatcacaaccaatgcttctgaactgatgaatgataccctttcagtttctttaccttttgacgaaacaattaaagatgccagctatattgcagttaatgatacgaaagaacaagagttttctttatatcgaattttaaccgcaaaagatgaagataatttactttcatttgaagctgtaaattttgctgtcgatgaactggataattttatcattaaagatataagacctaaaaataggtctttttcttatgtgattaatcagattttatatgattcaggttgtgactgggtattgggtgtctgtgaaccaattaaaacaatttccagtactttctactacacttccatgcgagaagctctaaaagctctacaagagttaggttcagagtttaccttttcaattgaaattacaggaaataagattactaaaaaaatcattaactgctataaccaaattggaaaaataaccaataagcgatttgaatatggtgatgaagttctgaaaatcgttcaccaacaagaccgcacaaatattgttactgcgctaattggacgtggtaaaggcgaagaagttggggacggctacggacgaagacttgagttttcagatgtcgagtggaggaagtcaaatggtaaaccacttgataagcctaaaggtcaaaattggattgaatatccagaaatgacgaaagaatatggcatcccgtcaaatggaaaaatgttgccacgtaaaacagttgttgtttttgatgacgtggaagatgcaagcgagcttttacaaaagacttatgaccaactggcttattactgccgtccacttgttcagtttagcactgagatattaggtagtgattcaattggaaatactgtttcaatccacagaggagaccgaaattatcactatcagacaagagtctttaaggtggttactgaccatgttaatgggcgagtacaagctagtctgggtgataatttaagtggtaactcaattaatcgacaattatcacaagttcaaagcaatatctctgacctttctagcaacaaaatgacttggtatgactccacagaaattggaaagtatcaagacgatattatgcgaggtgctggcgcgaacggtggctcgatttacatggtcaacggaattgaagctggtgtatctcaatcgagagaaacctatgagcaagtctttatggatgggccaaagattcaagattcacagtatttcatgattcaaaataatgtcggaatttcttttaaacaatgtaaaaaaggtcaatggacgacaatcaaagatgtccacaatggagcaagcacaaccgcttggactttagacggaacgtttaatgcttctttcattgcggctgggatattagcaggagttcttatccaaggggttgtagttaagtcaatcggaagtaattctttttttcaatctgtattatctaatggtgctttttcgattgagcaatacaaagaaacaaataacgttgattatacaaagcctgattggcaaaaagatatacacggtggtaaagttggggagttcatcggaacttatgacgggaacacaaggaaggctaatggctcagctttaattaattacccgggttatattttgtcaataaaccaagataacggaagtggttcttctactccggttttccaagttccgtctgattcaacttttgataaccctaagtttaaattatttggaaaaggaacaatttacgatgacattgaaataaagggaaatctcacagtaaataatcttaaagttagtggacggttagaaacaaaggaattgtacgttaatggcgtaaaaatcgataccaacggtggcggaaactctggtggtggtgatacaggttggaatgggcaatacccaccagaagtcacaagtgatcgtgataaacgctactggcaaatttgggcaatggcaattggagctggtttctctaaacaagcggccgctgctttactcggaaatgcacagggtgaatctgatgctaacccaacggctgatgaaagcaatggtgcaccgggattcggttatggtgtatggcagtggacggatagttcaggcgctagctctggacgtgtttatatgattaatctcatgacacgagtaggagtcactgacaatcctgacacaatcacagcccaattcaagcttttaatgtggcatgcaccaaacggtcaatggattgcgacaagttcttatccttattcttggactcaattcatgacattaacggatattaacactgccactcaagcatttgtagctaactttgagcgtccattaaacggacaccctgaacgtagtacttgggcccaagaatggtataacaaatttgttaatcttgaaatcccaagcggtagcggaggttatattgctccaatttcaagtcctattaccgtaacaagtgaaatgggttggagaactagtccaatcaccggagcgcaagaatttcacaatgctatggacttggttaatggcaatccaacaactccaatcttagcttcaaacgatggtcaagtggtccaagcgggaagtaattattataactggtatggaaattacacggtcatcaagcatgcggatggactttatacagggtacgcacatcaaagcagaatcgatgtttctgtgggtcaaaatgttaaaaagggccaacaaattggacttatgggagcgactggcccagtcactggcccacatttgcacttccaatttatggaccaatattggccatcatcaagcgctcactttaagaatccaagggattatatcaaattttagaaagggtctattatgacagaacattttataacactgtccaccacagagcctaataacaatattggcattgttaagctaagacatgcggatgtcaatagtcaagccattgttgctcaaatcgtagagaacggtcagcccaagagttttgagggactgcaaccgttcttttgtttaatggcacaagaaaccacaggtcaaggattatcagaagaaagtgttgtctcctttgatgccaaaaatggaacattgaattatattgccagtgacaatgcgcttcaaatggttggacgaaatgaagcttattttagctttagaaaacaagaaggaagtcaatggattgagcaattctccactcggacttttcactatattgttgagaaatccatttattcgcaacccttcaaagactcaaactattggtggactttcaaagagctttatcgaatctttaataagtatatagaagatggtaaaaagagctgggaagagttcgtggaagcaaaccgtgaaatccttgaatcaattgatccaggaggacggttacttgcggaagttttagacctcaataaaattatttatcgtaaagttccaagcggatttaatgtagtaattgaacacgattcagagtatcaaccggatgtgaaagtaacttattacaaaaattcaattggaaccgaagcgaatggctttgatactggtccagtatttggcggtgagcgaatttataacctagcttcttcattaagctatatcagaaataaagtcaatgttgagcttccgtcagtttatgcaatggccggagaagttgtaaataatggtaacgaactgttgttaatcaacggaactgaggttatgcgttttgttattgagggcgcaagaatcaccaaaggctatgttgaaaaagtgaagccaccaactaatctaattgtttatgatatcacttcttcaagtgcaaaaatttcgtgggaaaacgggggataatatggcagataaaaattatttacataccgcctacgccaacagcgcaggcggcacggatggcttcacgactatttatccgaatttgaatttattggaaaatggaaaatttgcgaaaccaataagttccaaatggaatatagatggcactacaatttcaaaagacgatataactggatattttaaagttcaatttaatggaactggttctctgaaccgtgtatattacacagcaggtatttctaacattccaattgggcaaaaatattcattatatattaaagcctattctttagaaagttctttagatattaaacttggctctgtaaacagctcacaaagtgttactgttacaaacaacagtaacgttccaaaaacttataaagtcgagggattagtcagaggtaattccgatacatttgggatatttggaggattaacaacaactcgtggtactttgttcataagtgaaattaaagtagaaccaggttccgtcgccactccatacataccatcagctagcgaagtcacaactgctgactggccgaagtatgtaggaacttacgttgatactaacccggtttctagtacaaactcaagcaagtacgattgggatgaaatgaagtatcgggtttatttagatggtacacccataggcggaagtaaacttctgtcatttgatttagaaaatctaaaggcgggcacatcatacaacgttcaggttagtcaaataaatggcaatattgaaagcgacaagtcagaaagcgttgcttttaaaacaacactaaccaaataatagaaataggagaagaaaatggctagtattaaaaaagtatatcgtggcatgcaaaatggagcagaaacgattaatgatgatttggaagcaatcaactctgaattaactagtggcggaaatgttgttcataaaactggtgatgaatcaattgctggaaataaaacatttaccggagatacaacagtaaaaaacttgaatattactggaggtataaaaacaacaaaaacagttaatgttaatgtcggaaacgggatgagcattaggctaacaaaaaaaggaaattttgtggaggtacgtttttatggaacaatgaccactgtaaaaaatggggcagagatgggcggagacggtgcatcatggattattcctgattttagaccagaagttactgtatctttagttggtcacttggcaagtggcgctgaatcattccatattgatattgaaccaactggacgtgtggtttggtggggacctgcagtcacaggaactggtggagcacctcgaggaactgctttttatttattaaattagaaagcaggggttatggaattagaacaacttgtggagcagcatgaggacaaactcaagcagcacgataaagaattatctcgacttaatgatatgtcggttgaaatgcaaaagcaaatgaatgacggtctgactcgtgttgatgaatcaaatcgctttttaagagaacagaatactcgtcaatctgaacaaaatgctcaaattttgcaagctgttatcaaaggtaatgaaagctcagatgaacatcagtttcagttgaagctgcttgataaaacaaacttttggaaattgacgattggaatcggcggttctgcagcagcaatttttgcagcattaactgaaataatcaaattattttttaaataaaggagaagcaaaatgaataacaaaacttacgatgcaatcaaatggattgttgtcactgtattgcctgcagctagcgtttttgtagcagctctcggtcatatttatggttgggggaatacagatgcaattgtggcaactttgaacgctgtggcggtattcttaggtgcaacaatgcatattagtacagcaagttataataaaaaagaaggtgagtaaatgaaaagattaattaaaaaggctgccattggaatggtagctttctttgttgttgcagcaagtggacctgtatttgcggcagttggtgaccaaggtgtggactggtcagtatataacggaacttacggtaattttggttatggccatgataaatttgcttttagccaaatcggagggacttacggtggaacctttgtagaccaagccacctatgaaacgcaagtagcttcagcaattgctcaaggtaaacgagcgcacacttatatttggtatcaagtcggaggttcacaagaagtagcaaaagcagcacttgaccgctatttaccaaaaattcaaacgccaaagaattctattgtagctttggactatgaaggtggagcaagtggagataagcaagcaaatactgatgcgattctttacggaatgcgtcgagtaaaagcagctggatatactccaatgtattattctgacaagccttacactttggccaatgttaattataagcaaatcatcaaagaattccctaactcattatggattgcggcatatccaaattatgaagtaaccccagttccaaactatagcttcttcccaagtatggacggaatttcagtattccagttcacatcaacttatgttgctggcggacttgatggaaatgttgatttaacaggaatcacagataatggatacggaaaacagcaaggccaagtagttaaacccgatactgctataccggccattgaaaatggtaaagaagccaatgaagttaaaggaaacgatgtagaagttggaatgacggttaaagtaaactttggcgctaagaattatgccacaggagaaacaattcctcaatgggtaaaaggtcaaccacataaaatcatccagaagaatggagatactgtcttgcttgatggtattatgagctggttatccgttcatgatgtggaaactattgatgcttctacaagccagccaacgacacccgcaaaaagttatattgtaaaacaaggtgatacacttagtgggattgcttcaaactggggtacaaactggcaagaattagcacgtcagaacagtttatctaatccgaacatgatttactctggtcaggttattcgcttcacaggcggtcaatctggggctacagcacgaacttacacagtacgctctggcgataacctttcatcaattgccagtcgtcttggaacgacagttcaaagcttagtttcaatgaatggtatctcaaatcctaatttgatttatgctggtcaaactttaaaatattaaaaattaaaccctcgcatgcatgcgggggtgttttttgttaacaaatgttaatgctttcattaagataaattagtataatatccttatcgtaaatgctattccaaatacaaatacaaataactaagtgttttgggagagataaagcgctcttttccaaagcaagggcgcttttttcttgacaaaaaataatgatagcgctataataaattacccctaaaataatctctgaggattttaatccatgaaattctcattgtataatttcctaagcgtccctctcctaactggggcgctttttttgtgctataatatagtcgggatgtttgtgagatttcatcctattcctagagtcaagccattcttcggagtggcttttttcaaataaaaaaactctagctggatgacttcaaggagtccaactagaggataatgagtgttagtacaaattcagaaaaatttagtttatgcaaaacataagaggtactaacaatttaaatattaacaatttttcagacaattgtcaattatttatagtagtgtgttataatagttttagtggatgagaaaaacattcaattacacacacttgataatctgcagttccatccacacatatcttatataataaacaagataagtgctacagattatcatactaggttctttagctcagttggtagctaaccgttcggtcgctagttcgagtccagcaagaaccataatagggataatctgtcagtaatggcagattttgttatttatataggaagaaagaagaaaataataaagtttttagtaaaagatattaaaaaagttttaggataataaaaataaaaacctctgtcagaggtttttttagtaaaatagcaagattagaatacaaaattatactgacaagctctctgtcagtaaaattataaaaatgaaacacccgaaaacattgccatgaatagctttgaaagcgagtaataaattaaacatgtactcaagctagaaaaataaaggcttttctaaaagaaagacttgcatttgttgctgaaaaatgctaaaatacataagtccgactttttagatatatatagtatatatctttcgggaaatttctaaggaggtacttttgcttggcaaaagatgatgtaattgaagtagacggcaaagtcgttgacaccatgccgaatgcgatgttcacggttgaactcgaaaatggtcaccaagtcttggcgacgatttcaggaaaaattcgaaagaattatatccgtatcttgcctggagacaaggttcaagttgaactctcaccatacgatttgacacgcggacgaattacttaccgatttaagtaatccggacattcattgagtgcatgatgcacagtaaccatagaaaggaagacacaatgaaagtaagaccatcagttaaaccaatctgcgaatactgtaaagttattcgtcgtaacggtcgtgtaatggtaatttgccctgccaatccaaaacacaaacaacgtcagggatagaaaggaaatagaaaaatatggctcgttttgctggagttgatattccaaacgaaaaacgcattgttatttcattaacatacgtattcggtgttggacttcaaacatctaaaaaagtacttgcagctgcaggtgtctcagaagatatccgtacaaaagatttgacatcagatcaagaagatgcaatccgtcgtgaactcgatggtttgaaactcgaaggagaccttcgtcgtgaagtgtcacttaacatcaaacgtttgatggaaattggttcttaccgtggtatgcgtcaccgtcgtggacttcctacacgtggacaaaacactaagaacaacgctcgtacacgtaaaggtcctgctaaatcaatcgcaggtaagaaaaaataattaaatagaaaggagttaaaatggcaaaaattacacgtaaacgtcgtgttaaaaagaatattgaatctggaattgttcatatccaatcaacattcaacaacacaatcgttatgatcacagacgttcatggtaacgcccttgcttggtcatcagctggtgcacttggatttaaaggttctaaaaaatctacacctttcgccgctcaaatggcttcagaagctgctgctaaagctgctcaagagcaaggtttgaaaactgtatctgttacagttaaaggtcctggttcaggtcgcgaatcagctatccgcgcactcgctgcagctggtcttaatgtaacatctatcagtgatgtgactcctgtacctcacaatggtgcacgtcctccaaaacgtcgtcgtgtataattagttgctcttgtcactaatcacttttcgcttagaggagaacatacatgattgagtttgaaaaaccaaaaattactaaatttgacgaatcagaaaattacggtaaattcgttgttgaaccacttgaacgtggttatggtacaactttaggtaactctctgcgtcgcgtccttttgtcatcacttcctggtgctgctgtgacttcaattcaaattgaaggtgttcaacacgaattcgcaacaatccctggcgtacgtgaagatgtcatccaaatcgttcttgcggttaaaggaattgccatcaaatcatacgtagagtctgaaaaacaaatcgaacttgacgtaactggtcctatggatgttactgctggtgatatcttaactgatagcgacattgaaattgtcaacaaagaccattacttgttctctattgctgaaggtcactcaatgcgtgctgtaatgactgttaaaaaaggatacggctatgttccggctgacgaaaataaagtcgatggagcgccaattggcacaattgctgtagactcaatttacacaccagtaagtaaagtaaattatcaagtagaacctgcccgtgtaggtggagattctagctacgataaattaacacttgaaattactacaaacggtactatcgtttctgacgaagctttgtcactctcagctaaaatcttgacagaccacttgaacttgttcgttgatctttcagaagttgcagctgaagccgaaacacttgttgttaaagatgaagttaaaacagaacgtgtgctcgataaaattattgaagaaatggacttctcagttcgtgcttacaatggtttgaaacgcgcaggtattaacactgttgctgatattgttgaaatgagcgaagctgacatgattaaagtcaaaaacctcggtcacaaatcagtagaagaagtcaaagttaaattgactgaattgggactttcccttaaaaaaagaaaataataatataggaggaaacaaatgagcaatcgtaaactcggacgtacatcttcacaacgtaaagctatgcttcgtgatttgactacagatttgatcatcaacgaaactatcgttacaactgaagctcgcgctaaagaagttcgtcgtacagtagaaaaaatgattacgcttggtaaaaaaggtgacctttcagctcgtcgtgcagcagctgcttacgtacgtaatgaaatcgcaattaaagatttcaacgaagaaactgaaactttcccaactgcccttcaaaaattattcaacgaccttgctaaacgctacgaaggacgtaacggtggttacactcgtatccttaaagtagaaccacgtcgtggtgatgctgcgcctatggcaatcattgaattggtttaattgtattaaatcttgaagtaataataaaatactaaattgagtgttatgatgttggcgggggtttctgtgggtgcatgtgttgagttgtgattgactctctttcgcatcagccttgcttatagtctagctctgtctgattagattaaatttctaatctagtcaggccactcaatttatttattttagccgttgtagctcagtcggtagagcagcaccatggtaaggtgaaggtcgacagttcgattctgttcaatggcatatttttttacagtagatatatttaaatatgagaagtcttattttataaaataagactttttattgactttaaaagctttaaaaagcgaataatgtccatggttaaatacatttgtttacaaaaaaggctccaaataaaatgaatgattataatatgcacgcacctattaatgatatgcaaattgccgaggatattcatcttactttcaatcacatgatgatgtcaatttttcatagaatagttgtgaacaaaaaatgagaaaagcaattttcgttgactttgatggaacaatcaatattcggaagacaaaaagtactttcaaaatttgaatattggtaaaaagtggcagactttttttactttgcaagccattttccttatattactggcttgtccaaccatttctacagaatgttaagaagaaattaaatgcttatgaaaactattttggacaaaaataataatattttcttgatgtaaatcaatgttttatagtctttttaaacttataataagactataaatattgatgcataattgcaggaggaaagtataaatgtcaaaaatagtaatgaaattagatgaattgagctgtccatcatgtatggctaagattgaaggagctttaaatacaacaaatggagtagaaactgcaaaggtgctgttcaatgcttcaaaggtgaaggcagaatttgatgacaatcagataactgctactgacatagttagtaaagttgagggacttggctatgttgtccaaaagagtaaagtcacggaaatttaaagatatgatgtgctaactatttttatctaagattcgtgtcagacactctgaaatatgataaaatggtagaagaataaaatccttaatcaaataaaacagcggattatccgctgttttgttacattttaataaattttacgtatgaataagtggagagaaaatggcgaagaaaaaatcatcatttgtttgtcaaaattgtggctataagtctgcaaaatacttaggacgttgtccaaactgtggcgaatggtcttcttttgttgaagaagttgaagtccaagaagttaaaaatcaacgtgtttcaatgactggcgaacgttcaaaaccattgaagctagatgaagttgaattatttgatactcctcggattgaaacggacttagatgaatttaatcgtgtattaggagggggtgttgttcctggttcattagttttgattgggggagaccctgggataggtaaatcaaccttacttttacaggtttctactcaattggcttctagaggtcgtgtgctgtatgtgagtggtgaagaatcagcccaacaaattaaactaagagctgagcgtttaggagatattgatcgtgacttttatctctatgctgaaacaaatatgcagtcgattcgtgcagaagttgagcgcttaaaacctaacttcttaattattgattccattcaaacaatcatgacaccagaaattcaatcaactcaaggctctgtaagtcaagttcgtgaagtgactggagaattgatgcaaattgctaaaacgaatgatattgcgacctttattgttggtcatgtgactaaagaaggtcagctggctgggccaaggatgttggagcacatggttgatacggtgctgtattttgaaggagaacgaaataatacatttagaattcttcgtgctgtaaaaaaccgttttggttcaactaatgaaattggaatttttgagatgcagggtcatggcttggtcgaagtgactaatccctcagaggtctttttagaagaacgcttagagggctcgactggatctgcgattgtttgtgcacttgagggaacacggcccatattagttgaaatacaagcactgacgacaccgacaatgtttggaaatgctaaaaggactacctcaggcctagattttaaccgtgtaagtttaattatggcggtgcttgagaagagaacagggctcttgatgcaaaatcaagatgcctacctcaaatctgcagggggagtaaaattggatgagccagccattgacctcgcggttgcggttgctgtggcttcaagttataaagaacttccaacagatgcgcgtgaatgttttattggtgaaattggtttaacgggtgaaattcgtcgggtgacccgaattgaacaaagattaaatgaagctgcaaaactagggtttaaaaaagtatatgctcctaaaaattcaattgtagggattgatattcctgaacagattcaagtgattggagtgacaactttaactgaatgtttaaaactggtctttggctaatataaaaataaggctatttcgttaatgaaatagcctttgctttttatgaatgactcatcttataagaataataagctaatagaactaatagactagagccgattaatgtaaaatcacctaaccataaacttaaaagtgaagaaataaaggctcccacaacaaatgataaagcaagagataagaagatgagtgaattttttaagtcctttgtgtttttagaaactatatattgtcctagatttgttccaaaagctttgattttacctgtggacatgatattagcataaggaagtcctctgactcgagtaaaggtatcaccttgaataaccataaaaaaggagagaattccaacaaaaagtgaggctgataaatgtaaaaaagtagcgaaggcgagagaaataagtaaaataccaatcatttgtatgaagagaagggattcaatttcactttgattattttgggttttatatttggtgaataaggtcttgaaaagtgcacctagtgcaaaaaataaaattggaattataaattgaaaagctttctccaaattgccgtgggctaaattaattccagtctgaatcaaattcccagtttggagactagcgaaacggccgtcaaaatgaaaaaaggtaaaggcatcaacaaagcctgtattcatggcaagtaatagagcaacaagtaaactttctttagaatggactgcggatttaaacataattttttccttcataatctgtaaaagataaggtcattatagcacaatgataatctaatgtactctatttaaaataaaaaattaaatgatcgctaataaggatataagttataaaataataaatatagcatgagaaattaaatagatttcttgtgtttggataagcaatattaaaggagcgtgtggtataattgacacagggctttcttgtaagcctatccattttctaaaaggaggaaaagatatgcgtcgttggattattcatcttgttatgactgtcatcggagcatcgctaggtgttgctgttgtaccatcaattttaaaggtatttggttgggacacagggattttgcagaacgaagctgttgacggtgtgattggtgcaattatttttattattctttcatttatatttgccggttcaatgcttaatgggttgaaaaaaatagattctagaatttccaaaatgaatatgtcaaaaatggtcttcaatattattgggattgttcttggtcttctcgttggggttattggaagtattccattaagatttttaaatgttcctattttaagtaatatcatttcattcatacttgttttggtgatgatttatttgggatatgttttgtttgatcgacgaggagacgaaattgctagagtgctttttcgtaagcgccgtgaagcaatggcaactgaaccagcagaagttgctgaggaagttgtcggtgaatctaagagtgataatagtattttattggatacaagttcaatcattgatggccggattttagatgtaattaaaacagggttcatttcagataaaattattgttcctaattttgtgattttagaattacaattaatttctgatagttcagacccactgaaaagggctaaaggacgtcggggcttggatttggttaatgaattgactaaatttgatcaagttgaaatttctcaagttgattttccagatgttcgagaagttgatactaaacttcttaaatatgcaagttctactggctcaaaattagtgacgaatgattttaatcttaataaagttgctgaaattcagggtgttcaagttcttaacattaatgaccttgctaatgctgtgaaaacacaacttgttgtgggcgaacatattaacgtacaaattattcgtgctggttctgaacgtcaacaaggcgtggcttatttgccagatggaacaatgattgtcatcgaagatactgcaaaattgattgataaaacagttactgttgaagttgctaaggtgctacaaacaagtgccggtcgaatgatttttgctgatttagtaaaaaaataaagaagaaaaccgataaattatcggtttttatcttaaatgaattttgagtatttaggagtttaatatgtatttaaaacgttttattcaattgtttgtagtttttttaatttctttagctgtttttgctttgatattagaaatgaattttggaaattattggttaagatttgttttaggacttatcattgcttatgtttttcttactttaccacttgttctcttaacaatttttaaaactaataaaaaggctaatgttgttggtacgaatgctgtagaaaatgaacttgcttatcttttaaaagactttccaggctaccttgctttaagtgtgactgatgaaaattcaaagagttcaacaacgattatgagttttattcaagctcaaaaaacggaaaatattttctacatggttgcggataaaaaagcttcaaagattagtgatataaaaagaaattcacaggtgagttttacgacttggtttgataagttggaaaaaggagggcgcttgtcttcaaatcgggttcatgcagaaatcttagaagaggctaaagctcaagaaattgtgaaaaaagaaggattaatcttatctcttcatgaaaatgcggagaatatgtcaattattgctttaaagattgaatcggtcctttatgaaaattttaaaggtcaaactaaagttattaattttgaaaaataatttattaaaactgctttttagcagtttttttattttaataaaagtgggaaatattgatattttagctatattgtattactatatagatgtagttagtattactaaatagcggaggaaaaaatgaatcaaattacagaaatgttgaaaggagttcttgagggttgtgttttagaaatcattggtcaaggggaaacttatggttatgaaattactcaaaaactgcgagaacttggttttgaagatgttgtagaaggaacggtatatacgattacgatgcgtcttgaaaagaaagggtatgttgagattagaaaaaagccttcaaaacttgggcccgctcgaaaatggtatcgtttaaatgaggcagggcaaattgagcgaggaagtttttggaaaaaatgggcttttatttcagaaaaattggagtttttacgtcatcaaaatttattgagtgagcagaagggagaaaatcatggcggagcatagaaatattgttgatcgaatgattggtcttgaagaaaaaagagaatttcgcgaatttgaaaatcgtgctcagaaacttggagagaattattatgaagattataaggaattaaaaaaatatatatggcactctggggtaacgaaatgggcagatttcaaatttatttttggacaagttcttgatttacttgaagaagctaaaatccaagacaaagaattgactgatttaattggtccagatgttgcggcatttattgatgagatggtggatgatactagttgggaaaaaaagcaaaaaaataaactaaataaggagctgaaaaatggttttagataaaattagtgatcttcttgctgaaaaaaaagactggcaagccatgcaaaatcgagctaaaaaattacctaaagatttttatcaggcttatcgtttaattcaaaaatatatgttcaaaatgggggcaacagattggcatatttttaaggatattattgaattatttgaactggcagtagttgatgggcgaagtccagcagaggttctgggcaatgatgttgcaacttttgctgatgaattattaagtgataataaagaggactggcgaaataagtatcgtcaagaattgaatgattattttgctcaaaagtaatcaatagattttactgataagtctgtcagtaaaattgaaaatttatcaataacaaaagttactgacaggtttgttagtaacttttgttttttttaaaattccatgaccatattgtaccaagtttctccaccgaattttgactcggaaagtccttcgtcagtaaagccgtgtttttcataatagggaactaaataatcatggcaagtaagactgattcccaaacgttttttcgatttggcttctttttcaagtaaaaggagtaagtttgtcgcaattcctaagccttgataatcagggtcaacggttaaactgatgattttttggaaaccacctgttttgggattggctttggtacgttcaaaagattcatcatccaagtaacgaccttctgtaacaggaccagaaacgtaacctacgacagttccttcactatttcttgctgcgataaagctatcaggaattaagttaattctttcgatcattgactctacagagagggcttcattttctgagaaagtagctctttcaatacggatgacatcatctatatcatttggcataatttgagtataagtaatttcattcatacaattaattctaacatagactgttcagaaaggaaatcaataatcattgttagtaattaaaagaataaatagtttgtcgtttaaaggatatgaagtggtttgaaaatctaaaatctttaataaaataaagtttaactaaatgtttacttaagatttacaaaaaatttacattgagttttggagaatgggataaaatgaaagggtagtaatcaaaccaatggaggttttatgaacacaagcggaaaaaaattcctaggaattttaattggaatttcagctcttttattaattattgcgtctttgggggatttgcaaatttctaaaatggttatggatcaaaattcaatttttggtaatctttttcagatatttggaatgtttccgtcagcgcttatcccttttatttcagcggaaattatcttcatttatggtctaagacaagataatcaactgacaaaatggattttagcgatttctggacttggctttgcttattggtcagcatggggctgggttgatggttggatgttttacggtgtgaccacacttaataacatcaaaaatcatcagccactgggtgcggcaaataacagtattggagccacagcgacttattcttttggacttgaagcactttttacatttattatcctggtcatcggaacatttttgatttatagatggctgagcaagaaaacttacgaagaattaagtcaattgattattgtggcgattgctgggattgctgtcgtttatgtcagcaactcaattgtcaatacgatgaaagttaactgggggcgttttcgcccttatgaggttaaggaaattgtttcctctaccaaaggaacgttcactaattggtggcatttgaacggtcaaacaggtcatcaatcattcccgtcaggtcatacaatcgcagcggctgcagcactctttttaccattttttgctgacagaaaaaatcttaaaggccaaaagattttggcttacagcggatttattttcacacttttaatgatggctgctcgggtccgaattggtgcacatttcttatcggatactacgatgtcattaattatcgcgtctttagttacttttgttgccacaaaggcaattggttactcatttattgaggaagaatttctcaaatagaaaattataaatgattactacaaaaataacattctttggggtgttattttgattttggttgtaaattctttgttttctggagagattgtcttatactaatgctaagaaaatcaatttttgaaaggaataaaaagatgaaaacaagcgatgctttgattgtaattgatatgcaaaatgaggtatgtgctgggatttatcggcgagaagaattaatcgagcaaattaatcaacgaattcttacttatcgaaaggctaaaaaaccgattatttttatccagcataatgatgatggacttataagagaaagttttggttggcaaatgattccagaattgctgacagcatctactgacaagtatgttgaaaaaacgcatgccaatggtttctatcaaacgggactgcaaaaactactgacagacttgtcagtaaaatcgattgaattttgcggtgctcaaactgaattttgtgttaacacgacgcttgtttttgctcatggtctgggctatcaaaattggatgcaaagaggggcaagttcaactttcgatagtaaatggctgtcagcaaaagaaatcgttgatttttatgaaaaccatctttgggatgaacgatttcttcaattcttagattaaatttgtcaatgatagattacaaataaattttaggtcggcatgctttcttaatttgtggtaaaatagaggtgattgttagagtagtttaggctatttaaaaccaagaacgattcatttcttacagaaaagaagtgaacgaattaatgaggagaattggattaatatgaataaaaaaatccgcgtccgttacgcaccatcaccaacaggacttttgcatatcgggaatgctcgtacagccctttttaactatctttttgcccgtcatcacgggggagattttatcatccgtattgaagatacagaccgtgaacgtcacgtagaagatggtgagcgttcacaacttgaaaaccttcgttggttgggaatggattgggatgaaagtcctgaaacacatgaaaactaccgtcaatcagaacgtttgcctttatatcaaaaatatattgaccaattgttgactgaaggaaaagcttattattcttataaaacgccagaagaacttgaagctgaccatgcgaaacaagaagcggcaggaattgctccacactatattaacgaatatgctggcatgagtgatgatgaaaaagcagcttatatcgcggagcgcaaagcgcaaaatattgaaccggttgttcgtatttctgttgatgaaaaagcaatttataaatggaatgatattgttaaaggcgacattgaatttgaaggtaaaaacatcggtggagattgggtaatccaaaaacgtgatggttacccaacttacaattttgctgttgttgttgatgaccatgatatgcaaatctcacatgttatccgtggagatgaccatattgccaatacaccaaaacaattagttgtttacgatgctttgggttgggaagcaccacaatttggtcacatgactttgattattaattctgaaactgggaaaaaattatcaaaacgtgacacaaatacacttcagtttattgaagactaccgtaaaaaaggttacatgtctgatgccattttcaactttattgcacttttgggctggaatcctggtggagaaaaagaaattttctctcgtgaagaattaattgaactttttgatgaacatcgtttgtctaaatcaccagcagcctttgaccaaaagaaattggactggttggataatgaatacatcaaaaatgctgattttgctaaagtatttgaattgacaaaaccattccttgttgctgctaatcgctttgatgaacgtgctgaggaactggttaaactttatcaaccacaaatgaaatcagcagatgaaattgttgaattaacagaccttttctatggagatttcccagaattgactgatgaagctcgtgaaatgttggctgctgaaacaacaccattagctttgagtactttccgtgcaaaattggctgagcttcctgaaaatgattttacagtggaaaatattttcccactctttaaagcgactcaaaaagaaactggcgtaaaaggtaaaatgctttggatgccaattcgtattgcagcttcaggttcaatgcatggtccagaattaccagaaacaattgcacttcttggaaaagaaaaagtattggctcatttggacgctgctttaaataaataaattaatcaaaaaatgactgacagaaaaaagcgtagcttttgagtattctgtcagtaatttttatttataaaaagattgctgtcagtaaaataaaaactcgtcattgacgagttttttaattatttgaattggtcagcagctggaatatggctgtcatggaaatattgttctgacagttttttaagtgtgccgttgtcgtaaagttttttgagctcaacattcaaatctttttgcaacttgctttggctgttatcaagaataaagtaatcataagtcttaaattctggttgtttatccaagtctgttggaacagtatccactaaacctgtgattgcatgttctttaatcaaattttctgcgggtgctttagaagcaaataagaaatcaatttgtccactagaaatagcagataaacggtcggctaaaggacgttggctgtattttacattgatttttttgtctggatgatttttgttccagctttcaaacatatcaccatagttggttccagcaggaatttctgtcgttttaccagcaagttgagagatttttgtaatattttctttagatgttgagaaaatcgcatcaattccttggcgaacaggatagctaaagagatatttttcagaacgtgcttttgtcttaccaaaattatttgccgcaatttgtgcacgaccaccgtctaaagcagctaaaatcgcactatcttcatagactttaaagttgaatttataatccttcatgtctttgtcagcagcttttaaaatatcatattcaaaaccagtcattttgccattttcgctgtattcataagggacagaagcggcagaagttgcaacagttatggttgttactttatctgttgatttagaagatgaattatcttttgacgagcaagcagcaagtaagccaattgaggcaattccaactgttgcaagagtcaacaattttatttttttcatatcaatttctcctcagaaattttgtcagctcagtttttattttaaatttggaagttggttacgagtgagctgacttttaatatagacataatattaacataatcttaaaaaaaccaccataaaaaagatttatgacggttttttaacttttatatggttccgttagcgaaaatttcaaaaattttcttatcaaaatgctcagtttcccaagtacattctgggtgccattggacagcaagcacatgtttttctttattttcaatcgcttcaactaagccatcgtttccatgagcaatggccgtcaagccttggcccaaatctttaatgacttgatgatggaaagaattaaccatataattttcaggtaagaagcccaaggcactttcttgttcaacactaatatgatgagttggaatttcttgtggtgttggactttggagatgttttatctgacttgaagtttgactcaagtcttgataaaggcttccgccaaaataaacattgagtaactgtaggccacgacaaacgcccaaaataggtttatttgcttctagagcagctttgattgtggcaagctcaaaacggtcacgaatcggatcagttgttcctaatttagcattaggctcctcaccatatagataaggactgacatctgccccaccagtcagtacaattttatctaccagtgtcaggtaattttttatattttcggttttgtcaacaggaagaacaatcacagtatggcctaaatcctgaaaaacatcaataaatgattgacgagtatagcttactttgttccaccaaaaaggggattgttcaactgtattgtaaggagttccaagaattccaataattgccattttattttttcacactttcaataggaataatgagtttagattgagataaatcaatctcgtaagtcactttacgattatcacgaaccgtatgttcaaagtcagtactatagagtatgatccgaagtttatccgctttttctaaatgataaatcgttggttgtagttcaaatttgagcgtaaaccattcgtcagcatttaaatcactgaccgtcagcaaatcttgattttggagattggtaaatcctttagtgaccaactgataaggactctcgacaagaggaagttcaaccaaatcatctaacataaagtttcggccacggtcaagaactttaaaatcttttactcttgctttatcttccagccgttttttgggaccaaaatcaagaatttgagcagataagagtcctttactatcatttaattttagtctgatttctagttcaattggaccattaattgttaactcagaaggaagttctaaatcaatgacagcttcgttagctttattttcaaataaatcttttttaaagacgttgaaatctttagaatactttttgaagctttcatcatcatagtggttatcaaattgagcaaaagaaaccgccgttttcccaagggggagtttgagctggtcatcgcccccaaatttactgacagctgaccaaacttgttctttagaattttcctgtaaaataacgggtggaagatttaaatttaaatctctatctaataatttggcagagaaataagcattgattgtctcagaaaaatcaatggattgccaagaattcatataaatatgagccccacgatgtagaaaggcatgcttggcatgaccttctggcagagcctgccaaaaattataagcttgttcgggtgtaacattccagtcttgtaaaccgtgaacaattaggacgtcagctttaacttggtcagaattgattaaataatttcggtcatgccaaaattgattgtaatcaccagacttacggtctaaagcagtggtcatttctgctaagcgtttttcgtattcagcatttccttttaaataatcagcaccatcaagatttcgtgagtaagtcagtgcggcaagcacatctaaatcttcaccaggaaagccaccaggagaacggacaagaccattttcacgatagtaattataccaagaagaaattccagcttcagctaagatgacttcaagtccatcgactccagtagtagcagcaccataagccatcgttcctaaatatgactttccagtcatggctacttttccgtttgcccaagtggccttaatttcatgcgtctttttacgagaagtataggcacgagttcggccatttaaccaatcaatgacagcagtcatactataaatttgctgataatcgcctgaagtttggaagccatttgagccacgcgttccaacaccagccacataaatagaagcaaaaccacgcgtcaaaaagtagtcatttaaagaataagtccaaccatgagtaaagcgataaggtgctttatctacaataggaagttctttggtttcagacgaacgtttttgtggaagctttccttggacttggattttgtgactgtcctttttttccaaatcaacattcattttatgaagcgctaaatcattagctttctcattgattcccaaatgataaggacttgcggtcatcacaaccggaagtttttctgtgctttttggacgaataatttgaattttaattaagtcattttttcctttttgctcggtatcaactgggctttcaacccaaatgacctcacgttcaaggagcgaagaatcaaaagttgccaatgatttgtcattgaaaaagtgatagtgattatccaaaggaagaagaccttctgaaacccaatgttcaacaagaatcatcccgcttttacgacggctacaaagtaaatagtaaaaagcagagatgatagtttcagttgtcatttcaacatcacttcgtggaagattaagttttttagcaaattcagttgcttttcccatttcaaaatcaaaatttggaacaaagtcaagaagttgcaaagcaatattccagaaaatatcccaatctaattcaatagaggattttaagaattcaatgacgtctagctcagtatttgcttgcaaaacagtcatatcagtaggactttgaatgagaaaatcttttaaaattttcttttcatcccaaaaaacagaccaacgaaacccgagctgatcaagttctgctagttgttcatcaaaatttttatcaacaattgaaaaatgattaaagcgcatcttaagtcctccataaaaagcatgataattcttttaattatagcaaattttcagtaaataatcagactaaaagggtctaatttccaatgaatatttgaagcaagcgcgcttttctgatataatagctgaggttattatattaaaatcaaattttggagggttccataaaaaatggatgttacatggacagtgaaatatatcactgaatttatcggaactgcactactcatcatcatgggtaatggtgcggttgccaacgtcgaacttaaaggtacaaaagctcacgcacaatcttggatgattattggttggggttatggacttggtgtaatgctaccagcagttgcattaggtaatgttacttcacaaattaatccagctttcacacttggacttgcagcctcaggactttttccctgggcacatgttgctcaatatattattgcgcaagttttaggtgcgatgtttgggcaattattgattgttatggtttatcgcccatactatcttagaacacaaaatccaaatgctattcttggaactttctcaacaattgataatgttgatgataacgatgaaaaaacgcgtttcggagctacagttaatggtttcttaaatgagtttcttggttcattcgtcttgttctttggtgcagtttcggcaactaacatcttctttggtagccaatcaatttcttggatgacagactacttgaaaaaacaaggagcagatattacatcatcagatattatgaaccaaatttgggttcaagcatcaggagcttctgcttctaaaatgattgctcatttgttcttaggattccttgttatgggacttgtagtcgctcttggtggtccaacaggtcctggtttgaatccagcgcgtgactttggtccacgtttggttcacagcctcttgccaaaatcagttttgggtgaagctaaaggttcatctaaatggtggtatgcatgggttccagttgtagcaccaattcttgcagcacttgcagcagttgcattggctaaaatgatttacaaattttaattattaaaaaaaaaatactgacagaatttctgtcagtattttttttatttaatcataagagcaatgactagtccaaagagattccaaaggagatggacgctcatgttaagataaaaattgcgatatttagcataaagactggtaagcacaagactcattaaaccgtaagttaaccagctgtagaggtcagtaggaccatgcatgtaagcaaaaaggagcaatgccgttaaaaaagcaaaatatttttgatttttgaaaatgacctcaaaaattcctacccgataaacaagttcttctaaaaaaccagcagcaagtgtttgggttgcaaagacagcaattggaatcactttttgtaattcgtttagtgaatcttgattactggttgttggactttgattgataatttgagcaaaaattcctgtcagaatagagactagaaaaagcaaagcaaaaccaattattatttttaaaggaggaaaatatttccaacttattttagggatgagttcagctttacgagcaatcagataagaagaaataatcgtaagtaaaaagataatgaaaaagatgacggtatctaaggttgtgaaatggtgctgataagcaaaaatggttgtcgcaagcattggtaagttagataaaataaagagtaccaaccaaactgatttgtgataagcaaaaattaatccaacaatcgataatacgagagctgtcattaaaaatggtaaatgaaaaatactgacagatagggctgaaaaaagtagcgccaaaataatcacaattgcccaacgatatttggctaatgattgaagtttttctatattaaacatgtcaatattatagcatagtaatagctgtcagcagaaaaaaatatttcatttttgttgataacttttgttaatctgaacttgaataaattgtagtaaaatagagctacctcaaaaatgtgcatatctggcaaccacaataaaaggtcagtctaactttgttcgtacctagatatgtacttaaaactatccttaaaaatgctcatggttaacgactatgagtttttttattgagattttaaaattacataattaatgtagaaagaaaaagtaaaagatataaatcgttgataatttccttgaaatttgcgaaaataagagatagttatttgtaaatgtaatcaatggaggctaaaatgagcgagattataaatcatattaccgcttttcaaccagtctatcgtgtgcttaaccgtgaagaaaatttagatttctaccgtgaagtgcttggctttaaggtcttggtagaagaaggcgcaatggtatggcttggtgggcatgaagcgaaaaaagatcggtttcaattagaagaatcaccaggttttcgtcctgttgaaggattgaaaaaacacgggcaaacggtgatcaaagctaattcatctgagattgagcaattaattgttcgtaacttggacaagatttctaaggtctataaaggaaaaaatggctttgctttttcagcgctttcgcctgaatcagaacttttttgggtagcatcagatttactgacagatttatcatcactgacagaaattgataaatcagaaattgagcttgagaaagataaaacttttaaaggtttgtcagattttgaaattatagcaatggatttgaatgttgctgaccaatcaattattgaattttatgaatcagtttttggtcttaaagcaatcaataaccaaattgaatttccttttgtaactttgacttttagtgttgaagaaagcgaagatttagctgcaggaaccgatgaagtacttgaccttgagtttttagtgttcatgattgataaagattttgatttgaaagattttgctcatcaattttctgatgtagacggaacatatttggatggctcagctaaaactttttcattagaagttcctgaccatgcagaactttggtttgtaaaataataattttaaaaaaacttgttaatttttgacaagtttttttactcaaagtaaatcagaaacgaaggttgaaacatgaaaaatcaacaagaatttttaaaaataatcgaagattatcttgagcgtgacgttttcccaggtgtcaatttcgcaattattgaaggagaaaaagtcgaggagtatcttttaggaaattcagcaatttatcctgaaacaatcaagctcactcagggaaaaaaatgggatttagcttctttgacaaaagtagtgggcaccggaacagccgtcattaatcttgtcctagcaggaaagttagaaattgatgcccctcttcaaaaatattattctaaatttactgacagaagcgtcagcttgcggcaattactgacacacacttctggtattgatcctttcataaaaaatagagataagctaaacgcaaaagaactgacagaagcaattaatcagattaaagttactgacaataagaccttcaaatatacagatattaattttattttactaggttttttattagaagaatattatggagaaagtctggataaaatcttttacaaacaagtatttgaagactggaaaatgaatgacacaagttttggaccagtagaaaatgcagtcccaacaagtcaaaatatcccagtaggaacagttcatgaccctaaagctcaagttttaaaaaatcattgtggctcagctggtttattttcaacgatgtctgatttgattttattcagtcaagcttactttcaagaagaaaaatatttaaagctgacaaaaaattatgctgacggagataaaaaaagaagtttggcttgggacttactcgggccaaatgatgattggttgcttcatactggctataccggaacttttctattaattaaccctcgtatcaaaaaagcagttgttttcttatcgaaccgtgtccatttaaaagataatcgagaaaaatggattgaagaacgtgacttcttgataaaatttttaatcagtcatttgaccttagatcaagacttaaataaaaagaactgtactgtttagtttacagttttttttttagttattgctgacagactaaaaaaataaatggctggactcaaatagtttacatttagatttttttgacctataatttacttgaaaagtaatttatttacttacggcgaaaggagaaattagtatataaagtagtttcaaagtagttggtagttgatagatttaagatcaaggagaatatcatgacaaaaataaatgcatcagatgcaatgttaaaagttattgaagattggggtgtcaaaaatatttacggtttacccggtgggtcaattgattcgacaatgaacgcattatataaccgaagagacacattaaattacattcaagttcgtcacgaagaagtgggtgctttagcagccgttgggggaagcaaaagtaaccggagaaatcggagtaacctttggttcagcaggaccaggagccgttcacttgttaaatggattatatgatgctcaatatgaccatgttccagtacttgccttggttggtcaagttccaacgagtgcaatgaacactaattatttccaagaattaaatgaaaatccaatgtttgctgacgttagtgtctataacagaacagtaatgaccgcagaacaaatgccagcagtagttgatgaagcgattcgtcaagcctatgccaaacgtggtgttgctgtcattaccattcccaaagatttaggttggcaagaaattgaagataattatgtttctagcgctaatctatatcaaaaacctttgccactagaacctgcgactgaaaaaatccaagaagcttggaaaatactaaaagaagcaaaacgtcctttgatttatattggtcaaggaacaagaggagcccgcaaggaaatcttagaactttctaaaatgcttcatgctccaattttgagttctgccttaggaaaaggaattgttcctgacaatgcccctgcttacatggggtcagctggtcgagtggcctctaaacccggggtagaaattgcgtctaacacagatgctgttttgttcttaggttcagatatgccattccaaagtttctttattcctaaagatgctaaatacatacaagttgatattgacggaactaaatttggacgtcgtcatcaagtagatttagctattttggcagatgcaaaactgacaattaagaaattaatggaagtgggagaacaacttccagaaacaaattggtatcgcgcagcactagcagacaaagaaaattgggtagagtggcttgaaaaacgttcagttattgacagctcacctttggaagtagaacctgtctttaaagccattaatgacatggcaactgatgatgccatcttccaagttgatgtaggaaatgtcacaattgacggaatgagacttcttgatacaagtaaggaacaaaaattcacaacaagtggctggtatgcgacaatgggttatgctctacctgcagcaattggtgcgaaagcgcaatatccagaccgtcaagtttggtcaatttctggtgacggagcttgggcaatggtgatgcctgatattcttactcaggtcaaatataacttaccaattatcaatgttgttttgaccaataagagccttggatttatcgaagcagaacaagatgatgccaaacaaccacactcaggaattgatttgataggtgctaattttggcgcttctgcagcggctttgggtgctttaggttttgatgttaataatttgtcagaattaaaagaagcttttgcaaaagctaaagaagcgaatcgtccaacggtcatcaatgtcaacatctttgaccatcgtccattacctgttgaacaattgcaacttgattctgctgaatttgaaaaagaatatcaaactcaaggattgattccatttagcaaattgattcaagaataaaaataaataatattagaataaaaagacattagaagagagctctaatgtcttttttagatagattaaaataaaagaataaattagaataaaattagtttttgttagatagggattataaaaaaataaagtcaaatcatagtattattagtcactatatatgaatttgtaggcgttattcattgtcttagcgaatgtacttttataaatactaaagcaaaacaatgtatttcaatttgggaaataagaacaatatgagataataattatgtaaaatgagtttatggttgtgaaaataataaaattataaatcaaaaagatttaatctaaaactcaaatatgaagcatggataaaaaatagaaaggagtagaattctaccaaaataatttcgataaatatgaaattcgcaagaaaggaatgatagatgataaaaaaatggacggtttgtttaagtataataatcttagttctaaactttgttccaaacttactgcaaggtcatcaagtatttgcagaaaatcaaaaaaattataaagataaagttgagcttattaatgatgaatcattcaatatctcatatagtatgcgagctttagaaaatcaatacgaatgggaaattaattatagaataaataaaatagaaaatgataaagaattaaagttaaagttttcttttgaagggaatcagcctattgaaatagagaaaaatgaaagctggacacttaaagaaaaaaatacaataatttcagattttgaaaaagagaatgaaggaaagattgtacttagagctaacaactctatttcattgttaaacttagaaattcaggcagatgctaaacttattgaaaacgatcaagaagtcatcagtgaagatattttagcgaagaatgaatcaacaatttttagcttatatattccagaaaataataaagcagattcaaaagagaaggataataaaaatacagaagaagtattaaataacgagtcaagtcaagaagaaactgttagtcaattaaaaaaagattcacaattagcattttcttacccttcaaactttgggataaaggctagttttaatgatttagcgcaaaattatgaaaatatttctcctgaatatagacaagatgagacaggaatttctccaaatcattcttggatacctacgggaaatacaacagtggtcaatcatcaaggctggaattctttttcttcacagtgggatggagtcaatagttggaatggagaagcaacaaatttagaaaattcgtatattgaatacgctggagttaataatccggtcgattttgccttaagaaaatatgcaaaagaaacagaaacaccaggcttatacgatgtttatttaaatgttcgaggaaatgttcaaaacccaataaaaccagttgatattgttttggtaattgatatgtcaggctcgatgcaaggggcaaaagaaactgctgttcggcaaggagtgagtgattttttatcaacgattcaaaacactgcttatgcagattatgtcaatgttggaattgttggatattctagtcctgggaattatgtaacgggagctagtggatatatcacggtaccgatagataaagtatcatcagaaaaccatgttaaatcaattaatcaagcattagcaccacaattttcaggtggaacttttactcaattgggacttcgcaagggaactgagatgcttgaacaggactccagtgataatcaaaaaatgatgattttgatgactgatggtgttccgacgtttagttacaaagtaaattctgcctcaaaagttgataatgtcatttatggtcaaagctttgctgaaagccgagatgaaccaggaaacacttctaagattcaaagcccatattctgttaaagatataaatggaggaagtaatatcgaaattcgggacacttgggccgcaacattaggagaggcagaaatttctaaacaaaagatttcagaaattcatacacttggaattcaacttgggaatgatggaagctatctgagtcaagaagaagtcaaaagtcggaccagtctaatagctacgacaggattgtaccaagatgcaaatagtgcaaatgatattactgattatttaaaaaatcaagcaaatgtcgttctaagtcgatttaacacaattacaaatggattgattctcgacccactaggtgctcagtttgaatataaggatacaaagtttgaaattactagtgtcggagaagactccattgataatttaccaacaggtaagataaacgaaaaaggattagaaatttcaaatcttaatattgggaaaaatcaagaagttcaaattcattatcaggttcgattaaatactgaaaccgatgattttaaaactaattattggtatcaaatgaatggagaaacgacgttgactccaaacggtagtaacccagataataaagtaaattttggagtaccatcagcaaaatcatcaggaataaatcttacccttgaaaaacaatggttagctaattcagaaaatatacctgagaaagttgagctgcttataggccgaagaagtgctcaaatatcatctgattggaccaaggctgttacgcttaaagaggatgatgaatggcggagtcagttagaaaatttacctaagtattctattttgggcgaagaattcatttatgaaataaaagatgagattgttcctaatagcgaaatatatgattggataacaattggggaagacaaaactacaattgctaacatagagaagtttagattacagctaatcaaaacatctaaccatgataatgaaccattgtcagaggtggaatttgtacttaaaaatagtcaaggagaagaaattgacaaggcagtaacgaacgaaaaaggtgaaattttatttgataagacccgtttaaattacggagaagaatatcagctccacgaaataaaatcgcccggtcactcactggaaggaccatggaaaataaaaactgagcttgaaaatgggcagcctataataaaagttgatggagagcaaatcactttagatgaacactataataaattcatgattagtctcaatatcactaatgatataaatatagaggaatttagaaactctgttacaattgataaaagagcagttgattcagaagaaaaacttgatggagcagtttttaatttatatcagatagaatcagtagatgatgaattgacccaacttacgccccttgaaatcacaaataatctattacccggtctatacgccttgcaagaaagtgttagcccaaatggatattacagagatgatgaagttcactttttccgagtcaaatttaatggaagcattgttgctattggtagtgagggtatagatattccatttttagatgaaaatgaaagtggaaaaaatggattagtattgaatgaagaagaaaatggtgatttgcatctcacactaattttttataatcaggccgttccgcccttgcagttagaagttgataagatagatgatgactttacctcccctttagctggagtaagttttgaattgactcgcttaggtaggaagtctactgattcggactccgtaaaaagaatcaatagttttgatagaatactaaaaacatttaataatgactttacaggagaaacaatagccttaaaatctaattcagatggcaagctaactgttattgacaatgaaaataatggtcaagaaagtacatctccaattagcttagagtatgatactcaatataaattggttaaaaaaagttcgattggattatttccaaattttggagaaacctcccaatggataatcacaacaccaaatatggacgaacttaaagaacatgaagaagataataacattgaaattgatggtggagatttacttgaaaccccagatgaatcaatactagaaagtatcaatcaaacgccaagtacactcggtgtcgtttcgcttattaaaacaaagaacccagaattcaaagcattagagagtactgattctcaggtcgaaaaagtaaaaagtgactcatctttccaagaaaaaatctcagcatatttaatttcttttgagattcattctaatattactcatcgttttacaataaaaaaagttgatggaaaaagtaatagaccaatagacacccaatttgctttaaggtgggttgagaagtttgaaccgactcaagattttgacagccttgagcgtttaaatcttgacactttggacttgtcagggaatgatatttcaacgagtagtaagacttctattgatgccaaagcaggagtcactctttctactgaaaagggttctagaaccttagaccatatggctagaggtaatctttatatcataagtgaagaggaggtgcctacaggttatcaaaagactaacactgttattgtggcatacatggataaggcacaaggatatgcagataaagctaccattcatattagattagccaaacgttcggcaactcatccagaaatcctagagtttggaagtttagaagactttaaagaatataaaggagatttggaagatgaaattgggatagtatttgcaaattacaaaatggctgaaggaggaagtgaagaaaaagagaaagaaaaagaaaaagaagaaaataatgagatgcagaataagcaagaaacaaataaaccgaacatagaactccctgctcttggagcaatcggatttaatgatagtccaaagggctatcctggtgacgaagataatggaacaatggcagcttggtatattttttcaagtttaggattctatccagtcacggctgcttctaatcaatatgtattaggaattccactttgggacaaagctagaatcaacctttcctctggtcagcaacttactatttttgcagaaccaaatgctccgcaacaagttttcgtcaaccaaatcacatttactgacaaaaaagtcaatgatactttcatcaagcacgaagaattgataaaaggcggaaccctaaaatttgatttaggaatcgtaccaaatccacttaaatatacgaacgaacaacttccttattcactgacagaaaattaattactgacagaccagacataatcattctgtcagtaaaaaaacacgcttgattgattaaaatcagcgtgtttttttataaatttaagcctatttctttaaatcagaccaaacccattcagtaaactcaggaatatcaactccttcatttcttgtcacttcaaagtgtttaactagtgtccgttccattcggtcaatgaaagctttcgctagaccttgattaacttttcggttgacataaagaacttgcatggcatcaatcgcttggtggaaacggtcaagctcagagtaaacccgcatatcataagtcgtcgtgatgtcaccatcttcacggtaaccatgaacaatcaaaccatcatgtcctctttgatagaaaatggattcgattaaatcttcatatccatggaatccaaaaattactggagtgcctgaagggccaaagtatttttcaaattcttcatctgagagttcacgttcttgatttagagcgccttttttcttttgcaaccgccctaattcaaccacattcacataacggaatttcgcctgtgggaaaacttcgtttataagatgtaaagctgccagtgtttcaattgtaggctcagctcctgctgaggcaaaaactaaatctactgcttctccatttttagccgttgaagcccaatcaattgttgcaattccgtcagtcgccaatttttcagcttcttctttagtaaaccattgttgacgaggttgtttagaggctacaatatgattaattttacttctatcttgaaaagcacggtcaaatacggcaagcaatgtattcccatcagccggcaagtattgtctgataaaatcagatttcttttcagccaaatgagtcaacattccagggtcttggtgagtataaccgttatggtcttgttggaaaacagttgaagtcgaaataacattaagcgaaggataatcatggcgccatttttggtctgctgcttgacgaatccatttgaaatgttgagttaacattgaatccacgactcgcaagaatgattcataacttgcaaatactcctgtgcgtccagttaaagtataaccttcaagccaaccttctgcttggtgttctgataattgagaatcaataatccgaccctcaggtgagataaattcatcatttggattttttatgacttgcatccattgacgattcgtcaccttaaacatttcccaaaaacgattagacatagtttcatcaggaccaaacaaacggaaacgcgtaggattaagtttgactatttcagcaaaatattttgacaaaacattcatatccatattgtcatttgtatcagggagtaattttcctcgattattttcagaaattggatttgcgaattcttgccaatctggtaagaccaaattagaagaatcaactcccccatttgttacagggtttgaagccattcgcatctcaccttttggtgcaaaatcacgcaactcttctttcaaacttccatcagcattaaataaagtttccggttgataagaagtcatccattttacaaattctggtaaagttcccatatttttagaagataacggaagtggaacttgatgcgcacggaaactatgttcaatcggcattcccttaccgtcaaatttaggacctgaccaatcattataacgtggaccaccccaaccttttggtaaacgtgcgataacaattggccaagctggaatctctccattttgataacgattatcttcacgcgcatctttctgaatttgatgaatgtcttcaatcgctttatcaaaaacttcagctgctaatttatgataagccatgtaatcatgaatatcatcattttcaatataacgaggtgagtaacccagtccttcaaagaatttacgaatatcaacatctgaagtccgagcgaacaaagtaggatttgaaattttaaaaccatttaaatcaagaattggtaaaattgccccgtcattcttaggattaatgaatttaatagagtgccaacttgtcatcaacggtccagtttcagcttctccatccccaacaacagcaaaagcaatctgttcaggttgatcaagaatagcccctgttgcatgtgatagcacataacccaactcacctccttcatgaagtgaaccaggggtttgtgctgtcatatgcgaccctattcctccaggaaatgagaaacgtttaaacaaacgtgacatgccttccaaatcttgagtaatctctggataagcttctgtatatgagccatcaagataagaaggaacaaccatagcttgtccaccatgtccggggccacccatgtaaaacatcttttgattatatttattgattagacgattagcatgagcatagaggaaagtttgtcctgaaaccgtcccccagtgcccaataggattggctttaaggttttccgctttaattggagtacctgtcacagagaacaaaggattttctttcaagaagatcattcctgctccaagataagttgctgctcgccaccatttatcaagctttttcaaataagcttctgaattatattctgtcattatttcctcctgattttccttcattataggtcaattatgcttgatattctaataatttgttcatatatccactaggaaacattgctactcttcttctaaatgatgcacacgatgcagtaattctgcttcgatttgttcgagtgttttgcctcttgtttcaataacttttttactagtaaaccaaattgagaggaaacaacaagccgcataaatcagaaaaattttacctgttccaaaaaatgataataatggtaagaacgttaatgacaccacccagttagcagcccagttgacggcagcaccaaatgaattccccaaaccacggattttaagtgggaaagattcaccaatcatcacccacattactggtccccatgttgctgagaagaaggcaatatataccgttaaagcgataactgctaaatatttaccaaagccaatatgagcattttctgctaaaatcatccctactgacatcaatacaagagaaattcccattccccaagcaccaaaattgagcatccaccgacgattaactttatccattactctcatagcaatataagttacaataacattgaaaataccaatcccaatatgagcaagtaaagctgcgcttgccccaaatcctaccgcaacaaaaattgatggcgcaaagtataagactgtattacagcccataacctgttgaaaaattgccagaccaattgccataatcaaaactggacgtgacatttgaccaaataattcttgtaagccaccttgtttttcttccttagccatcaattgaatatcagaaatttctgcttcaatcgagtttggatcgtcatttatcattcctaatatttcacgggcacctgcttcattatcatggcgaacaagaaatcttggagattctggcaaaaagagtccaccgatgaaaagaagggctgctggaacagtggccaaaccaagcatccaatgccaatttcctgaaactccttttaaagcatagtttgagatataggctaataaaatcccagtcataatcatcaattgaaacatagttgaaactccaccacgaattttagcgggtgaaagttctgataaataagtcggcaccaaagctgaagctgacccaacagccatcccgagaataacccgagagatgattagtaactcagcactatttgaaagtcctgaacctaaagctccaacaaaaaagatgaccgctgacaaaagtaacagacgtttccgaccaaaacggtcactcattggtccaatcacgaccgcgccaattacagctcccattaaaactgccgctgtaatccatccttccatccaagcccaagaactcacctgccagctctctttttcaataaaaagtagcgctcccgatatgacgcctgtgtcatatccaaataataaaccacctaaagcaccaaaaaaatagatgaaagtgggagaaagttttctcatgatagtaactccttaatttttatttgcaagtcttcttgccttttttactacccacaaatgataccgctttccacgcttactttcttgtaatccttgatattttaaaatggaaatgttgctcataataaagctaaaaactactcttatgtaagagtagttttaattagtttattcatttttattaagcgtgccggatttccagcaattatgcagtggctaggaaatgatttggtcaccacagagccagcaccaacgacaacatcatctcctaaagaaactccaggcaaaagaatcactgaaccgccaagccaacaatcattaccaattactattggcccatcatattgccagccttcccgtcttaaaaacacatccttggcatgatgattaggtgtaaataattgacaatttggtccaataaaacagtttttcccaatcttaaccttacccgcactaataatctgaagtccactattaataaaagtattttctccgactttaaaacgattgggatattccaaagcagttattggaaaatatatttctgaactttgaggtaaatttggaagaaaattatccaagagttttcttgcttcatcaatattttcttttgccttatcattaatttcagaaattttttgactagaatttttgactattttttgtagttctacttctttgctatattggtaccaatcaccattatttattttatcaaaaatagatagctttgctaaacgtaatttttctgcttcatctaacattctcatcgactttttcctttactaaaaatcccttactacaaatatgtaggtaagggattgtagactaatcaaatcttgattcacttgttttccaagtataagaaccgtctggtaagatcttgtctcctaattctttatagtcaaagttataaaattctgcaactctatcatatccagaataatcaacggcagcaagcccgacaaatgctccagtgaagaatccgccataagtttgtaaaacataatcatctgaaaggacagccgcatctaagactacaggaatttctatgaattttttgccgtcaaaactatattcataagaatatgattctttacggactttagtgcggaaccaaacatattcagttccgtcaggaattttaatggcattatcttttaaataagaagtatagtttcctctgttattctcagcaacttcaatgacagctccattgatttcattccatgtgataaaagcgaaggaccaatgacggtcattgtaatagttggttaatccagccatttgttggtaagaaaatgggttaaattttactttgacttctgcgtcaaaatagaaagcttgccaacgtctagcaatcaaagataaatcaaaattatttgccaaagagccctgaccaatcaatgttaacttgccatttccaactgaacccattttctcagtaaatgggacacgcaatgtattccagttaatatccaaagtagaacttgcaaaatcgtctttttgactgtggtcagcaggtgcattagtttgaattgcatcttttggtccttgaacaaaagttgtcccaccatgaccaccaacaatacgtggccaaccttcttcgtcccattccactttttggatagaagtttcacgacctaaagagctccaaccacgagggtctgtgcttgattcatttttatgattccatggtcgagcgcataaggaagcataataccactcacctttgggtgtagatacaagacctccgtgtccttgcttttgaatataatgatcaggagtatcgaagtttgtaataaatgggtcgccgggttcagtttcaaaagataaagtatccaatgttttagagcgggccacgacttcttggtgcgtaaagactgttccaccttgagccgcaaaaagataataataatcattaatttggtagaggtgtggaccttcaaccaatttgacatttgtaccattgtaaatcgttttagctgttttaggttgtaacttcattgttgtcacatcaaactcagtcaatgtgattccgtcaaatggatgcttgtattcacgatgatcccatgtttgttgaactaagtatttccgtccgtctttatcatggaaaagtgaagcgtcaaagccaagaccattgagcttgattggatctgtccatggtcctttgatgtctgtagctgttgttaaataattggtcatatctttgaaagcaccattgacaaccttaacatctgtataaacaagccaaaatttaccatcagcataggataaatcaggggcccaaattccacctgaagctgagtttcctctcatatccaacaaagtggttgttgacaatggacttggaagtaggttccaatgttctaaatcttttgattcgtgcaaacgaacaccagggaaccattcaaaagtggagttcgcgatgtaataagtatcttctacgcgaataatgcttgggtctgcattaaagccgggaagaattgggttttgaataagtgacatgattttgtctccttttaatataaattattccgcttccttaagttgagcacgtttttcatcaagctgttgattaatctctgttacatctttatcagaaattggatagagttgcataataatcattgatacaagagcaagaacggctggaatccaaattgctgtgagatttataccagctagggcgttagcatgttgatgtgctgctgtctcattgaaaccataagctgctaagaaccaaagtggaatcgctccacctaatgtaaaaccaattttgaagaaaagtcccatgattgcgttaataatcgcagcatttcttttacccgatttgagttctccataagcgataacttcaggaactaatgcccacatgaatcctgttgctgaagttaagccccattgtttaataaaggttgcaacataagctaaccagagggcatcatgcattccattaagggaccaaatatatgtcaaaatttctccaacaatgaacattccgataaaaagatgaaagaaaccttttttaccgaaaattttctttaaacgaggccaaaagattgggaaaacaattcctggaattgaagcgatgaggccgatggctcccatccattctgaatgtccaacaacaaattgattaaagaaaccatttacagtattcatgaaaaacatgaaagtgaaagctaacatgaagaaaatccctagaatcacaagtggacgattgttctttaattcaaggaagaggtcagttgttttaacttctgccgattgttctgctgttgcaaccacacgttctttggtcaatttataacataggaataaagctattgcaccaataatcatataaactgagtaaactccaaaccaagcatgtcccgctgagggatcagtataattccccatatgaagtttaaggccaaataatccagtatctttaagacttctttctttcggtgctgccatttgaacaaacattggaaagagggtatagactaagagatttgctccatttgccaacatcatccgtgtacttgtcagcttatcaacggattccggattacgagttaatgatgcattaagtgaaccataaggaatattaacaactgaatatactaagtctaaggcaaaataaacgataaaagcaaaggggacagaccctttaacacctggtagaggtgcaaaaagtaaggcagctaaaatcactggaggaatacctgctcttaaaagccaaggtcgatattttcctgcttttgatgttcttttatcaataaaagtcccaaccattgggtcccaaaatacattaataattcgcacgaacagaaaaataaaaccggctgttgcagtaccaatcgcattgactgttgtcatatagagtgctaaaaatccaccaacagtcccaaagacaaggttttgtgcaaaatcccccattccataaccaatacgttctccaagcgttagttcatgatattcatcatgttgaacttgtttgattttattactcatttttgagtacatccctcctattattttattaaaattatttttactgatgagtctgtcagtaaatttttaatccgttgtaaatagatattctgttataaaagtctttttttgacctgctttaagctcaatcgttccccattcaggatgatgaacaaggtcaggtatttcttgaaattcaatagcaattccgcgatttttggacattggtctgtcattaatcattgactctatttctggatttgtggctgtgtaaatcacgaccgcttgtctatcagtttgagctactagtttccgaccagataaagggtcataaagcattaaacttttatctcctttgggattaaaaacaaagcaatcatctagtcctacgggattatcttttaaaagttttttgattgaaacgctttctttaatggaataagaactgtcgtcaacatttagaagacgaccagttggtatattctcttgattggtttcaaccagaaagtcaacatttgcttgaatgaaatgctcatgagtcgttgataattctgctgacagattaaaataaggatgccaagccggattaaagactgtgtcagttactgacagacctgatattgtcacttctaacttattgtcagttaatttataagtgacttctgcttggatttgacctggaaaaccggactcctcatctcttaaacttagtttaatgccaagagatgatgctgtttcaaaagtttcataagaccaaaactgtctttcccagccatggcttcctgaatgtaaattattttttccttcatttgcctctaaactgacagaatcataagtagcacctgaaatacgcccggcaactggaccgcaaattacaccataatatcctccatcatttgcataggtttcggaattgtttttggataaaagaatattttcaaatgttccatttttgtcaggagtgaggagttgatggactcttgctccataatcatggacaacgatggtgagtcgttcatttgataatgtaatctgactaattgatttgtcagctctaaaaggcaaagattctttggaaatggtaaatgtcataattaaccttcgtcattgaattgtactaattgatgagaaatttcagaggtatttttataaacttgtttccaaatttgataaatttgctcataacgtgctacattttttggatttggtatgaaactggcttccttgtaatgaacaaaagctttagtgaccgcttctaagctatcaaaaagtccgcaaccaaaagcagcaatcatacaagcaccaagtcccggtccctgctcaaccgttaagcgaatcatttcagaattaaaaatatctgcttgcatttgcataatgtcgggattttgcgcacccccacctacggaaatcaaacgtttaaacttcttgtttttcgttttttccatgatatctttagaatcacgcaatgaaaaggtaattccttcaagcactgctcttgaaaaatgtttttgttcatgatgagcagaaattcctataaaacttccgcgaatttttgaatcaaaatgtggtgttctttcacctacaatatatggcgtaaagagcaatccttctgaaccaggagaaactgtgtaaacttctgacaaaagttcattgaaactcaagccttttccaaaagtttccttataccagtttaaagaatttccagcagccaaggttactcccattgagtaataagcacccggaaccgtgtgattaaagaaatgaagttttcctttataatctgcaattttaggttcataagcggaaacgactccggaggttcccattgaaatcaagcccacttcttcattgattaaaccaacacccagagcggcggcagcattatcggctccaccagcaaatacttttacttcatttgtcagtttatagcgttcagctatttctgctttgacaaatcctgttcggtcagtggattcaatcaattcaggtagaatttccatatcaatattgaatgcgtcagtaatttcctctgaccattgttttttctcaatatctaaaagtaaagttcctgctgcgtcagaaaattcggtataaatatttcctgtcagccaaaggctcaagtaatcttttggcaacattatttttttaactcttgaccaaacctctggttcattttcttggagccaaagaatttttggtaaggtaaatccttcaagagaaatattttttgtaatctctaaaagtcgctgaccaagtctgtcagtaatttcttgacattgtttgcttgttctcacatcattccaaagaattgctggataaactggtttattattgtcatctaaaacgactaatgaatgcatttgccccgaaaagctaatacctgcaagttgctgaccaaaatctgaaatttctactgacaaaccggtcagtactgattcaagtgccacaatccaatattctggacgttgttcagaatagccttgtttgggcgtatcaatttggtattcagcagattttgttgtaattaaattaccaacttcatccatcaaaattcctttaagacttgatgttcctaagtcaattcctaacacgtaagtcattattattcctcataataaaagagaaggacgaggaggaattcctcgccctcttttaagttctaaattttaaacaagatagtcattcaatactgatttgatgtattccaagtgattagaatcaagttcaatatcatcaccatattcaagtgcaaatgcggcaagactttcaaaagttgctgttccattttcaatggattgaccaacttctgtatttctgtatgaactataacgttcgtcaacaatatcagacaagaatttatcttcaatgattgctgctgcacctttcaaagcacgcgcataagtatccatccctgcaatatgagcaagaattaaatcttctgctttgaaacttgtacgacgtactttcgcatcaaagttaattccacctttgccaagtccaccgttcaaaagaatttggtgcatcgcaagtgtgatatcaataacaagtgttgggaattcatctgtatcccaaccaagcaagtaatttccttgattggcatcaatagaacccaaagcattgaaagtacgagcagtatttaattcgtgttcaaaagtgtgtccagccaaccaagcatgatttgtttcaagattgagtttgaaatatttgtccaaatcatatttttgcaagaaagcaagagctgttgctgagtcaaaatcatattggtgagtcattggttcttttggttttggttcaatcaagaaaatgggcaagtggttgattgattttgcataatcaattgccaaatggaagaattttgccatatgatccatttcaagacccatatctgtattcaaaagtgattcataaccttcacgaccaccccagaagacgtaattttcaccaccgagttttttagaaagttcaagaccttttttaacttgtgcagcaccataagcaaagacttcagcacgattagaagttgaaacaccattcatatagcggggatttgaaaacatgtttgctgtattccaaagtaatttaatccctgttgctttttgtttttcaagaaggtggtcagtaatttcgtccaaattagcataaaattctttcaaagaatttccagtaggtgcaatatcaatatcatggaaacaataatatttaacacctaatttttcagcaatttcaaagaaagcatctactcgacggtgagcacggtcaagttcagaaccaccttccaaatcccaagggcgttccattgttgctcccccaaagggatctgacccatccattgtaattgtatgccaaaatgcaagggcaaaatgaagttgttcttccattgttttaccagcaactacttcttctggattataatggcgaaaggcaaacatatttttagtttttgtaccttcgtatttgataggtgcgatgtcgttaaagtaagccatttttatagctcctcctctttatgatattaatattattttcaaactcgtaattactactatacatttcttgtaatatatgtcataataatagtgattaggagagaatgaacatgaaaaacgaattagagaatatttatcattcaaaaataaataatcttaattttttacttgtcgatattacttacagaaaacctcaccttcattttgacattgaattagcttttgtcttagaaggggctggtcaggtaataacgcaagagcaatgctttgaaatcaaagctggacaggcaattatctttaatagttgccaagttcacgaactatcttcaagcgactctatgaaacttttgattctacagttttcatcagaaatttttaaaattatcttccctcagctggataaaatttattttgaaaatcatcctttcaatctaaaaaatcaacctgaaactttaaaattactcttacaagcggctttaagttattttgctgatgataagaataattccttgcgtactcacggatatacttcccttttattagatcgcttattaagtatttctgaatacagtattttaagcagttctgaacaaaataaattaatggatctccaagagcgaatggagagaatttcttcttacattcatgaaaactacgaccataaaatttctttagaaatgattgcttcgcatgaaggactttccagaacgtatttttcccatttctttaaaagtaattttgggattaatttcaacgagtatttaaataagattcgttctgaaaaagcaagaacattactttcttcttctaaagataatttattaaatattgcttacatgtgtggtttctcagatatcagaacgctcaacaccgcttttcttaaatcttatggtgttctaccgaaggaatttagaaaaaatagtgtactcttcccaaatctcaactatatgactttcaatcaagataaaattgataatcaagttttttattctgatagaggctcttttgatattttgcaatattatttagaaaaaaactttgaaaaaacaagtagtcatttttagactctttatttttaacaagttaatgatatcgctttctaagaatcttatcttactgttttgttctatttttcaggggaaatgttgtcattttatcatacctaaatcaaataaaaaaaatacttggcttttaccaagtatttttattaatcccaaattttagttgctttaatttcattaatcgtttggtcaaaatcatttgttaagattgtcacatgtcccatttttcggttatgtttagcatctgcttttccataatcatgttgatgccaatcggcatgctcatgattaagattcttaactgcctcaacgtgttgccctaaaacgttcaacataatggcaggtttcaaaagtttaggttctggtaggtcttctcctaaaatccctttaatatgcaaatcaaattggttgaaatcacaagcttcaatggtaaagtggccactattatgtggtcttggtgctagttcattgacatagatttgaccatctgctgttaaaaacatttccacacaaagcacgccagatagctctaatttttccgcaattgaggtcgcaattttataagcattctcagtaatttcagcagatatacgagccggagaaatcgtctgatgtaagatgttttctctatgttcgttttcagctagaggaaaaaccacatattcgtgaccatttccactaataataacagaaatttcacgttcaaaagaaataaaatcttctaaaacacattctgaaagttctgtcagtgatttagctgctgacaagtctttatcagcatttaaaaccacttgtccatgaccgtcatagcctccagttgttgtttttaaaacttgttttctagttactgtttctgggagtttttccgctgaatctacgagttgccaaggtgcaacattaactttagcttcgttggtcaaaaattctttttcaaagcgacgattttgcgtaatctctaacagacgtattccttgaggaatccttacacagtcttcaatttcgtgcaaagcttttgctgatacattttcaaactcataagtaatgacgtcacaagcataggcgagtcttaataagttttcaacgtcatcataaggtgcaacaatcagttcatcagatacttttgccgcagaacagtttggatttgggtcaagtgtaatgactttatgtcccatgtattgagcagcaattgccatcatctgtccaagctgacctccaccaataataccaattgtttgctttgtattctttatcacaagtcttcctacccttcattatttgaaatcctacaacttttgaactctttttaaagtaatgctttgtttgattcctcaaccatttcttgtgcagcagcccgatagaccaacaatttttggtataaattctcatttgtattcgccaaaagttgcaaagcaaataaagcagcattttttgctccagcctctccaattgccattgtcgctacaggaacccctgccggcatttgaacaatcgaataaagtgaatccaaaccagataaagctcgcgattttattggaacaccaatgactgggacgagggtctgagcagctaccattcctggcaaatgagcggctccaccagcacccgcgatgataactttataacctgcctcatgggcttggctcgaaaattcagccattaaagctggtgttcggtgtgcggatacgacctttttttcataagctaaaccgaagtcatctaaaatttttgctgtttctttcattgtcgcccaatctgagctcgaacccatgataattgctacttctgccatttttcctcttcttttttcttaaccaaaatttttatattgctcgtgaaccaatatcatgacgataaaagaaaccatcattttccaatttatcaagtttttcataaagcaatttctgtgtactttttacatcttctcccgtttcagaaacaagataaactcgacctccactagagattaattgattattttcatttttggaaactcctgcataataaacatttaaaccttcaggaatttctggaagaataagtcccagttttgcttgactaggatagccttctgcagcaacaaccacacccaaagtcacaccagactcaagccattctaatgttggctcatttccagctaaaatatcaataattacttgagctaagtcactttttaaacgggggagaacaacttgggtttcaggatccccaaagcgtgcattaaattcaattgttttgactccgtcttctgtcaaaattaaacctgcataaagaacgcctgtaaatgacttgccctcttctatcattccagctactgttggtttaacaactttttccagagcctcatttacaacctccttagaaatatgtaggaccggtgagtaagcccccattccccctgtgttagggcctttatctccatcaaaagctcgtttgtggtcttgagcaatcggcatcggatatattttcccgtcatggacaaaactaaataaagaaaattcttcaccatcaagaaattcctcaatcacaacttttccttgactaccagaaaaaatatcggccagagctgacttagcggtctcaatatcaaaggcaaccgtcacaccctttccagcagcaagcccatcagctttaataacaagaggaactcctttttcatctagatatgcaagagcaggctctaagctatcaaaagtagcataatcagccgttggaaccccatattttttcataattgattttgcaaaatctttagaaccttctagctctgcggccattttatttggcccaaaaattggtaattctgcttttataaaagcatcgacgacgccattcatcaaagcagtttctgggccaacaaacgttagtccaatgttttgattttgagcaaattcaactaatttatcattagatagttcggaaatatcaactatttgaattccatctttttccattcctgaattgcctggagctacaaagacttcttcaacttgaggactttccataaatttttttgctaaggcatgttcgcggccgccagaaccaattaccaaaattttcatcatttctccgatattccaaacgctttttatatacacaaacttgtgtattcagctattttatttattattcaacaaatcttgaacgaataataaaagtcaaagtgacgatagctcatctatcttttcttgctttatatatcttataattctatcttaaaagatttgtgataaaagaaaaagcctgaacaaaagtttcaacaaataagaagagagattgttcggtatttactcaattctagccagagttttcctcttgacatttttaaatgacaaatttgtttatcagcttttctatcgcaattttcattaaaaacatgtaaaataaatttaagtagaaaaagaaagcgaaaacttatggcgactcaaccaaccaaagataaaattattagtagcagctgggaacttttagaagaacttcctctcacagaattttcaatgcgtaagttagctagtcggctaggaatgacagtgtcttctctttactaccatttttcaaataaagaagcactttttgcagaacttattgataaagcaagccttgaaattatttttccagcaaatgagaaaacgtggcaagaccgccttttcgtctatggtaaaaatatttatgctgttttagaagcttatccaaacctcgcacaattgatgatggattatccaccagaatctgagaactatcttcggctctttgataaacttttaatgattgtagatgatctcaagctttctgatgatcacaaattttacaccattaacctttttctaaattttatttacaccagtaaaatagatagtgatcgtttagtagagcaacccgaaaaacccgtttctactgtcaaaattcctctggtacaactggctccttttctcgacaaatattggcgaactgaaagcctcaccagtcttggctcttctgaaagttttgagtttggtttacagcttattatttcaggaattgaaaaaatgcttaaaattaattaatttataaaaaacttcctgaggaagtttttttcttgactttattttagaacaatggtattatttttaccgaacggtgttctaaaaatataaaagaaggttctttatgaataatactaatgattttaatttaaaaaaagtcttacctgcggttttaacaattgcaattggaatgcttttagtaatgatggatacaaccattatgaatgtcactcttccgcatatccagtctgctttccatcaaaatctctcaaatagtcagtgggtcattactgcttatactttagctatggccacagttattccatttgctggatttttgggagaccgcttttcagataaaaaagtttttgctttagcaatcatttttttcactatcgcttcatttcttgcagctaatgctcactcactgcaaagtcttattatttggagaattgctcaaggtttaactggtggcgttgttgctccaatcggaattggaatgtcatttaaaattattccaatggaaaaacgaggttcaatgatgggtcttctaggattaccaatgttgctcgctccaacaataggtcctgcactttcaggtttcttagttaaacacttcaattggtcaactgtctttttgattaatcttccggttggagttctagccctaatctttgttctcctctttctcccaaattttccggcaaataaagcaagtaaaattgacttaaaaggggctcttctttctccatttgcctttccaattttaatttatggtgtacacgttgggacagataaaggctggtcaaatcctactgccctctcttttgtaggccttggtataatcatgttgcttttattcattattgttgaactacgtgttgagaatcctcttttacaccttcgagcttttgtaattcctgaatttacaaaaggaatttcgctcatgtggctcaatcaaatcgttgttttcggggccatgcttcttgtcccactttacttacaaaatgtcgttggactttcttctaaaaatacagggctaatcatggttccgcaggcaattgctagttttttaggaatgacaatcggtgggcgtatttttgataaatttgggacaaaagctgcagttctgccgggttttactctgggagctataagtcttagtctttttagtcaaattaaacctagttcttctttagctttcacactttgtgctattattttacttggtttaagtcaaggtctggtcaatatgcaagttaataaccacgcccttcaatctgttccaatgaaaaatatcagtcgagttactccactaacaaatgaaatgatgcaagtagtcaactcatttgccattgcctttttgacagcatttttaagtggtcaaatcaaaaaacagactggactttctcctttacaagcaaatctaactgccttccaccatactttctggttactcctccttttcgttattgtaggtttcattttaacgctattcttacgaaaaaaagcaaaagcataattaaaaaacactgtttatcaaaacagtgttttttaaatctgatttaagatttcattgacttcatatttttcagcaaaaagtaatcgtaaggctaaaaccatgcgagccgcaagaatctcagatgataataaagaaaaagtgttttcctcattaagaaatttggtcaactcttgttcgtaagtatgccacatctcaagtagacggcgtcttaaaatatcactttcttcaataatcgctggcagattaaaaaaaacttctttttcattattcgccgaagtattcaagagccaatttttgtaagtttcccagattttatcagctggaatttcttttaaaactttaataatcaattctaaaagttcaccctcattatcaaaaacaagctcttctttagatgaaatgtattgaaaaagtgtttttttggcgattccacattcattagcaatctcctgcacagttacgttatcaaagcctttttcttcaaaaagatgcattgattttgtgagaatttccaatcttttagccatctttttatcttctcttttactcataattctagtataacacatttttagtaactcggtaactttttctcttgacaagcaaaaagtaaccgagtataatcattttcataaagataaaaagtaactcagttacttaatttcttggaaaggaactgtgttcgtcttctctaaagctagatgaatcacatcttaatatgaaaaataaaaaactttggattcttatgattccgctcatgctcgttttatttattgctacccttgaccaaacgattgtggctgcaagccttccgaccattgctcgggcgattggaaatagcgaccaaatcacctgggtgacgactgcttatctcttgacttcggcagtaactaccttaatttttggaaaactcggcgatttatttggtcgtaaagccatattgcaaatcgcactcggcatttttcttatcggttcacttttttcgggaatttctgataatatctggtttctcatcattgctcgcgcctttcaaggaattggcggaggtggtttaaatacactctgtatggtggtcattgctgatttagttcctgctcgcgaacgttctcgttatttaggaattgctgggcttgttcctgctgtggctctgattgctggaccatttcttgggggatttatcacggatatctttagttggcactggattttctttatcaacttgcctattggtattctttctttaattctaatcgcaagttatttgaaattagctaatcctaaccatgattcaggagtaaaaattgatatttcaggaagtcttttgattacagttgggactacaacgcttttgctcaccttatcgcttgctggttctacttttgcttgggcttctttgcaaatcatctccttattccttgttgctttattatctcttattgcctttgtttttgttgaaagtcatactaaagaaccaatcacacccatttctttcttcaaatctagtatattttctatctcaagtctgcaatttttcttggcaacagcagcactctttgtgggcatggtttttacgcccatgtatttttccgaaattcgtggctattcagcaacggcggctggttctagtatcattcccatgctgattggtttaatgattgcttccagtctttttggagaagtcattgctcacacgggacattacaaatatttagctgtactcggtagtttattgattggtctagcaagtcttttattaattggactagctgctcatacagcgctctggctgattttgttggctttatttatcatgggctttgggcaaggtgctatgattcaagtagctcttgtggctggacaaaatgcagttccttatcaacaaattggtgcagcaactggcgccctcaattttttcaagagtcttggtgggtcttttgcttcggcaatctttgccattatcctgaccaatagccattcttttgggagaacttttttctggattgttcccttaatgattctttcattgattctcggtctatttatgcccgaaaaaccactttctaaagaaatgattgatgttgctgctggcaaggaagaagttcctgaatattgaagaatttgctttaattatcctaattgaaaatgcaaaaaaactgtcaatattttgacagttttttgtattaattaccagcttttattaatgttggaatttctagcaaatcttgaatttgcacatctggctgggcttctccactaacttccaaatgctttggattataccagatggttttaatgccagccttattaccacctaaaatgtctgttgtcaacgagtcaccaacaatcgcaaaatctttttgattggccgcttcaatgtggtcaaagacgtaatcgaagaaagcaagggaaggcttatgatgacccacttcttcactaataaagatttctctaaaatggtcagagattccagactcaaatattcgtgggcgagaaacacgtgatgttccattactaaccacatacatttctgctccttttgctgacagctctgtcagtaattctttggcatgtttaatcagctcatgaccttgtgataagtaaagttgatattcatcatcaacagcaactggattataatttactgacacatttaaagctctaaaagcatggtcaaatcgagtagatagaagttcttctcgtgaaagtttttctgattcgtgtaaacgccaaagcgctttgttttcacgagagtaagtcgcacgattttcctgattatcttcaatttgatagtgggtaaaaatttttcccaaagcatcatattctgctttatcaaaatcaagtaaggtgttatcaatatcaaaaagtagtacagtcatttcttttcctttgcttaatgtattctttgcattccctacattatatcagaaaaggagataaagatgaatgttctgaaacttgaaaattttttcaatgacaatagacagatgattttacaatagaaattttaatattaaattagagaaaaaaatctaccctaaaggtagactttttattaatgtctaaaatgacgaagtcctgtgaagaccatcgcaattccatatttatcacaggcatcaatcacttcttggtcgcgtacagagccacctggttgaacgattgctttaattcctgccttagcaatttcatcgatattgtcagcaaatgggaaaaaggcatccgaaccaagaaccgcattttcttgaagttctactgatttatcagcggttgcctctaaggcaatttttactgaacccacacggttagtttggcctggaccaacaccaagcgtctggtggtcattggtcacaataatcccatttgatttgacaaacttaactgctttccaagcaaacttcatggcctccatttgtctgtcagttggttgaactttagtcgccactgtccattcttttggattttcaacaatgacatcttgattttgaacaagtagtcctccaagaacccctgttacaagcgcttctttttctgaggcttcttttttagaaaaatcaacggttaaaagtcgaatatttttctttttacttaaaacttccaaggcttctttgctataagagggtgcgataataatttcaaggaaaatcttactcattttttgcgcagttgccaaagttacttctcgatttaaaacgataattccaccgaaaattgaaactgggtctgcttcataggcataatcccaagctttttcgatatccgttgctgttccaatcccacatggattcatatgtttgagggctacaactgtgggttcttcaaaatctcttgcaatttgtaaagcagcatctgcatcacgaacattgttatagcttagttctttaccatgaatttgcttactttgggcaattgaataagtcgtaggtattcctgactcataaaaatctgcattttgttgcggattttcaccataacgcattccttgtttaaggtcataagtcaaggttaatttttctggttttacattttctaccggaaattcttctgtcaaatattgtgcaattaaagcatcataacttgcagtgtggcgaaatacttttgctgcaagttgctgacgaaaacttaaacttgtttcaccttttactgacagctctgtcagtactttttcataatcatttgggtcacaaacgactgtgactgacgcatgatttttagctgctgaacgcaacattgaagggccaccaatatcaatcttctcaatcatttctgcttgacttcccccagcaagcaaagtttctttgaagggatataagttcacaacaaccaaatcaattggagaaatatgatgttctgtcattgatttcatgtgactttccaagtctctacgtccaagaagggctccatgaattagtggatgcaatgttttaaggcgtccatccatcatttctggaaatcctgttacttcatcgattgcaatattcggaatttcttcttggtccaaaacgactttcgttccacccgttgagataatttcccaacctaattctcgaatttccttagcaaattctacaataccttctttgtctgaaacactgataagtgcacgttttgacatgatttcctccaagttttctgctgacaattctgtcagtaatatttttcttataaaagaactgacagaactgtcagtaaatatttatcatgtctttattttacatttatcgtttggaaataaaaagcaccagttttaaaactgggctttttttattataattgttcggaaattacttttagtctttgattaaaaactcttcattgaaaattccaatatatggcaactgacggtaacgttcggcataatcaattccatagcccacaataaaggcatccggtacttcaaagccaacataatcagcgtcaatatcaactttacgaccacttggtttatctaataaagagataatttttactgaatgtgcttgacgtcctgtcagcaattttttaagatagagcaaagtatttccagtgtcaatgatatcttcaacaatcaaaatatcacgtccatgagccacggttgataaatctttcaaaattctaacttctccagaagatgaaatcccataaccataactggtaacatccataaaatcaacttcagcatcaattgataattctttaagcaaatcaaccgtaaacatgattgacccttttaatattccaacaacaagtggattttttccttcataatcgcgtgaaacaacttccgcaagctctttgacacgttcggcaatttgttctctggtaaataaaacttcttttaaatgtggatgcatttttctctccaatttttttcacaatatgtttctattttagacttttttagagagaagaaaaagaccagaagtctgactttggtcttttttagcttacaacgttcggaaatagaaaattttcaaaaccataattttcttaatcaactttaataactcccaaatccaacatcgtttgtgccgtttgaataatcgctgcttcacctgaacgtggtttccagcctaaaagtttaactgatttttcatttgaacaagctatgttttgccccaaaaatgtagctggcatcgccaaacttttatcaaatcgagctaaaattttaactaaaaagtcgggaattacctgagtagatacttttttagcttttgtaccaaattcctttttcaaaaactcggcttgctttttgtaagtaatattttggcctgaagttgcaatgaaacgctgaccaatcgcttcatctttttcaagagctagcaaatgtaaatcagcaacatcacgaacgtcaacataatcaaatgctaaatttaaaagtctggacattttaccttcaaacatattttttatagccgcactagaatgtgaaaaatcatttccaagaattggacccataacagctgtaggtaaaaccgatgctccttcaataccataagcttctgcaagtttccaaaactccatttccgccatcgttttagaacgttgatatgcattaattggagcatcaagatttgtccaatctttctctgtgaagatttctggatgatccttatgccccgctaaaactgctcccgatgctgaggtcaaaaccactcgtttaactcctgcttccttggccgctttcatcacaaacttaactccatctatagccattttcaccattaaatcatcagcgtcaagacgttgcaaaggtgttggtgaagccacatgaatcacagaatcaacaccagtcatggcttgactccatccttcttcttttgtcaaatcagtgtggacaaaatctaaatctgtaaaatctgaaattccgccttgtgccatcatttttttcacttcttcttgtcgagacatcgtccgcaatgtcgcccgtactcgatagccttttttcaataaagcaatcatgataaacatagcaatatatccagaaccacctgttacaagaattgtttttttatttgtatttgtcatttaattttttcctctatttttcttaattcacatctgttacacttgaaacttatgtaaaattattgtacgatagaagtgtaaaaaatacaagcctttgaaaagcttgtgtgacacaatcaggagaagtgtaatggcagcgacaaactattcccaaactatcaaaaacgatacaaaagattttattactacagcaattttgcaactattaggaattcaaaaaacatccgaaaaaccgaaaactcttgctcaactcaccgtttcaaacgtttgtaaaagagccggagttagcagaatggctttttatcgtaactttgagtccattgaccaggtcatttatcaatactatcagcctcaaatttctcaaagttttgaaatcattcgtcagaatgtttctgccagttcaaaaattgaaaaccaattaaaattctttgaagaattcaaaaatgacctcttcctttctgaaagtcaaggttacgaaccaattattcgtcagatttatattgaagaaattgagaaattttatgaaaaaacaaatgacgaatatttcattacttttgtcgcaaatggagtttatgctctttggcgtaaatggttaatgaacggtcaagataagtcaattgaagaaatacatgaactcattagaaaaattgttacaatttaagtaaaaataaaaagacacttgcacgtgtctttttaatataaatttattttttaagcaatttcctgtcctaaatgaatcacctcatccaaataactttgagtttcatcatatagatggtgtgtaatcataatcaccgtcaaatcaggattttctaaaatatttttttctacagctagagctgtttttttgtcaacactcgccgtactttcatccatcactaaaattggcttactgcccattaattctctagcaacagataatctttcttgctgacctcctgataaatttttatcataaaccgtatcaagtttattaaatacaaagtcatcagcacaagcaattctaatcgacttatcaaagatatctggcgaaattttacgccctaaagtcaaattttcttctactgtttccttaaaaagatagggaaattgcataatcacactcatcacacgaggcaaagattttcgattaattcctttataatctttcccgtctaataaaatttctccttcatagtcttgcttattcccaaccagcaaattaatcaaggttgattttccacttccactatcgccaataatcgcgtattttttccctttttcaatgacaatttctggatactcaattttttgcccatcaggaaatgcaacagccagattttttaattctaacttactttcaaaagctgtcacttcttctccgtcagtaacttttgattcgtcagtaatttttccatatttctctaacagctttcccgttgcattgagcaatattaaactattcgctacactttttgagtaattagttactgttcctgacaaatttccaacactcatgacaacaccaatgccaatttgcccattcatgataagaaaaccagccacagctaaaatcaaaaactgccctaacatacttgtccctaataaagaatactgcatccaagcacgggtaaaaattaatttcacattcgccgtagctaattgattaaatttccccatggttcgctcttgcataagtcccaattgtttattatgatagagcacttcataaccacgcaagtaatccgtagatgtcgctaaggcatcattagcaagctccgacacttgttccgtatctcgttccactgattttttaaacatttttggaaaatagaacaaaagcgctccaaccaaaagagttgtcaaaagcaatacccagtggaaaaagataatagcaatgcctgagaatagcatcgcaacaattcccgtataaacaaaataaatctggtggaaaccattatcataaagtagttttgtatcattatttaaccacgaattataatcttccttactatttttctcaaaatcagaataagaaatttccgtcagaggctcaatgatatctcggcgtacagcattaagctgtttttgtatggcaatttctttccaaacatcacgcgctccttgaacaaaactatcgactacccaaaggataatatcaatagctaaccataagaaaaattgattcatctcttttgcaatcaaagaattgagcacatttactaaaaagaccgaactcaagaccgcaagagcaatatcaatcgtgataagtaagaaaaccataaaattttcaaatttgaattctttaagatactttaccatttttccttctcttattttacttaagattatgttaccactacattttagcatttaaatttcaaaagtaaatagcgcttacaaaagtattttagatgttttattttcttaaaagaactgaaaattttctcttatttttattaagctaaaacgtaagaaaaaaaacttcatcattgctgatgaagtataatttggcgaacgacttctggatagagcttgtgctctgcttcatggacagaacgctcatagacttctaaatcttcgtgataagcgagcgggatttgagcaatcaattccccagtatcaacaccctcatcaacataatgaatactgattcccaaccccttttttgcctcatgtgattcttcaatcgcatgaggtgaaccagcgaaatcgggaagataagaagggtgaacattgattatctttcccttatattttgataacatcgtcgcaccaataattttcatgtagcccgccaagagaattaaatcaatttcttgatcttttaaaatttccaccaaggccttttcataatccacttttgaagaaaattcttttaactccaaactcgcctttgccacccctaatcgctcagcacgttcaagtacataagcatcatgatggtctgaaaaaacaaatttcacttggtctggaaattgttcagctagtatttgaaagtttgagccatttcctgatgcaaatactgcaattttcatgctatcccctattctcaatgaaaaaaatttattttttaatcactactgctgaatcttgtcttttgaccattttaccaatttcaaatgcattcaactcttttttgagagtttcggcattttcaggagcaacagctattaccattccaattcccatattaaaaatttcatacatttcttcatgtttgatatccccatatttttcaagagctttgaaaattggtaaaatattccaggaaccttcaacaatttcagctgacaagctatttccgaacattcttggtaaattctcatggaatcctccgcctgtaatatgagcaatcccttttattttattttgtttaatcaaaggtaaaagctctttgacatagatttttgtcggagttaaaagagtatcaatcaaagattggtcaagttcaggcaacgattcattcaaatcaaagtcagaaaaaactttccgaaccaaagagtatccgttagaatgaatcccagatgaggcaagaccaagcaaaacatcgcccgcttccacatctttttcgccatcaattaattgtgatttttcagccacacccacagcaaaaccagctaaatcgtaatcatcttcatcatacattccgggcatttcagctgtttctccaccaatcaacgctgctcctgcttgcaagcaaccttcggccactccagccacaacttgctccaatttttcaggaatatttttccctgtggcaatataatccaaaaaataaagtggttcagccccagcagcaataatatcattgacgcacatggctacgcaatcaatcccaatcgtgtcatgtttgtctgcttgaatggctaacatcaatttagttcccacaccatctgtccctgaaatcaatacaggctcttttacatcaagcacggataaatcaaaacttccaccaaaaccacccagtgccccaagcacacccaaacgttcggttttagctacatgcttcttaatacgagaaaccacctcatatcctgcttctacatctaccccagattttgcatacgcattctcagacactgtcattctccattttctgatttattttattctacttccatgttaaatgattttcaaacataaaaaaagttccagcgggtagtactgaaacttttcgattgaatcgttcggaaataacaaatcatttcaactgtaattgtctatcaaatataaaaaaccgccagcatcagctaacggtttttttctatttattcagcaatcgtttgaatatcaaagtcaatcttgttatctacaagtgttacaataacttttgattttggtggaatttttcctccgataatcagcttagctaatggattttcgatgacttttgtcaaataacgtttgagtggacgtgcaccataagctggttcataagcattttcggcaatccaaacttttacttcttcactcaactcaagttgaacatccatttcttcaagacgatgtgaaagttggctagtcattttaacgataatattcttaatatcctcaagtgccaatggtttgaaaagaatggtatcatcaattcgatttagaaattctggtttgaaatgtgcccgaagttgagacatcacgttttcagttgtttcttccgaaatttcaccattttctccaacattatcaagcaaatattgagaaccgacatttgaagtcataatcaacactgtgtttttaaagtcaacgagaacacctttagagtcagtcaaacggccgtcatccaaaacttgcaacaagatattgaagacatctggatgtgctttttcgatttcatcaagcaagatgattgtataaggattacgacgaacggcttcagtcaattggcctccttcatcgtaaccgacatatcctggaggtgctccaactaaacgagagacagagtgtttttccatatattcactcatgtcaatccgaaccatatgctcttctgaatcaaagagattttcagccaaagctttcgcaagctccgtcttacctaccccagttggtccaaggaagaggaaggaaccaagtggacggttagggtcttgaattcctgcacgcgcacggataatggcatcagatacggcttcaacagcttcatcttgtccaacgaccctttgatgcagtgtttctggcaagtgaagtaatttttcacgttccccttcaaccaacttggtaattggaatgcctgtcatgcgtccaaccacttcggcgatttgttcttcagtgactgattcttgaactaaggataaatcatctgattttgctttttcttcgatagctttgagttctttttcaatttcaggaattttaccataacgaagggctgctgctttttctaagtttccttcattttgagcttcttccaattcgtggcgagcatgttctaattcatttcgtttttcagaaatattgcccacttcttttttctcagcttcccattgggctttgagttgattattttcttctcgaagttcagcaatttcaccacgtataatttcaagacgtttcttagaagcatcatctcgttcttttttgagggccgcttcttcaatttctaattgcatcaagcgacgattagcttggtcaagttcagttgggagtgaattcatttctacacgaattgttgcactggcttcatcaaccaagtcaatggctttatctggtaaaaatcggtcagtaatataacgatttgaaagggttgctgctgcgactaaagcattatcatgaatggtcactccatggtgaatttcaaaacgttcttttagaccacgcaagattgaaattgtatcttcaacagtaggttcagtaaccaataccttttggaaacgacgttcaagtgctttatctgtttccatgtatttacgatattcatccaaggtagttgccccaatcaaatggagttcaccacgtgcaagcattggttttaaaaggttcccagcgtccatagagccttcggtcttacctgcaccaacaatcgtatgaagttcatcaataaagaggataatttgtccatctgattttttcacttcattaaggactgctttcaaacgttcttcaaattcaccacgatatttcgctcctgcaatcagggcacccatatcaagtgaaaagattgttttatctttcagattttcaggaacgtcttttctgacaatcctttgtgccaatccttcaacaatggctgttttaccaaccccaggttcaccaataagaacggggttattttttgttttacgagaaagcactcgaatgacatcacgaatttcttcatcacgtccaatgacaggatcttgtttacctgatttaacttgagcaacgagatctaccccatatttttcaagtgctttgtatgtttcttctgcattttgactggtcactttatcacctccgcgtaatttttcaatcgcagcttgcgcttttgcttttgttagtccatggctaaccaaataactggtcaatggattttgttttaattcaaagagggcaaggagaataatctcagttgatagatattcatcgcccattttttgcgcaattttgtctgcttcagtaaatacttggaacaaatctggacttaggttttgaccataagtaatatttgaaccttctactgaattaattttatcaatttctttttcaattaaatttgtaaagtcatctaggtcaatccctaaatctttataaaagttcgccccaaaactattaggttgaacaaaaattcgccataaatgtggaacttcaatcacttggtgatgacgaacttgcgcaatttgttgcgctgaaccaagtgcttcttgcatcgttgttgtcattttttcgatgtccataaaaacacctcatttcgatttcatagttagtagtgattattatctttttctcactacattccaattataatactttggtcagtaatggtcaaactttttgattcgttatttataaaaaattatttacactttttaaatgaattatttatgtactaatcatagtgaagctgtctttttaatacactttgccttataatggatttagatgtcaaaatagaaaagataggagaaaaatgactcaacatctaaattctttgggaaagtctgccctcttaatattaagtaatacaattattgtccttccattcatgatttttattcaaattgcaaaaggaacctcgcttcttgccctccttccttttttgctcttttatactttcagaatgactggcgtattctttataaggggaataaaaacaagaattaacagctatagtcttttaaaaatttcattgtatgccggtttacttggttccttgttaggatttatgggttctttctactttcctttctatactttatccggtatccttttaggagtcagtgcagcttggttaccgatgtcaaacacttcggtaaattattatctaaaaaatactaaccagcttatcaaaggaaaaaccttagttagcttacttttgtttttagcccttggcttttcttttgtcttatccccttctctaaaatatcccctattctttgtcttctatggaatagtttatcttctctccttccaattagttggaaatttggataattacaaagttgatccaaatgatttagaaaaagcttcatataaatatcttattttatttgctttattttttgtttgcctctttctattacgttcaagtcgattacttgccaatagtttagaatttgattatttcattttcggatttttctttttggtcatcctatatattgtcgctacgaattttttcaaaaataaaattcaaagaaatatccctcgtaaattatcatatttgacagctattaatggggcagtgggaaattatttatttcttttttgttctttgtatgtcgctggtttttatggtcatcagcatttatttttacagttttatcttccttatgttttaggaattgtctttgcctctaaggtcaaaaatttacttggaaataatgtcaaaacctactctttaatcggcatttttctaggtttacttttgattgtttttagtcctctatttgctctaggtttattccttactagcttatttaaaggaagtttaaattcaagcttaactcaagactatgaaagtactgttaatatcgttgaagataaacgtatctgggtaaaatataccattcaaaatatcggaagtattcttcaccaatttttgttgatgcttttaggttcactcatcatcatgaaaaacggcttatctatcaagaccctgttcgttattacttcaacccctattcctacagctcgaagtattgaactaatgaaatcatggaatcttattgctacatcattgattatcttaattatcatcacctatcttatttatccaaaaatagttccacttcttaaaaaatcaaagtaaattagaaaaactcatgtctaaacatgagtcttttatttaatacgagtggtcagtgaactttcttttccttcgataattttatgaatctctttagcaaattggcttcgtttaattggacgataactttttaagaaagaaaaaatcggaatttttatgagtggctccaataggcgtgctggaaagtaactgctttttcgtgaagcatcatagacaattcctggaaaaacagaaacaaatcttgatttcaaacgtttttgaccataagcctccacttcttttttagctctcatatagtcattcataaaaaaaggaccatcatttgccgaaataaaaagacattgattttctgagttaactattgtatcaataattatttttgctggttgaatactatttttttcataagttgttccctttgatttacttggaaatagaattcctaccgcatcaatcacccaatctgatttttgtaaaagatcttgccaatccccaggttcgattagattagcagcatggtaaatgactggctcagcgagatgagctttagatttaccatttcttgataaactgtgtaattcataatctgcaacttggacaagttccttgaaaataccttgaccaactagtccagttcctccaactattgtaataatcatttgctcacctcacttgcttttatttcttatcctaacatattaaaaggagtaatctaaaataatcgctttagaatttagcaaaaaaaactagagtgagtactctagtttttttatttcacgctatttttcgctaaagattccaaatagtcagcttcataatcatacagcggcgttggatattcgccatcaaagtaggacaagcaaagcttatcatgaccgattgcttcaacaagtcctgactggctgagataggtcagactatccgctccgatcgcttctctgatttcatctgtcgtgtgtgtggctgcgatgagttcgtcacggtcttgaatgtcgatgccataaaaacatggatatttgagagcgggactggcgattgccacatgaacctcggctgcgcctgcgtctttgagcagtttgacaatgcgacggctggttgtcccacgcacaatactatcatcaaccataatgacgcgtttgccttctacaacgcctcgaacagcacttaatttcatgcgaacgccttgttcacgaagttcttgagtcggttgaatgaaagttcttgccacatactgatttttaatcaggcccatttcgtaaggcaagccagattcttcagcgtagcctgaagcagcactgagtgatgaattaggcacaccgatgacaatatcagcatcaatttgggcttcttgggctaaaatttttcctgaacgttttctggcagtatgaacattaactccagcaatattactgtcaggacgggcaaaatagatgtattccattgaacaaatggtcatgttggtgctgtcagtaaattggtccacatgaatgccgtcatcattaatttcaatgatttcaccgggttgaacatcttgaatccaagtggcgccaacgacatcaaaagcacaggtttctgaggccacaacaagtgcaccgttgctcatttttccgattgagagtggtcgaaatccattagggtcaagggctgcgacaattgagttttcagtcataatgagataggcaaagccacctttgaccgtattgagcgcttctttgactctgcccataaattctggatgatgactacggcgaatcaagtgcatgaggatttctgtgtctgaattactggagaagattgcccctgatttttcaagttcacagcgcaatgattgggcgttggttaaatttccattgtgggcaagcccaagtgctccatcatgaaattcaaactggaaaggctgaatattattgatatttgctgaaccagccgtggcataacggacgtgaccgatggctgctgagcctgtcagctcttctaaatctttttcgtcacggaaaacttctgtgaccagacccagaccacgatgacgattgagttttccattattattgaccaaaatccctgcaccttcttgcccgcgatgttggagagcatgaagtccaaaataggtcaggcgagcggcatcaggatgtccccaaacaccgaaaagtccacattcttcatttaatgtcttcgattcaaaatgcgaccactcttgctcagtaaatgttgcgcttgtcatttcatcagacatgggagtgctccttcataaatgctgacagcttcgtcagtagaaatagaaagttcattcatttccaaaattccgctgtcagtaacttttccgattacttcgccgctgaccgaactttctgtcagtaatttttcaaaagcagcttgattttctggtgaaattgagaggacaaagcggccttgcgtttctgagaagagttgggcattggtcaaattaacttttacatcaacgcctaaacaatttgcaaaagcagattcagctagagcaatcgccaatccgccttctgccaagtcatgtgctgagctgaccaatccgtcagtaattgcttttaaaacaaagtcttgattggatttttcagtttctaaatcaaaatcaatggtgccagaaatttcgccggtcagcattttttgaagttcagaacctgaaaaatcatcaaaggtttgaccgactagcacaatcaaatcccctgcttttttaaattcttgagtcgtaatatttttcacatcctcaatcaagcccaccatgccaatcatcggcgttggcaaaatcgctgaaccgtttgtttcgttgtaaagactgacatttcctgaaatgacaggtgtatcaagggccaaacatgaacgtgaaattccgtcagcggctgttgttaattcccaaaattgttctggtttttccggatttccaaagttcaaacagtccgtaatcgcaagcggttttccaccagaggccacgatattacgagccgcttcagcaacggcgattgcccctcctttttctggatcaagatagagatagcgcgcgttacagtccgttgtcatcgcaagtgctttgttggtgccacgcacgcgtaaaactgcgctatctgagcctggtgcaacaacagtgttggtcatcacgcgcgaatcataagtttcataaattgatttcttgctggcaattgtcggttgagctaaaatttttttgaaaatttcactgaccgcgctgtcagtaatttctgggagatatttctcgctgtcagcaaatttttgaatgcgctcagggacttttgcctcacggtaataagttggagcatcttccgccaatgaatcaactggaacatgagcaaccatttgccctttatgataaagcgtataaaagccatcatcagtcacttgcccaatattcacagcatcaaggtcgtattttttaaataaatcaataatttcttgttcatgtccttttttgacacataaaaccatacgttcttgtgactcagacaacatcatttcataaggaatcatttctgtttcacgctgaggcacattatccaagttaagacgcagacctgatcccgcttttgaagccatttctgatgtagatgaaaccaatccagctgctcccatatcttgaatgccgactaaaatatcgccatgattttggatgacttcaatacaagcttcaagcaataatttttccataaatggatcaccgacttgaaccgctgaacgttgtgtttctgaaccagaaccaaattctttagaagcaaaagacgccccatgaatgccgtcacgtcctgttttcgctccgacataaaaaatagaattccccacacctttagcttgtcctttttgaatatgtttatgttcaatcaagcccacacacatgacattcaccaaaggatttccagcgtatgattcatcaaaggctacttcgccaccaaccgtcggaattccaatacagttgccatatcctgcaatcccggctgtcacttggtccacaatatgacgtgttttaccattgtcaattggcccaaaacgtaaactatccaaaattgcaattggacgagctcccattgaaaaaatatcacgaataataccaccagaaccagttgctgcaccttcataaggttcaacgtaagatggatgattatgagattcagccttgaaaacaaccgccaaatcatcaccaatatccacaaccccagctccttcaccaggccccatcaagacttgtggcccagtcgtcggaaatttttttaagacaggttttgaatttttgtagcagcaatgttctgaccacatcacggcatacattccagtttccgtaaagtttggcaaacggccatcaagaatctcatccttgattttcaaatattcttcatccgtcagtccccactcacggtaaattttgctttcttgaatctgttctggtgacatctccaaagtcatgttattctcctataagatatgagaaacgcttgcttaaaaacgtagaaaactacagcccaatttactgcattagtagtctaaagaatatacgttccaatagaaatgcaacttgtatattctctactttaaaagctttcagcgctctgaattcaattatttcaaattacaaatttactgacagattcgttttttaaaatctaaattctgtcagtaatttttttattttccaacaaagtttttcaagacagaagcaaacaaatgtactccatcagcgccaccaagcagttcttccatggcccgctcagggtgaggcatcatcccaagcacatttccttctttattgacaattccagcaatattttcaactgacccattaggattttcgtcagcataagtgaaaataatttgcccatttgctttaagttcagcaagctgagcttcgtcagcaacatattgcccctcaccgtgagcaattggtaaattaatcaaagcgtccttggcatattcagtcgtaaaattactttgattattttcaactttaagagcttgccatttggaaacaaatttcaaaccctcattgcgaatcaatacacccggtaaaagcccagattcaaccaaaatttgaaatccattgcaagtgccaaaaacaggtttcccttctttagccaaacgtttgatttccggcataatattggcaaatgacgcaatcgcaccacagcgtaaataatcaccataagaaaagccccctggaatcaacactccgtcaaaacctgcaagcgacttctcatcatgccagacaaattctgcctcagctcccataacatcacgaattgcccaaagtaaatcaaaatcacaatttgaccctggaaattgaatgactgcaaatttcattaattagctccttcgctttgttcattcaaaatttcaattttataagtttccatatttggatttgccaacaattcattggcaatttcaattgcttttgcgcgagcaatctcagcttctgcatcaaattcaaaatcgaaaaattttccaacatttaattctgtaacttcttgataacccattttatgagttgccgctttaatcgcttgggcttgagggtcgagaattgaggctttgtaagccacgtaaacacgtactttagtcattttaaaattctttctatataagatgtgaggaactgtcctaaaaactagaactcatttatttcgcattttctaacaaattcaaaacttcagtataagtttcaactaaatcgccaatattacgtctgaaaacatctttatccatatgctgaccattcgcatcccagagacgtgaagtatcaggtgaaatttcatcagcaagaataattcttccgtcagcaagacggccaaattcaagtttgaaatcaaccaaagttaagccgatttcagcccagatttttttcagaatctcgttgattttacgcgtttcactctttaaaaattcaatctctgaataagttgcaatgttcaggaatctaacatgttcatcattaataaatgggtcatctaaagcatcatccttatagtaaaactcaacaattggttcttgtaaaacaattccttcttcaagaccaaatcgtttggcaaaagaaccagcaacaacatttcttaaaacaacttctaaaggaattattgaaacttttctattcaattgttcggtttttgatatcttttctatgaaatgcgtttctaaaccttcagcatttaatttttcaaaaattaatgaagtaatttgattatttagagcaccttttcccgtaatctgttctttacgagcaccatttaatgcagtcgcttgatcacaatattccacccagagcacctctgaatcatcagtaaaatacagtttcttagcttttccttcatagagcaacttttctttttccacaatatcctccatccatttaaggaattctttatgcttcttattctattctaatgagccaaataaaaaaagctctagcggataaaactagaactttttcaatttattgttcggttttgctgaatgttcggaaatactcttttattttataagttttcatattgttcatcagaaacttcttctaaccaaactgcttctcccgcggtaatggccacatgactgaaccagctatcttttgtcgctccataccaatgtttaactcctgcatgagtaacaatcgtatcacccgcatgtaaaagttgggcctccttcccctcttcttgataccatccctcaccggctgtaaccaataaaacttgataaccctctttatgaatatgccaatgattacgacagcccggctcaaaagtcacatttccaacaccaaagggcaagtccttatctgcaatcattccttctaaataagattgaccagtaaaataagcaccataaggatttttttctccctgaggaaaaataagtgcattgtctaattcttttttatccatttcgttctctcttttctaatcaatctgctgataacgagttacctttaggcgcagttgatatttttctctcaattcagcaatttttgccatcatcggacttttatgatgaagatcaattgcttcttggttttcccattcatcaatcaatagaattgcgtgttgattatccaaagggacaaaatattcataacgtaaatttccgctttgttgacgtattttatcgacgagtccagaactgaccatttcgccagcaaaaagacgggcattctcacccttaccttggtacaaaatgttgaccgtaattgtcatagctttcccctcttatccccaaatttttttagccatattaaaagccgaccaagcctttggccaccccacataaaagctcagatgcgtaattatttctgaaatttcttcctgacttattccattttcttttccttttgccatatgaaaatttaattgttcaaaatttccacctgcaatcaaagcagtaatcgtaatgacactacgctcatgtgctgaaagttctttttcacgactccagacttctccaaaaagaatctcatcatttaattcagcaaattttggggcaaattctccaagttgttcatgtcctgcggtttgtttttccattttaacctccaaatttttaattattttatcttgtactttttccaagttccttcaaaaatgttaggcgcatcactgttggtctaaaatttttctcccaagcaggatcccagctctgacccgcacgttgtcgataagaagcaataaatttatcaatattttctttatccgtcacaggttcaaattccacttgatagactttcccgtcaatgtgaatttgccccttacgtgaaatcattgccgaattccaccaacttgacgccgtcccacgacctgctgctaccgctaaatcatcatcaatataagcaaaccaaatccaagcaggacgatgttcttgagggtctgggctaatataaatatcttgtagcttagaaaacttttttacatcaatttccattttttctccttttttaccaagattgtgttgtaggtccaacagtaaactcgctgacgttaacgtcttcaggttgttcaagagcaaaagcaacaatgcgagcaattgcctctggactaatcccatattgttcataaagagctgtcattccttctgctgctgctttgtcagtgattgtattcaataactcagtatttatagcagccggataaatagtcgctgtccgaatatgagttccttcttgagcggattccattcggagtacctccattaattcacgaaccgcccattttgttgccccataaacaccaccattgggatatgcttttaggccagcaactgaactcgttgtgatcacatgtcctgatttttgagctgtaaattcaggcagtacagcagcgagcccattaagtacaccttttaaattaatatcaaccatattttcccattcttcaacatgaagagctgataaaggggaacttggcataattcctgcattcaagaaaatagcatcaatttttccaaaattttctttcgcatattgtaccaactttttattatcttctggattagttacatctgtcacttgatagattgcttggccaccagcctttttaattttatcagccagctcctgcaaacgattttcacgtcttgctgctagtacaattttggctccttttttagcaagtaattcagcagttgcttggccaataccgcttgaggctcctgtgattatgacgactttgttttcaatattatttgacattttttctccattcatttttaacttctattttcattatattccttgaagttcacttcaagtcaactcaaaagcttcacatcgctttatctttttgatgattttattataaaatattttttagctgccgtgaaatgctttttatatcaataattatgctttttaagcatactatattaaactataaaaaaagcttcgtatcattacgaaactttttttaatcagatttattttatcttcttgttcaaaatcaaagtatagaagacaaaattaagcaaagcaagacaaaggaaaaacataaatacatgttgagttcctgttgttaaattacttgattttgttgcaataagactagctgtagccgttcctgctgacgctgcaaattgagaagttgtagtaaaccaagcattaccagaggcagctttatcatgaggaagttgagctaaactattggtcatggttgttgcaaaacttgaagaacgaccgattgtgaatacaacataaagtcccatcacacccagtaaagtcagattcttagtaaaaatcgttaataaaacaagagcgataaagaatacagtatttccactatataaaattcccttggcccctttgcggtcatagagcgcaccaattggaccttgagctgctgaaccaattaatgaaccaggcaataaagcaaaacctgctaatgtacttgtagctcctaacgaaacttgtaagaagttaggaatgataaagttaattcccaaattgacaaattgtaaaatacaataaactaggacagacaaagtaaaagttgggctcttaaaaacattgatatcaataaaattcaacgtacttgtttttgaacgccaaataaaagcaatcaaccccaagataaagaccactaaccaaatccatgaaaaatgagcactcgaaagtgaatctaaagctaaaagagcgctggtcattactaatgacaaaaatataaaagcaataaaatcaaatttgcctggacgtattttttcacttttctcaatagcccaagctcctaaaggaaagagacagattgggataatcaaaataattgcaaaaatcattcgccaacctaaagttcctgttaaaagtccaccataagttggtccaagcgctggggcaatactcaaaatcatcccagcaaatcccatccaaagtcctactctctcacgcggaattttagttaagacaagattaaacatcaatggaatggcaataccagtcccgattccttgaattaagcgtcccgccattaaaatagtaaaattcggagaaattaaactcagtaaatccccaagggtaaaaaagattaatcctgaaaaaaataaagtcctattttgaaaacgttgactaatatatgaacttgttggcattacaatcgcaacaactaataaataagcagttgttacccactgaaccgtactcagtggaagtccgaaggtcttttcaagcgttggaaacgtgacattcaaacttgtttccgctaatatccccataaaagccacaagggccacggcgacaattgaaaagcgcgttttcgcgctaattttatgattggctgtatttgtttctaattctgtgttcattcttttcctttctgcatgctaaaattattaagaaatttttcaactgcagcaatctcctctgccgacaaacccgctaaagctttttgattatgtccttggatatatgttctaatttcgggtaaatattgtttgccttcttcagtcaattcaaccgatttctgacgagcatctgttggactcgcttttctcttaatcaactgccgtttttccatacgttgcaaaatttccgttgttgtagaacgtcggatattaaattctaattcaatcatcgtctgactgatttctttttctgagtcttcttcactctggtttccaagaaaatctaatattgacatttgctgacccgtcaaatcaagctgagctgcaaaattatcaaactctcgtgacatttgattactggcaacttttaaaagtcgtccaattgcttcttttttagttcgcatacgaaccattataacacaatcttttttgttcgtcaacgaacaatatttaaattttatcaataaaaagttactgacagagttctgtcagtaactttttagttaatctaaattgccaaatcaaattttaattgaggttttaccggttcatagtccacaagctcaaaatcttctggtttaatatcgaaaaagtttgttccgtcaggaacattaagcaccaaacggggctccttgtcagaagctgttcgcttaactaactcatttgcttgttcaaactgattatcataaatatgcaaattatttacgaaatagaaaaattttccaactttccaagaaaaatgttttgcaatcatcatttgtaaagcgacatattgcatggcattaatatgatgcgcaacaagcatatcatttgaacgttgaataagagtcgcatccaagtaaatctgaccatcttgttcacggcgaacatcaaacattgtttggaaagcacaaggcaaaagtccttcagtttcctcaaaatcttcatattgccaaagattaatgatattacggcgattccaaggatttttagctaaaccatccaataattttccgataatattatattttttaactgttgccccatagcgttgtccaatcgtaccgtcgccaattccccattcgccccagtatttgactccatatttttcttcaagaacagcaagttcacttgtctgatcttgataaatccacatcaattctttaattgccgatttaattggaattggacgcaaagtggtaattggaaactcacctttttgcaaatcataagtaacgaaagaacctgttacatacttactatttgcggtttgaccatccttatacttgggacgtgcattttctgaaaaaacaccattatcaaggatattttggatattttgtttaaaaatcttgtctgcgtaagtcatgaatcttcctatctttttattcctttcattataacacagtctgctattttgattcaatagcatttatcaaatatttacttgtaaaaaataagatactaatttgtattctttcttctattatcaagaatatcaggatagagttttcgcaattttctcgctgacaatagtgcaaaaatagcagctaaaacttgtaagataagcgacaccaatcccaataagacccctaccgctaactccaaaagattatgcgcctgatttgctaaaataatcaaaacaacaccaataacactcaagatattaagaccatatactaaaatcgaagcaatactttttatttttaatttatgattttgggtatgaagagcaatcgcataaattaaaataattaaaccaaaacctaaagttaaatattggtctgtaataatttttgttatttgtagcaaaaaaatgatgaatacagcgataatccagattccaagaaagatattatatttatatgctttttgaatcacttctttttctttattttcgtcaatctcttctttcatttttcaatttcctgttctttttttaattccatgagagctaaagttctaaattttcttgccctcctgatgtaaatccagtagatatacacaagtaaattcacaagaattaaatcagtaatatagattaaccaaattcctacatcacctgagtcgatgtaaagaccggctaacgttatccccacacttccacaaatcacagcaaaactatcagaatgatttcccctgttttactgtcctgcatttgataaagtttttctacctttttactatcttctaatttttcaaagtttctgtaattaaaaaagttttccgaaagatataataaaattctcgctaggacaaaagataagagtacacagacaactgttgtcaaaaccaaccattttacaggagaaatatttatagaatgatgttctacaaaattcattacagaagctggaaatgcaccagatattacgaaaataggaagtatttccatacccgtcatttttgacttactttttatatatagttccttatttttaacatcatacccatatatattttcaatatctcctgcaatagtgattattcgaggaaaatttttatttttcatttcttcccttttctatggtcgtatagccaatcatctataatcaaaaacaactgtccaatatttttaaatttctttttattgatatgtactcagaaataaagaatgtaccaaaaaacgttacaaatccgaaaatccacaaatacttaatatcagaaaaaaggaaaaatctaacccctatatatattgccagaactaaagataaaatagagatgataagaaaaacaaggcgcgttcttaacaaattcttcttcatatttcttttttctccttcatcaacaggaacttttttcattgtacttttttcaaaagattttactgttttatattcaaaatacaaaatatttaaataccaaaaaagaagcatacacaaaactataacgaaaaccaaaagtagattgagcaactttaattctctttcaacaactttctctgtaaaaaatggaatactcagaggaataagagctaacaacattccgtagcttgaagacttagagcttcctccaattgataatggatcaaccctatataattcatcatcttcattcaattgttcctgatttttactttttttataaagttttctatcatctatttcagtatagtaaaagaaattcggtactttcacaattggaaaaataaagttataggtattactattttttctttttctttgatttatcagatactttatcataagctttatcatattgagaatcaatccaacctcctatgagaacgacaccaacagcaattagtgcacctaacggtccgcccacacttccgaatgcggcagcaactcctgcggtagcaagcttactcccaagtgcgctgatgttttagcaacaatttcatccactggtttcctttgtatagccatttctccagcatcaagtacggcaccaataggattctcatggaacattccgtaagtggcagcattaactccttttgtcaatccataatttatcaatccccacttttctgcgccccacaagcctgacccccagtttccatcatttccaccattacctccactgtaataattatcttctgccacaagtcgtgcttcttttgtataataagcaggttgtggtacataagtcggatagtaagttccgttagaattactatatcctcctcctgatgaataaccataaccaccagagtaagagtagcctccaccgtaatagccataagttggtgcataataaacaactggcgcaatgtaattcggcacatactcataaccattggcatagtaagtcgtcgcataaggattgctcgtattataataaacgattggtgggacgtatttatagtaaacatcaagcgtttcatcgtgttttggataaagtcctgagcgcgtagtgcttccttcgataaagtaattgccaaattgataaggaactttcaccgaataagcgtgtccataaagtcccgtggtggattcttgaccgagataaaccccgtctgtcccgtaataatcatacgtaactgtactttggatatgataataatcaccaactcttatcgtgtttcctttggtcttttggttttgccaaccgtattgataatgtggaaaagtgcttacaggtcagttttcagaaaaggcacaaacagttacttatgtatacacaaaaaatgagttacctattgctacaggaaaagttgttgtaaaatatatagatacagatggaaaattaattttaaaagatgttgttagaactggaactgttggggaagattatataactgaagaaaaaaatatttctggttatacttttcaagaaattcgaggtaattcaaaaggtaaatatacggataaaattcagaccataacttatgtttatactaaaaatcatattataaaaccaaaagatgaattagtaaattctggaacaaaaataataaataaaactaatccaaaagttaaaaactccagttctgaaaaatcccaaaaactacctgaaactggtgaaaacaaaaaaaggagtatattgtttttcattagtggactcactcttataactttagggtcaactattatagtatttcgacataaaaaagaataaaaggctatcaaaggcctttttattattaatagtcgaatattgcttactgattatgttatgatagagagatacaattggaggaagaaataaatatatatggttcagctatcagaattagcatcagcacttaatcaaacagaaagtaagggagtattttctaaacatcctaaaggtttcggatttgttcatccagaagacgcaacagataaaacaaatgatatctatatcggtaaaaatgatactaaatttgcgatggatggggataaagttaccgttaaagttacctatcctaaaactgaaaaacgcggtgcaagtggacaaattactaaaataaatgaacgagccgtagttgatacggtcgggacttaccgttctttgtcaaatcgtcaagtcaaagcattaggatacaaaggaagaatagaactctataatgatcgaatttctgatactttatatatcaaacaacctttatcaggggttcaagaagaagatgtagtaagtcttaaaataacccaatatccaaccgataccaagacatttgaaggaaaaattacaggtattattggacataaaggcgaagtaggactagatattttagaagtgctttgtgctatgaaaattccacaagagttctcttctgaaactttagctgaggctgaggcattttcagaaaaattaactgattcagatttgcaagatcgtgaagattatcggaatgaaattacctataccattgatggagatgattctaaggatttggatgatgccatccacgttaaaaaattatcaaatggacattttgaattaggagtccatatcgctgacgtcagttattatgtgactgagggttcttctttagatgaagaagcctactcacgcgcaacatcagtctatgtaactgaccgagttgttccgatgttgcctgttaagttatccaataatttgtgttcacttaatgaagctcaagaacgactgacaatgtcttgtctaatggaaattgatgacaaaggtaagattgtcagttataaaatatcaccatcagtcataaaaacaacttatcgaatgacttataataatgtcaataaaatgattcatcaaggacaagaaggtcatagggaagcccttgaaaacttctttaaaattaccgattcgattaaagtggccgttgaacttcatgaaattcttgaaacaatgcgaaaagacagaggaatgattgaatttgacgagagtgaagcaaaaattattttagatgaaaaaggtcatccaatcgaaattgtaaaacgtgatcgtgatactgcagaacgaatgattgaatcctttatgttgatggcaaatgaaactgttgcccttgattttcaaaagaaaaaactaccttccttatatcgagttcacgataaccctaaagagaaagcttttgctaaattgatggaagctgctgctaatgctggtttttccttgaattcagattctcatcaagccattaatttctttgctgatgagattaaaggaacaagttctgaaaaggcattgacttatcaacttcgacatacgatgtcaacagcggtttactctgaaaaaaatacaaaacattttgggctcgcagcgactaactatacgcatttcacaagcccaattaggcgttatcctgatttaattatccatcgtttattacatttatatccttctgaccattctaaccgtactaaagacgaatggaaagaacgtttacctgaaattgctagccattcttctgatatggaacaccgtgcggtcgtaactgaacgaattattgatgcaatgaaaaaagcagaatatatgtcagagcggattggagaagtttacactggtacaattacaggcctgcaaaaatttggaatctttgttgcattagataatacagttgaaggtttaattcgtgtacctaatttacatactgggactacggaagaacttaaatttgatgaagaagcaagtatttttaaaggaaaaaaatcagaaacagtctatcaaataggacaagaaataaaaattcgtgttattgctgctaataaacgaaaaggaacagttgattttgaacaaattgctcctgaataaagccagtctactattatgtcgaataaataaaggactaataagataaattaaactattgaaatttaaatattttcgagtaaaataccagtatttactggtatttttattatgctaaataacaagatagatattttattaaaataaatgttgacttttaaaaatataagtattataattcagataattaagaattaacaaataagagatgaaagagtagtcttaggtatcagttgagagagccttgttgctgagaaaaggtctgataatgggatgaaccacactcatcgctatcttactcacattattaatgtgagcgttagctgcgttaatgctaagttgttataacttaccgaggtcacttttgtgaaaaagtgataaattaaggtggaaccacgattaaaccgtcctttaagccaagtgcttttaggcgttttttttatattatctttctattctcgaaaggagaaatctatgagttggcaaaataaccttcggtcagtaagtccctatattgcgggtgaacaaccagaacttactgacatgatcaaactaaacactaacgaaaatccctatccgcccactagtgtagctcaattatttaatgaacgttttaagacaaaaaatttgcgtttatacccaagtactgatgcgaaaagtttaagaaaaaaattggccgaatatcatcatttagaagttgaacaggtttttattggtaatggctctgacgaagttttgtcacttagttttctgactttttttaatagtcaaagccctttattaatgcctgacattacttattctttttaccctatttattgcgaactctatcgaattccctttcaaaaagtccctgtagatgatgattttaaagtgtcaataaaagattattgtattgaaaatggcggaattgtgattgcaaatcctaatgctccaacggctttagcactaaatcttaaagatatagaagaaattttgaaaaaaaatcaaagctctattgtcttgattgacgaggcctatattgattttggtggggaaacatgtcttcctttgcttaaaaaatacgataatttagtagtggttcaaactttttctaaatcgcggagtttggcaggaattcgtttaggtgtagcttatggctctgctgaagcaatttctcatttgtatgatgtgaaaaattcatttaattcctatccaattgatagtttggcacaaattattggagaagcaagtttaatggatgaacattattttcaaaaaaacattcagaaaattattaagacaagagaagtttttaaagaaagtctggttaatttaggatttgaagtgactgattcaaaggctaactttgtttttgttcatcatccaaaagtaacagcagaagaactatttaatgcgctttatgaggcaaaaattattgtcaggcattggaatcaaccacggattgatgattggttacggataactattggaactaataaagaaatgaacaaagtgattgaatttttaaaaggctatttaaaaaagaatgaggaaattgacgaatggaaaaaataaattatctgcttcctgaagaatcggcagaaatgaccttgaatcaagttaaaagtctacggcagatagaaggtcgtttaagaaaattatttagcttgaaaaataatcaggaagtcatgcccccaagctttgaatatacgcaactctatacagcacttgaaagtaatgggaaaacttttaatcaagaaaaaatgtttcagtttatcaatcatgagggacaatcaattacactccgttatgattttacacttcctttagttagactttattcgcaaatcaaggattctactagtgctcgttattcatattttggaaaaatatatagaaaagaaaaacggcataaaggtcgttcaacggaaaattatcagattggtattgaactttttggtgaatcagccgataagtcagaattagaaattcttagtctagcccttcaagtaattgaacagttaggtttgaataaaacggtctttgaaataggctcagcaaaattttttcaacgtttatgtcagttagctgatggttcaacagagttacttacagaacttttactcaagaaagatttgagtggccttaatgcttttatcgaaaaaaataatttttctaaggaattaagagaacttttgaaagaaatatttattactaatgagttatcaaggttggaaaatttagtgacaaatacaaaagatgatgtgctcatttcttcctttgatcagctcaaagaattttcagagaaactttcaatgattaaaccgattatcattgatttgggaatggttcctaaaatggattattatactgatttaatgtttaaagcttacagttcagcagctaatcaacctgttttatcaggaggaagatatgaccagctattaagtaattttcaaaaagaggcggttgccattggtttttgttgtcatatggacaccattctaaaggctttggaaagacaagaattggaggaagacaatgattaaaattgccataactaaaggacgaatccaaaaacaagtcaccaatttattggaaaatgcgaactatgatgttgaaccaattctaaatctaggacgtgaattacaaattaaaacgaaagatgatttacaaatcatttttggaaaagctaatgatgtcattacttttttagaacatggaattgttgatattggctttgttggtaaagatacgcttgatgaaaatgattttgacgactactatgaattattggatttaaaaattggacagtgtatttttgcccttgcttcttatcctgacttttcaaataaaaattttcaaagacgtaaacgaattgcttcaaaatatccaagagtgacaaaaaaatattttgctcaaaagcaagaagatattgaaattatcaagttggaaggttctgttgagcttggaccagttgttggtttagccgatgcaattgttgacattgtcgaaacaggaaatactttatctgcaaatggtttagaggtcattgaaaaaatcagtgatatttcaacacggatgattgtcaataaatctagtttcaaatttaaaaaagataaaattatagaaatggtggagaggttagaagatgctcaaacaaattgattatcaaggaaagcttgaagaaattgctgaaaaatttcaaggtcgaaaaacagaagtatcaaaagaagttaataaaactgtccaacagattgtagcagacattcaaaaaagtggagatactgccttatttaactatgctaaaaagttcgacggttatgatgtgaatactaataatttactcgtcacgcgcatggaacgtgaaacaggactagaacaaattgatgaggattattttagaattcttaggcgtaccaaatcacaaattgaagaatttcataaacatcaactaggaaattcatggaatatttttaaggaaaatggtgttatcatgggacaaattgcgcgtcctctggaacgtgttgctctctatgttcccggaggaacggctgcatatccctcaacagtcattatgaatgctgttccagcacttttagcaggcgtcaaagaaattattatgattactccagttaaagctgatggaaaagtaaatcctaatattttagcagctgctgaagtttgtggaatagaaacaatctataaagtgggtggagcacaaggtgttgccgccgttgcatatgggacagaatctattcctaaagttgataagattgtcggacctggaaatatttttgtagctacggctaagaaaatctgttacggagtggtagatattgatatgatagccggtccgtcagaagttctagttattgctgacaaaactgccaatccaaaatatatcgctgctgatttaatggcgcaagcagaacatgataaacttgcgtcagcgattctagtgacgacttctgaaaaacttgttcaacaagtagatgaggaattaaatagacaagttcaaaatttggaacgtcgtgaaatcattgaaagttccatcaggaattacggtggagccattgttgtaaaaaatattgatgaagcctttgatgtttccaatcagctggctccagaacatttagaagttttgactagtgaacctttaacccaacttccaaaaatcaaaaatgttggatcaatttttcttggagaatatacgccagaaccgctaggcgactatatgtcaggaagcaatcatgtcttaccaactggaggaacagccaaattttactctggtttgggtgtctataatttcataaaatattcaacttatagctattatcctaaagaagttttggctgactttaaagaggatgttgagacatttgcaaaatcagaaggattgacggctcatgctaactcaatttctgtgagatttgatgaaatgtaatacttgagacaagattttcaaaatttattggtcaaggcgtgaggagccacatggattttaaaatattgaataagaaaaatagtagggagaaaaacatgacaaaacaagaaaattattacgcagaagttttcgaaaaaccatggggtcggatgttctatgacttactttttccacagctcctaccaaatttgacaaaagattcaaaaattctgagtttcggctctggatttggacggacggaaacatttttggaggaacagggatttgaagtcacgggctatgagcctgatgtagaaaagctcgagatgatgtctgaccaaacttttcgtcagttgacaggaacttttgacgactttgcagaaactgttaaaaatgagcgttacgacgtgattctcattcacaatgttttagaatacgtcctcgaccgaaaagtcgtgttggaattactcttgtcacttttgacagatggcggcacgctttctattgtcaagcacagtaagtacggtagcatgatagaaatggcagcaggacgtgataatccgcaggcagcgcttgatgtttatgaaaatgaagctgtcgcttctcacaaccacggcgatatcctagtttatgacgatgattggctgacagattttgtggcaaattacaaactgaaactccaagaaaaatttggaattcgtcatttttacggtatttcacaaaacgcagaaatcaaagaaacagacaactggtatcaacccatgcttaagttagagcaaaaagtagcgaaagaccaaacgctgtatccagtcgcacgattacatcatttgatatttaaaaaaactaaggagaacctgttatgacacgcatatcacacatcacgcgtaataccaaagaaacacaaatcgaactttccatcaatcttgacggcacaggtcaagcggacattagtacaggtattggttttctcgaccacatgctgacacttctcacctttcacagcgattttgacttaaaaatcataggacatggggatcatgaaacagtagggatggacccgcaccatctcattgaagatgttgcgattgctcttggcaaatgtatcagcgaagcattaggtaataagctcggtattcaacgttatggaagttttaccattccaatggatgaagctttggtgacttgtgatttagatattagtggacgaccttatttggtatttcatgctgatttatcaggaaatcaaaaacttggtggctatgatacagaaatgactgaagaattttttcgtgcccttgcttttaatgctgggattacgttacatctgaacgaaaattatgggcaaaatacgcatcatattattgaaggcatgtttaaatctacagcgagggcgctaaaacaagctgtaagtattgatgaagcgaaagttggagaaataccgagcagtaagggagtgttatgactaatctaaaagaattaagaattaatattgagaaatttcctgaagcacttcacaatacgctaaaagatgcaaaaatatatgatagcagttcctctcctgaagctcaagtgttattcattgataaaaaagatggctattatttaaaaatagcttcatcaaaaactttagagcgagaagctgaaatgactgcttattttcaaaagaaaaagttaggtttaggatatatttcttatttatcagaccagtcacaggattttttactcaagaaaaaaattcaaggagaaaattatttggctaaacaatatcttaataatccgaaacgtctgtgtgataatcttgctgaaaatctacgatttcttcatgaacaaaattttgaggattgtcccatattagaccattctgaacgttatctgaaaaaagtcgaaaagaacgcaagtataaataattcaaatctagattttgtcaataattataatatccgaacaacagaagaagcttatgattatatagaaaataaaaaattgctattaaggaatgatacgcttttacatggagattattgtttaccaaatataatcctagacaattggaagttcaaaggttttattgatttggattgtgcaggtgttggcgaccgacatattgacctcttttggggtgcatggacgcttaattttaatattggtactgatcaatatcgtgaccgattttttgatgcttatggtcgggatagaatcgatgttgatcgtttgaaattggttggctgctgtgaggtttttggttaaattgaattttagtatattttgatattgaaaggagcattatgaaaaaaattgttatcatcgactacaatattggaaatcttcaaagtgtacaggccgcatttttacgattgggacaagaaacagtgatttcaagagatttagaggaaattcgtaaagcagatgcacttattcttccaggagttggggcttttcctacagcaatgaataatctaaaaaagtttaatttgattgaacttatacaagaacgagctgctgctggaataccaatattgggaatttgtttaggaatgcaagtgctttttgaaaaaggatacgagatagaagaaagacaaggtcttggacttttaaagggagaggtgattccaatcaaaactaatgagaaaattcctcatatgggatggaatcaattaaacctggctaaaaccagtccgacaactcattatttgtctgataatgatgaggtctattttgttcattcttatcaggcgacttgtcctgatgatgaactcattgcctacaccacttatggcgaagtaaaaattccggcaattgttggaaaaaataatgtgataggctgccaatttcaccctgaaaagagtggagaaattggcagaaaaatactaaaagcattcttggaggaaatttaaatgaagattattccagcaattgatttgcaaaatggtgaagccgtgcgtctctacaaaggagattatgataagaaaacggtctattcaaaaaatccccttgaaattgctcaaaaatttgaaagaatgggagcgactgacctccatttggttgatttagatggtgctaagataggacaaactcgcaatttagagcttgtgcgaaaaataaaagatgaaacaagattgaaaatcgaaattggtggtggaattagagatttcgatacagttagaatgtatcttgaacaaattggtgtggaacgagtgattttaggaaccgcagcggtagaaaaccctgattttcttaaagagctattaattaaatacggtccaagcaaaatcattgttggggtagatattagagagggttttgtatcaacaagtggttggttagaaaaaacgagtcttccttatctgtcatttttaaaaaaattagagagaataggggttaaaaccactattattactgatatctccaaagacggaacactgacaggtccaaattttaaactttatgatgaaatttcaaaggaatgttctctaaacgtgattatttctggaggtgtaaaggatagttctgatattcaacgtgcaactcgttctgacttttatgggattattgttgggaaagcttactatgagggaaaaattaatcttgaaaaggagttcaggaatgctaactaaaagaattatcccttgtcttgatattaaaaatggtaaggttgttaaaggaatcaattttgtgggtttaagagaaataggtgatccagtggaattggccaaaatatatgaagaacagtgtgcagatgaaattgtttttcttgatattacggcatcttttgaagaacgtgaaattattggtgaattaattggtcgggcggcgcgtgaactttcaattccattaaccgttggtggaggaattcgttcaattgacgattttagaagaattcttgctagaggagctgataaagtatccgtcaactcagctgcaattgaaaatcctgaacttattcgtcaagcggctaacgaatttggcgttcaatgtgttgttgttgctattgatgctaaaaaacgagcagactctaggggatatgatgtctatatcaaaggtgggcgtgaaaatgcaggtcttgacttagttgattgggctaaaaagtgtgaaagattaggagcaggtgaaattttactaacctcaatggataaggatggaacaaagacaggctacgatttggaaatgctgaatgtcgtttgtactgctgttaatattcctgttgtagcaagtggcggttgtgggaagatttcggacattgttgaagtttttcaaaaaacaagaagcgatgctgcccttgttgcttcattatttcattatggcgaagcaacagttgatgaagttaaagacgaacttataaaaaataatatttcagcaagaattattaagaaggagattttatgaaaccagattttcataagcagaaacttattcctgttattgttcaagattatcaaacaaatcaagtattaatgcttgcctatacaaatgaagtggcttttgagaaaatgcttgaaactggtgaaacttggttttggtcacgttcacgacaaaaactttggcacaaaggagaagaatcagggcattttcagaaaataaaaggaatgcgtttggattgcgaccaagatactttactggtttttgttgaacaaattggtaatgcttgtcatactggtgcttactcttgtttttatgatgaacttattccttttgatgactctgatattttcagagagttggagaagcaaatcatcgaccgaaagttacatccagtcgaaaaatcttatacgaattatttgcttgaagaaggcatcgataaagtattaaaaaaagttggtgaagaagcaagtgaagtgattattgctagtaaaaattcagataaaggagaacttttaggagaaattgatgatttactttatcatttgtttgtattaatgaatcagcaaggtatttctctagaagaagtacggcaaaaagcaaaagaacggcatcagctagaaggaaataagaaggaatttcatacaaggacggcagattaaatgaaaaaattagattatcatttccactctcatttttcggctgatagcgaggagcttcctagaaaccatgtgatagaagctatagcacatggtttaaaagaaatttgttttacagagcatcgagatttttattttccaggaatggatttttcactaaatctacctgagtattttcaagaaatcaatcgattacaagcggaatttaaagataaaattaaaataaaaattggcttggaaatgggaattgatttacgttttaaatcagaaattaatcagtttattgattcggctccttttgattttgtgattgcctctgttcatgaaattggagatattgaagtttatgacgaaacagaattttatctacagaaaacaaaagaagaagcacaaagagaatatcttttagcttgtttagatactgttcaaaattttgtgaattataattcgtttggtcatttagattatgttgctagatatgggccttacacggataaatcaataaagtttgcagagaatcgggagattttatttaaaatcttgcgggctttagcttcaaaagaaaaagcattagaaataaatactagattgtttgataatccgaaaactgaacaattttatagtgatttattgattaattttaaaaaattaggtggaaaatttataactttaggaacggatagtcatatagcaaagcgtgattggctttcaattcataaagcaagaactttaattaaaaaagctggctttcacgaactagcaacttttagtgggatgaaaattgataaaaataaaaagtctattaaagaataataaaagctatctcataacatatgaaatagctctatatcaatgatatttacatcatgatttaccattaccgtttcagaaatgtataacaggcaaaagtttgattttatgaaacaatggctttttgcagaaggacctctcgatattttatctcaagtatttgaatgggataacaccatcaagattccaaaatttgtccatccttgtcaagcctgtgcgtatatttttcagagccctgaaattgtaaaagttattgaaaacaattacacttctattttagagagcgtgacaaagaaattttatcaaaaaataaatttcaaaagtacttttagagaaaaattaaatgctcgggttgatttagaaagttaacttaaaagcaaatgttgaaccactccatttgctttattttaatataatgaaagagaaatatatgaaaaaaatagaactcccacgtttatttatattctggtcaattgtggaatttatagtagcaggcattttatattttaaactccctgaaactataaagattaactttggatatattttaactagccccgtaagtcaagggaatcgtgcatatatttttacattgcccgttgtaatgtttgtttctgcaatagtttttcaagcactttcaagatattacagtccatatttaaggtatcttttgctagtaatcaatgtgattgttttacttggaacttcgttttatttgcttcaatttttatttatgtgatctgaaagttttcttatacaggagttaactatgttgattttttccattttgagtgttctttttttagtgttagggacaattaacataataagtagagttcaaaggctcaaaaaaaagaaaatattacaagaaaattggggaacatttaattcatctccgagtgcttcagacagcgtgaaaagtttagagaataaccttgctcttgaaaaaagagaaaaaaaatacgattcatttattgatagccaaacatgggatgatttagatttacaaaaaatttttaaaaaaataaatataactgaatcaagtttaggtgcagagtgcttatataacagattgcatcttcatgtttattctcaaaatcaaacaattgaagacacaaaagattttttgaataaaaataatgatgttaggcttgaactacaatacctttttacaaaactcgggaagaagaacaataatctaaccaacaaaataataaaaggagcttcaaattacaagaaggaaaagctgtatttatattttcttttaggcattataccgttactgtccctatttctagcgattccatttcgaacatttggaaccgtactattttcgtgcagttttttatttaatatttttttctccttgagtaaaaaatatctaatggacttggaattagaaaggatgtcttatctcgttcaaatgatttatattggaaaaaagatatcaagatattcttttcccaaaaaaaaccaactaaaaaatgctattaaagaattttcattgttaaatatatttgggtatacttataaacctgatgttgaattcgttgatatgggggttatcttggagtacctaaattttttatttttaatccctataatttctcacgcctatatggtcaataagctgaaaaaacataaccttaaagctcagagtatatatgatattttatctgaattagaagccgctatctcaatattaaactatgaaatagcattagattatttttgtcgacctactttttcaacgagcaaagaattaacagctaaacaaatttatcatccactattaacagaaccagttgctaattcgattgattttaaggaaaatattcttattggaggagataatgcttcagggaaatctacattcttaagaacagttgcggtaaacatagtactggctcagtctataaacattgctctggcaaatgagttttcaatgcaacatggaaacatctttactcttatcaaggttcaagatagtattagtaggggagaaagttattttatggcagaaagtcgaattgtcaaatcaatacttgacagattgaataatgcaatggttgaacaaccataattgtctctatatgatttcaacacatgacttgaacctaattgaattagctaaagattggaacgaaacctatcattttacaagtagtttcataaataataaaattatttatgattataaaataaaatcaggaaaacctcagaccagtaatgcagttaatattttaaaaacactaagttatccatctgaagtagtcactgttgctcaagatacaataaaaattgtcaacagtaatttttgaatttttaaatactacgtaaatactaaagctctgcgacaaaacttgtcgcagagcttttatttcaaattcaattataaatcttttagttcattagtgtactttattatttttcttagaaggtaatgttttatccattcccacacaatcaacggacttgcaataattaccaagccgagtgcaaatattaaaattgaaagaacaatcccaacaaggattttcaacgcaactactcatgtaaacgaagcaaatgtaatattcatcatcacccatacgtgcgaccatccaaagtcatataaaacagatgtaaacataagaataatagactttttatattatgatgctaaatctttctcaagtagcgcaagacgttcttgaacttcttgatttgatagttggtgggctttgatgtaacggttattgggatgaactcgacattcatgtgaacaagcaccaagatattttgcttcattttcctctgaagctaacatttgtctgttacattctggattcccgcaattgatgtaacgttcacatgggcttccatcaaaccaatcacgtccgacaatgacatgttctttttggttgattggaactgcgattcggctatcaaaaacatacatttgtccgtcccaaagatctccttgaacttctgggtcttttccgtatgtggcaattcctccgtgaagttgaccaacgtctttgaagccttcccgaacgagccatcctgaaaatttttcacaacgtattccaccggtacagtaggttaaaacacgtttttccatgaattgttctttgttatctcgaatccactgtggaagttctctaaaacttcttatttctgggcgaatggcgccacgaaaatgccctaagtcaaattcataatcatttcgtgcatcaatcactactgtattttcatcaagcatggcctcacgaaactcttttggatcaagataagccccagtaagttccaaaggattgacgtcatcttctaaacttaaattaactaattcagggcgataacggacatgcattttcttaaaagcattttgctcggcttcatcaattttgaagattgttgtgctaaagcgagggtcatttttcatcaattccatgtaggcatttgtttgctcgatagtaccagaaacagttccgttaattccttcgtcagcaactaaaattcgtccttttaaacctaattctttacagtctgcgaggtgtttttgggcaaaagtttctccatcttcaattgggacatattggtaatataataaaactcgataatcttgagtcataatttctccttaatcttattagtacattagaatccattataatttaatcattttatgtctatcaaaagcaacaaaattgcttgtatattttctaacaagcttaattattgtggatttaattgaatattaaagggagaagttgtaatctatttgttgttaagttcttgttaatacaaaaaaatgcattaaatattattattttattgacaatttaaaatattaagagtattataatgtaaattaacaaaaaaagaggaacttgaaatgacatacacacaattttcattgttgttgatcaaggtggacctacattagcttttgtggctaaaatatgtgggtcctgtttggcgatagtcatttcgaggaccgagagacgtcctcatgggcgtcttttttgtttcttaataaaaaatagaggtaatattatgcgaaaaattgaattctttgacacaagtttgagagatggcgaacagacaccaggcgttagtttctccatttcagaaaaagtaacgattgctaaacaactggaaaaatgggggatttctgtcatagaggctggttttcctgcggcaagtccagatagttttgaagcagtaaagcaaattgctgattctttgaatgatacggctgtcactgcattagctcgttgtgttatctcagatatcgataaagcggttgaagcggtaaagggggcaaaatatccgcaaattcatgttttcattgccacttcacctattcacatgaaatataaacttaaaatcagtcccgaagaagttttgaaaaatattgataaatgtgtgagatacgcacgtgaacgggtcgaggttgttgagttttctccagaggatgcaacaagaacggagttgaattttcttttagaggctgttcaaacggctgtcgatgctggagcaacttatattaatattcctgacactgtcggttatacgacgccagaagaatatggaaaaatttttaaatttttgattgataatactaagtctgaccgagaaattatttttagtccacattgtcatgatgatttaggaatggctgtagctaattcattagctgcaattaaagctggggctgggagagttgaaggaactgtcaacggcattggagagcgagctgggaatgctgctcttgaagaaattgctgtggcactacatattcgtaaagatttttatcaggcacaaagtcctttaaaactttcagaaactgctgcaacggcagaactaatttcacaattttcaggaattgctattccaaaaaataaagcaattgttggtgctaatgcttttgcacacgaatcaggaattcatcaagatggtgtccttaaaaatgctgaaacttatgaaattattacaccagaacttgtcggaataaagcataattcgttgcctttaggtaaactttctggtcgtcatgcttttagtgaaaaattgacggaacttaatattgcttatgatgatgaaagtcttgcaattttatttgaaaaatttaaaaaattagctgacaagaaaaaagaaattactgacgcagatattcatgccttgtttacaggagaaacggtaaaaaatctagctggatttatacttgataatgttcaaattgatgggcacaaggcattggtgcaactaaaaaatcaagaagaggaaatttatgttagtcaaggagaggggtcaggttcagtggatgcaatttttaaagctattgataaagtctttaatcatcaactaaaattaatttcttattcagtggatgctgtaactgatggaattgatgcacaagcaacgactttggtttctgttgaaaatttatctacaggcactatatttaatgctaaaggtgttgattatgatgtattgaaaggaagcgccattgcttacatgaacgctaatgttttagttcaaaaagaaaatttacaaggaaaggttgaacaaatttcagctcatgatggaatttaaggtgaaaaatattgtctaaaaaaattgtgacacttgcaggagacgggattgggccagaaattatgtcagctggtttaagtgttttaaatgctgtcagtaaaaaaattgcttttgagtatgaattagaagccaaagattttggaggaattgcaattgataagcatggtcatcctttaccagaagaaactttgcaagcagttaaaaatgctgacgcaatcttgctcgctgcaattggtcatcctaaatacaacaatgcaaaagttagaccagaacaagggttgcttgctttacggaaagaattaggactgtatgctaatgttcgtccattaaaaatttatccggctctaaaaaaactttctcccatccgaaatgttgaaaatgttgatttcctagtgattcgcgaactgacagggggaatctatttcggtcagcatgaattggcagatgataaagcacgagatgtcaatgattattctgctgatgaaataagaagaattcttcattttgctttcaaaagtgctcaaagtcggcccagaaaattactgacttcggttgataaacaaaatgttcttgcaacttctaaattatggcgaaaaatggctgatgaaattgctgacgaatatcctgatgtacgattagagcaccaattggtcgattcttgtgcgatgttactgattactaatccgcaacaatttgatgtgatagtcactgaaaatctatttggtgatattctctctgatgaagcaagtagtttggccggtagcttaggagtgatgccttcgagttcgcatggatttaacggtctagcactctatgagccaattcatggttcggcaccagatattgcaggaaaaggaattgcgaaccctgtttcgatgattctatcaattgccatgatgctaagagaatcttttgggcaagaagatggggctgcgatgattgaaaaagccgtaacccaaacttttactgacggaattttgactaaagatttaggtggaaccgcgacaactaaagaaatgacagaagcaatcctgaaaaattgtcagtaaaatgcgattgaatagtgagcattttagttgcagacaaaagaaccgttaacaaatttgataattttgtcagtaaatattactgacaaaaagtacaaaattactgacagaatttgtcagaataaatttttaaaaaaggaaataaaaaaatgtcaggtaaaacaatatttgataaactttgggaccagcatgtgattgctggaaatgagggagaacctcaactgctttatattgaccttcatgttattcacgaggttacgagtccgcaagcatttcagggcttacgtgaagcaggacgtcgtgttcggagaaaagatttgacatacggaactcttgaccacaatgttccaacacaagatatttttaatattcaagatttgatttctaaaaaacaaattgatacttttactaaaaatgtcaaagaatttgatgttccagcggagactcatggtggaaaaggacaaggaattgttcacatggtagcacctgaatctggcagaactcaaccgggaaaaacaattgtttgtggcgatagtcataccgcaacaaatggagcatttggtgcaattgcttttggaattggtacaagtgaagttgaacatgttcttgcaactcaaaccatttggcaagttaaacccaagcgtatgaaaattgaatttcaaggtcatccacaaaaaggaatttatagcaaagactttatcctcgcattaattgctaaatatggtgtggatgcaggtgtaggttatgcggttgaatatagtggggatgctatcagtgatttaagcatggaagaacggatgacaatctgtaacatgtcaattgaatttggggcaaaaattggcctgatgaatcctgatgaaaaaacttatgactatgtcaaagggcgtgaacatgcacctaaaaactttgatgaagctgtcagtaaatgggaaaaacttgtcagtgattctgatgcacaatacgataagattttaagtcttgatgtcagccagttgaaaccaatggtgacatggggaacaaatcccggaatgggcctagaatttggcgaaaagtttccggaaattaacaatgatttgaattatgaacgtgcttatcagtacatggatttaaagccaggccaaaccgcttctgacatagatttaggctatattttcattggttcttgtacgaatgctagacttggtgatttagaagaagctgcaaaaattattggagacagacatattgctgatggactgacaggaattgtcgtccctggaagcagacctgtgaaagaagcggctgaagcacaagggcttgataaaatttttaaagaagctggttttgaatggcgggaaccgggttgctcagcctgtcttggaatgaatcctgaccaaattccagaatacgttcattgtgcttcaacctctaatcgaaattttgaaggacgtcaaggacataatgcaagaacgcacctgtgctctccagctatggccgctgccgccgcaatcgctggtaaatttgtagatgttagaacgctcgtaacagattagtctgtagaaagaaaaaaagatggaaaaattcacgatttacaaagggacaagtgttccagtcatgaacgataatattgacacagaccaaattattcctaaacaatttttgaaagcaatcgataaaaagggctttgggaaaaatttattttatgaatggcgttatctcaaagattacgatgagaatcctgattttattttgaatgctccaaaatacaaaaaagcttctctgttaatttcaggagataattttggttctggttcttcaagagaacatgcggcatgggccttatcagattacggatttcgggcaattattgctggctcttactcagatattttttataataatgctttaaaaaatggcttgttaccaattaaacaaccaagagaagttctaaatcaattgacaaaactgtcaagtcaagaagaaattactattgatttaccccatcagctaatcatcacaagccttggtgactttcattttgagattgaccccatttggaaagacaaattaattaatggcttagatgatattggaataaccttgcaatatgaagaagcaatctcatcttacgaacaaaaaaatcaataagagcgagctaaaaatgacaattattaatttaaagaatgtaaatcttactcgaaataaaaaagaaattcttaaagatattacttggaaagtaaatcccggcgaaaattgggttattctgggcctcaacggctctggaaaatcaagtcttttgaaattgattttagcagaagaatggaaaacttctggcgaaatcactgttttaaatactcaatttggaaatggagaaattcctaagttgagaaaaagaatcagcgtagttggctcatttattgctgaaagatttcaaccaaatattaaggctgaaaaccttgtttatactgggaaatttaattcgagcatgctctataaaccctacacagatcaggaacttgatgaggcccgtcagcttttaagacaaatgggggcaaaatcacttattggccgaaattatgccagcctttctcaaggggaaaagcaagttcttcttattgctaggagcttaattttaaagcctgagcttttaattttggacgaagcaacgaacggtttagatttatttgctaaagaaaaattattaaagcaactgcagcagattaatcaattaaaaaacgcaccaacactcatttatatttctcatcatcccgatgaaatcactgatatttttactcatcttttacttttaagagaaggaaaagtgattcaatcagggaaaaaagaaaacttattaaatgaaaagatacttactgatttttatcaagaaaaagtagaagttcaccgttttgagcagaaatattttgtaatttctgctaactgagaaaggaaaacaaaagtattttatagactatatagaatattctgacaaattattgtattttcatttttttagtgataaaatagctctatgtaaatttatggggaggtcaaaaagataacatatggaattcaaatataacggaaaagttgaatcagtggaacttaataaatattctaagacattgactcaagatccaacacaaccagcgactcaagcgatgtactacggcattggttttaaagatgaggacttcaaaaaagctcaggtcggaatcgtcagcatggattgggacggaaatccatgtaatatgcacttgggaacacttgggagtaaaatcaaaagttctgtcaaccaaactgacggattgattggacttcaatttcatactattggagtttctgatggaattgccaacggaaagcttggcatgagatattctttggtcagtcgtgaagtgattgctgacagcatcgaaaccaatgctggcgcagaatattatgatgccatcgttgccattcccggttgtgataaaaatatgccagggtcaattatcggaatggctcgcttaaatcgtccgtcaattatggtctatggtggaacgattgaacatggcgaatataaaggtgaaaaattaaatattgtttcggcctttgaagctctgggacaaaaaatcaccggaaatatttctgatgaagattatcatggcgttatttgcaatgccattccagggcaaggtgcttgcggaggaatgtacactgctaataccctggctgccgctattgaaactttaggaatgagtttaccttattcctcttccaatccagcagtcagtcaagaaaaacaagaagagtgtgatgaaattggtttagccatcaaaaatttattagaaaaagatattaaaccaagtgatatcatgaccaaagaagcttttgaaaatgccataacaattgtcatggtccttggaggctcaaccaatgctgtgcttcatatcattgcaatggcaaatgccattggtgtagaaattacgcaagatgatttccaacgtatttcagatattacccctgttcttggcgatttcaaaccgagcggaaaatatatgatggaagatctgcacaaaattggtggccttcctgctgttttgaaatacctacttaaagaaggaaaacttcacggtgattgtttgaccgtcacaggtaaaactttggctgaaaatgttgaaacagcattagatttggactttgacagccaagatattatgcgaccactaaaaaatccaattaaagctactggacatttacaaatcttgtacggtaatcttgcccaagggggttctgttgcaaaaatttctggtaaagaaggcgaatttttcaaaggaactgctcgtgtttttgatggtgaacaacattttatcgatggcattgagtctggccgattgcatgctggtgatgttgcagtcattagaaatattggcccagtcggaggtccgggaatgccagagatgttaaaaccaacttcagcattaattggagcaggacttggaaaatcttgtgccctcattactgacggaagattttctggtggcacacacggctttgttgtggggcatatcgtccctgaagcagttgaaggtgggttgattggtttagttgaagataatgatattatcgaaattgatgcggtgaataatagtattagtttaaaagtttctgatgaagaaattgctaaacgccgtgccaattatcaaaaaccagctcctaaagcaacgcgtggtgttcttgcaaaatttgctaaacttacacgccccgctagtgaaggttgcgttacagatttatagaaaggtttgaatgaaaaaaataaagttagaaaaacctacttccggttcccaacttgttctccaaaccttaaaagaacttggagtagaaattatttttggttatcctggtggggccatgctccccttgtatgatgcaattcataattttgaaggaattcaacatattttagcccgtcatgagcaaggagcaacgcatgaagccgaaggttacgctaaatcgtctggtaaagttggtgtcgtcgttgttacttctggaccaggagcgactaatgcagtaaccggaattgctgacgcttatcttgattcagtcccattgttagttttcacaggtcaagttggccgtcagtcaattggtaaagatgcttttcaagaagcagatactgttggaattacagccccaattacaaaatataattatcaaattagggaaaccgcagatattccaagaattgttacagaagcctattacttggcaaggacaggacgtcctggaccagtagaaattgatttaccaaaagatgtttccatccttgaagtcactgaaattaatgacccaagcttgaatcttcctcattatcacgaaagtgaaaaagcgactgatgaacaattgcaagaattactgacagaactttctgtcagtaaaaaaccagtcattattgctggcggaggaattaattattctggctcagttgatattttcagagcatttgtcgaaaaatatcaaattccagttgtttctacattgcttggcttaggaacattaccaatcagccacgaattgcaactaggaatggcaggaatgcacggttcatacgctgcaaatatggctttagttgaagctgactatattattaatttgggatcacgttttgacgatagagttgtatccaatcctgcaaaatttgctaaaaatgctgtcgttgctcatattgatattgacgctgctgaacttggcaaaattgtaaaaaccgatattccaatcctttctgatttgaaagtggctttaagcagacttttgcaattaaataaggtcaagactgactttaatgattggattaaaactgtcattgaaaataaagagaaagcaccatttacttatgagccccaaaaccatgatatccgtccacaggaaacaattaaattaattggagaatacactcaaggagatgcaatcattgtgaccgatgttgggcaacatcaaatgtgggtggcgcaatattatccttataaaaatgcaaggcaacttattacttctgggggaatgggaacgatgggctttggcattcctgcagcaatcggtgcaaagctggcacaaccaaataaaaatgtcattgtttttgttggcgatggtggctttcaaatgactaatcaagaattagcattacttaatggctacggtattacaatcaaagttgttctgattaataatcattcattgggaatggtacgtcaatggcaagaatcattctatgaagagcgacgttcacaatcggtttttgatgttgaaccaaattttcaattgttagccgaagcttatggcatcaaacatgttaagttagataatccaaaaactttggctgatgatttaaaaattattacagaagatgagccaatgcttattgaagttctaatttcaaaatctgaacatgttttaccaatgataccagctggattacacaatgacgaaatgattggacttcattttactgataagaatgaggaggtagataatgcgtagaatgattatcgcaaaacttcataatgtaacaggaattatgaatcgatttaccgccgttctcaatcgaaggcaagtgaacattctctcaattaccgctggagttacagaaagtcaagacttaactcataccacttttgttattgaagttgatcatcttgatgaagtagaacaaatcattaaacaattaaatcgcttaatagatgtgattgaagtagctgatattacagatttgcctcatgtagaacgtgaagtcgtcttgattaaagtatcagctccaccgaccattagggcagaaatttttacaatgattgaaccttttagagtaaatgtagttgatgtcaatctggaaaatgtcaccattcaattaacgggtgattcagcaaaaatcgaagcacttattgatgttgttagtccttatggcattctaaatatggctcggacaggtagtgcaggttttgagcgtggctaaatttaaataagttaacaaataaatagaaaaatagaggaaacaaaaatggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcggtagctaaagctgatgttattatggttttggcgccagatgaacttcaacaatccatttatgaagagaacatcaaaccaaacttgaaagcaggttcagcacttggttttgctcacggatttaatatccattttggctatattaaagtaccagaagacgttgacgtctttatggttgcacctaaggccccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgctaaaaatcttgaaattgaaaaaattggggcagaactacgtaaagcaatgccattcacacaatctggtgatgacgatgcctttaaaatctatcagtaatttctcttattgattgaacaaaaacataaaagcattttatggaggaatgacataaatgataagtgccaaagaggttgaagatgcctatgatttgttaaaagcagttgtcactaaaacacctttacaattagacccttacctttccaataaatatcaagcaaatatttacttaaaagaagaaaacttacagaaagttcgttcttttaaattacgaggagcttattattctatcagtaaattatctgatgagcaacgctctaaaggagtggtttgtgcctccgcaggaaatcatgcacaaggagttgcttttgctgcaaatcaattaaatatttctgcgacaatttttatgcccgttaccacacctaaccaaaaaatttcacaagttaaattttttggcgaaagtcatgtaacaattcgtttaattggtgatacttttgatgaatcagccagagcagcaaaagctttttctcaagataatgacaaaccatttatagacccttttgatgatgaaaatgtaattgctggtcaagggacagtggctttagaaatttttgcgcaagctaaaaaacaagcaataagtttagataagatttttgtacagattggtggaggtggtttaattgcaggaattacggcctacagtaaggagcgctatccccaaactgaaattatcggagttgaagcaaaaggggcaacaagtatgaaagctgcctactctgctggtcagcccgtcaccttggaacacattgataaatttgctgacggaattgcggttgcgactgtcggtcagaaaacttaccaacttattaatgacaaagtgaaacaattgcttgcggttgatgaaggtttaatttctcaaaccatactcgaattgtattcaaaattaggaattgtcgccgagccagcaggtgcaacatctgttgccgcacttgaacttattaaagatgaaatcaagggtaaaaatatcgtctgtatcatcagcggcggaaataatgatattagtcgaatgcaagaaattgaagaaagagctttggtttatgaaggtctaaaacattattttgtcattaactttcctcaaagaccaggagccttacgaacttttgtcagtgatattttagggccaaatgatgatatcacccgatttgagtacatcaaaagggctgataaaggtaaaggaccttgtcttgttgggattttactttcagatgctagtgattatgattcattgattaatcggattgaaagatttgataatcgttatgttaacttacatggaaatgatagtttatacgaacttttggtctaactaaccaattggtttgagccattttctagtttcaattctctttaaatcactagaaatttgatataatttaattaataaattatttaaatttaatgagatagaaaagagaaatatcatgacagaaatcacacaactttttcaatataatacccttggagctttaatggcaggcctttacgaggggacaatgacaattggtgaacttctgaaacatggtgatttaggaattggaactttagattctgttgatggagaattaattgttttggacggcaaagcctaccaagctaaaggtgataaaactatcgtcgaattaactgatgacatcaaagttccttatgctgcagttgttccccatcaggcagaggtagtttttaaacagaaattcacggccagtgataaggaattagaagaccgaatcgaaagctattttgacgggcaaaacttatttcgctcaatcaaaataataggtgaatttccaaaaatgcacgttcgtatgattccacgggcaaaatcagggacaagatttgtagaagtttcacaaaatcaacccgaatacactgaagaaaacgtcaaaggaacaattgttgggatttggactccggaaatgtttcatggtgtgagtgttgctggttatcatctccattttattagtgaagattttacttttggtggacatgtccttgattttattattgataatggtactgttgaaattggcgcaattgaccaattgaaccaatcattccccgttcaagatcgcaaattcttgtttgctgaccttgatattgaagcactaaaaaaagatatcgatgtagctgaatgataatcactagatttctttagctatattaaaggagaaatctatgaaaattattgcaacatcagatgcaacagccgctatcggtccttatgttcaaggtaaaattgtcaatggtttactctatgcatcaggccaaattccgttgaatccattgaacggagagattgttggagatagcattgagactcaaaccgaacaggtgatgaaaaatatttctgctattttgaaagaagcccattctgattttgacttagtcatcaaaacaacatgtttcttgaaaaatattgaagatttttcacgatttaatgcaatttattcaaagttttttgataaagaattcccagcgcgttccgctgttggagtcgcaggattacctaaaaatgtccttattgaaatagaagtcattgcagaagttaaatcctaaaattaaaacatattagctataaaaattactgacaagatttctgtcagtaatttttttggttacaagtcagtcttttttacgtatagaaaattataagccaattttaaaatttctgacaaagctgtcagtaaaaaatggaggaattatgataacaaattttgatttatatcgttggaaaaaagctggcatgaccaatttaggagtaaataaacttttaaaattttttcatagatatgataaaaaaataagtttaagacaaatgggacaagtagcacaacttaaatcaattcccaactttattgaacaatataaaaatcaagacgtaattaaactgagagaagagtataaaatatacccttcattttctcttcttgatgaaatttatcccgaaaggctcaaggaaatttacaatccacctgttctattattttatcaaggagatataggactcttaaaaactcctaaattagcttttgttggtagtcgacaagcaagctcacaaggaattaaagccgttcaaaaaattgtgacagagttgaaccaaaattttacgattgtcagcggactcgctaaaggaattgatacagcaagtcatctttctgccattaaaaataaaatccctacaattgcagttatcggtacaggcttagatatcttttatcctttagaaaatcgaaaaattcaagaatatcttgctaaaaaccaactaattctatcagaatattcagtcggagaaaaaccacttcgctatcattttcctgaacgcaatcgtatcattgcgggactttcacatggtgtagtagtgatagaagcaaagttacgaagtggtagtttaattacttgtgagcgcgctctggaagaaggaagagatattttcgctgtaccaggaaacatagcagatggattttcagatggctgtaatcatctaattcaacaaggagcaaaattaatctatcaagcccaagatatcttagaagaatatttgtatgattaaaaaaaccctttatcaccttgcaccacaagacttaagtcggtttttacagtacaaaaaaatatcaagttctactataagaaaactaaataacttgacatattgaagaaaagcatttattatgagagagtgaatttaatgtaaataagagcattaacacctcttaaactattattttacttccacattcgatatatacctctatgaattaagatacaataactaaaagatagtggataccaaaaagaataaataggaaaaattatgccaacttcaactaaaagtaaaacaaaaacaactacaaagaaaaaaacaacacgaaaaagagttactccaggtaaaaatctggttattgtagaatcgccagcaaaagctaaaacaattgaaaaatatttaggtcgaaactacaaagttgtggcttcagtaggtcatattcgtgatttgaaaaaatcaaccatgtctgttgatatagagaatgactatgaacctcaatatattaatattcgtgggaaagccccattaatcaactctctcaaaaaagaagcaaaggctgccaaagccgtctatctcgcaagtgacccggaccgtgaaggtgaagcaatttcttggcacttagcacatatcttaaatcttccacttgaagaaaaaaatcgagtggtctttaatgaaatcactaaagatgctgttaaaaatgcctttaaggaaccgcgtcaaattgatgtggacttagttgatgcccaacaagcacgccgagttcttgaccgtttggtgggttattcaattagtcctattctatggaaaaaagtcaaaaaaggactctcagcaggtcgagttcaatctattgccttaaaactaattgttgaccgcgagaatgaaattaatgcttttattccagaagagtattggtcaattgatggtgaatttaaaaaaggaactaaaaaattcaaagcatccttctggggaattgacggaaaaaaacatcctttaaaaaccaatgaagatgtcatcaaagtcatggaacgcttagacggtcctgattttaacgtagataaagttgaaaagaaagaacgtcgcagaaacgctcctcttccttatacaactagctcaatgcaacaagacgcggctaataaacttaattttcgtactcgtaaaacaatgatggttgctcaacaactttatgaaggtcttactttaggaagccagggccatcaaggtttaattacctatatgcgtacagactcgacacgtatttctcctgttgcacaaagtgcagcccacaattatattgctgatcaatttggagaaaaatatagtaaacacggttcaaaagttaaaaatgcctctggagcccaagatgcccacgaagcaattcgaccttcaaatgtttttaacactccagacgccattgctaaatatctagacaaagatcaattaaaactttacacactcatctggaatcgtttcgttgccagtcaaatggttgcagctatttttgatactgttaaagtaaatctgtctcaaaatggtgttatctttattgccaatggttcacaagtgaaatttgacggttatctgcgaatctacaatgattctgataaatcaaatatgcttccagagatggaagaaaatgaaactgtcaaaaaagcgaatgttaaaccagaacaacatttcactcaaccaccagctagatattccgaagcaacactcatcaagacattggaagaaaatggagtgggacgtccctcaacttatgcgcctacactagaaacaattcaaaaacgttattatgtgagattatcagcaaaacgttttgaacctacagagcttggagaaattgtcaataagcttattgttgagttcttccctaacattgtaaatactgaatttacagctgaaatggaaaaagatcttgatgaagttgaagaaggaaaacgtcaatggattgaggttgttgaccaattttacaaaccctttgcaaaagaacttgaaaatgccgaagaaggtatggaaaaaatccaaatcaaggatgaacctgctggctttgactgtgatgtttgtggaagtccgatggtaattaagttgggacgttttggaaaattttatgcttgtagcaacttcccagactgccgaaacaccaaagcaattgtcaaagaaattggtgtaaaatgtccactttgccatgaaggaaatattattgaacgcaaaacaaagaaaaatagaattttctatggttgtgatcgttacccagaatgtgaattcacaagttgggacaaacctattggtcgtgattgtcctaaatctggacattttcttgttgaaaagaaagttcgcggtggcggtaaacaagtggtatgttcaaatgatgaatgtgactatcaagaagaaaaacaaaaataaaaggcgcttccgcgcttttttattatattaatcaatggaaaaatttactaaatttagatataattgggactatgaaaaaaacacatattaacgttattggagcgggacttgctggttctgaagctgcttatcaaattgctaagcgtggcattcctgttaaactatatgaaatgcgaggcgttaaacaaacccctcaacacaaaacagataaatttgctgaactagtctgttcaaattctcttcgtggagctgcaatcactaacgcggttggtctcttaaaagaagaaatgagaagacttgattctgtcattatcaaggcagcggaagtgactcaagtacctgctggaggagccctagctgttgatagagaaggtttctctgattttgtcacaagagaagtttctaaccatccattggttgaagtaattcgtgaagaaattactgatcttccagaagatgaaattacaattattgctactggacctctaacttcagataaattagcagaaaaaattcatgaatttaacggtgcggatggcttttatttttatgatgcagcagcaccgattattgacgccaactcgattaattttgaaaaagtctataaaaaatctcgatatgataaaggtgaagctgactatatcaactgtccgatgaccaaggaagaatttcaagcctttcaagaagctttaatttctgctgaagaagctcctttaaactcttttgaagatttaaaagtctttgaaggttgtatgcctattgaagaaatggccaaacgtggttataaaacgatgctatttggcccgatgaaacctgttggattggaatatcctgaagattataaaggacccagagacggtgattttaagactccctatgcagttgttcaacttcgccaagataatgcttccgcatctttgtacaatatcgtaggatttcaaactcatttaaaatggggagaacaaaaacgagttttccaaatgattccaggtcttgaaaatgctgaattcgttcgttatggagtcatgcatcgtaattcttacatggattctccaaatcttcttaaacaaaccttccaatctcgcaaacaagagaatctgttctttgcaggacaaatgacaggagtagagggctatgtagaatcagcagcttctggtttagttgctggaattaatgctgtcaaactctttaatgacgaagaagtagttatattcccaaaaacaacggcgattggaagtttaccttactacatcacccatactgacagcaaacattttcaaccaatgaatgtaaccttcggaattgttgaagaattagaaggcccacgaattcgtgataaaaaagaacgttatactaaggtagcagagcgtgctttaaatagcttaacagatattatttcaaaagataatctataacaaataaaaaacacttggaatttgaatcaagtattttttatttgttatagattatctagagcatttttttgttcttcattgataatatgagtataaaggtctgtaacttgagttgaagcatgccctaactgattgctcaccaatacctgagaatttgtttgagcataaagtcgagtcgcaagtgtatgtctaagtttgtgaggggtcactcgtactttaaatgcttgagaatatttagcaactaatttttcaacactagaaggatctattcgactaggaacatctctataaagtgtcacaaaaaatgccgtatctttcgctgtagtcttataacgttgactacgtacttccaagtatctttcaaaataagttttggcaaaaggagcataaggaacagcatccctttttcctcctttacgagttacctcaacaaccatagtaataagatttaaatctcttaaatctacattaactgcctcagaaagacgaataccagaggctaaaataagtgcaataattgctaaatcacgttctttatttttgaaaaaactagaacgagctctagttgataatgttttttcgtattcattatcaatatagtcaagaaaaccttgagtttcatctcccaaaaaaagcttccctttaatattctcagcacgagaagctaaagtttcggattttttcttagtctgtaccttcttcataacattacgatagaagtaaggctcaccatcttcattttcaacctcttcagtaaggtatttataaagactagaaagagcagatagagtacgattaattgttgtttgacttaccccataacgggtagagcgcgtatttaaacgaggtctctccctaagatagaggatgaatgactccaaatctcgtttagttaagttttctaaaacagagagggaaacatcagttatcttatcaacatcagcaactccagaatcgaccaaccaactaaagaaacgttcatattctttaagatattcataaagtgtattcaaactataaggaatagtaagtttagattgataatattctaaaacataagaaggcatgatatgttttagtttttcaatattttgtattaattgttcacgtttcatagatttaagtataccagaagagatatccaattgtcaagaaaattacagtttttcggaaagatgttacttaaaacatataggagttctgtttcacaccttttcaaaaggtttcataaaccttgttattataaggtttatgtgacacgttgctctcctgctttttgttttaattatctttttaaatttttttagaagttttttctttttccataaattatctttcttcaatagtaaaaatacgcatatagccattcacaaaaaagagagattccgattaagaatctcccttttacatcatttgacttgactttttatgcatatttatttataatatcattaagtaagtcgattgaacggaatgggttcttaatcggcaggtctgattaagcgacaactttatcaggccttttttagttgccttaattatagcataaactaatcttgcgtgcaaggatttttttgttatgctctgttaggctggttaatcggcttttggtgggtatttaacttccattgtttttctgtcaaagaacgctaagacctcctgtttaacttcaaatttatgccaggtgtccccatttttccaatacaaaaatccatcctttgaggtaaccacggcaacaatcttaaccctttgggggccacttttggtttcaacagccgcctcgtcgcctttacgtagtctaattggttgtaggtggtctggtaccttccaatagcgtttatgtttgtcagttccgttaatatggactgcttgaatgattttcatgattactcccctgttatttaattacgttaacttgattatatcaaaaattgtacagtaaataaatttcaggcagtttgtgaattttataactttcttaatgcatctttagcttcagcgctgacaatgtgggtatataactcagttggtttggttgaagagtgtcctaattgattgctgacaaggacttgagagtgactgacgttatagagtcttgttgcgaatgtatgccttagagtatgaggtgtcactcgaactttataggcttctgaatacttcgctactagcttatttatcgaagcattcgagatttttctaatttgttggttgtaatcagtaataaaaagtgcttgtatttcagtttctatgctacttcttgccccaaaataatctgttatatatctgtgtgaaaagtgggcaattggcactacatctttcttgccttcttttcgcatcactcttactttaccagtttcaaggtttaaatcgttaagattgatccctacaagttccgcacaacgtaatccagatgataaaaaaagacttaatatagctaaatccctgactttatttttcttgaaactagttcttgcacgattactgatagacttttcatagtgttgctcaacaaattctaaaaaggctttggtttcatcgcctaaaaagagtttcccttcaagttgagccgcacggtaatgcaaggtttcgcttttttttcggatatgaattaaacggctaacatttctagtcatgtaagtattgccattactatcttcggtttgttcgcaaagataattatataggctttttattgcagcaattgttcgatttaatgctgatgtatgtatattagaaccacattttgattctaaacggagtcgttcgtgaagtacaaaagcttctagctcacgtttcgttacgttttccatttctttcaaagtaatttctttgatgttagcatggttcgttatgttattttcattcatccatttcaagtatttcctaaactccaggcaataagagtaaatagaggcaatactcagcggtacagtgtccttagactggatgtactcattgacgtagtagggaaactcaagcatgagtttatttacattataacgataaccatgattttctgacatctcttttattgttcctcaacattttctattcaaattagaatatattgtagttaaatattaaagtattgtcaattttattagaactcaaaattttatgttaaggggtcttgtataggctgcttttttagattttcccttttattatttatattccacctcatctattcaaatatttttttggtaaaagatattttatttgtaagtatatttagtttgttaagagtgggtaatttgtagtggctgatttaacggaatctggtaagtccgtaatccgataaatccagtctctggaatatccgtaatacggttatttcatccgaaaaacgggttttcagtatttcggtgtttaaacctcagaaagaggcttcagcattttataaatggattaaaattacttagcaggtataaacttatgaaattatatatatctttccgaaaaagtttgctttttctcatagtattgctaacatttttagatacaatattaatattgataaccttctctaataccaaccccaatactgacctcaataccgaccctaatactaaaaaaagccactttaattgtggcctttttagttaagttcaatctaaaacagttgagagtccttcctcaatagtcgtgattttaaaatctggaaattgcttcttaaatttatcagaaataaatagattatcttgacgatagcgtggaagtaattcgtttagttcttgcatacttttattaaatgacttaatgaggttaaattgccactctcgaatcactctggcttttactttcttatttaatattttttctgcaatttgtctcagttctttgtaactgtgtggtttatcacagggcaaatgccaagtttgattgtaggctgaaggtgtatttgcaattaagaccatagcacgactcgcatcaggtgtccatatcaagcttctctggcaacttgaattgatggggatactagccgtcttatcctctttaattttgtctaaaaacattgtattagtgatactttgtgttttatcaggtccataaaattctggtgctcgacatatcacggcatctaactcacgattgtgtatttcagataagaccatttcagccatttttgcacgtacaattgactttcttcctactggaataaatggtgtattctcggtttgtggttcgctgtctttaggatacatataggtattatcaaaaaatactaatttgcttccatatagtttgcatgctgtaataacattttccataattttaaaaaaattggcttcccaaagtgaactatccatgggtaatcctacagtgaaatatacaatatcactcccatctatagcagttttagtctgttcaaaatccattaaatccgctgaaactaactcatctgttggatgtatctttttaggtcggcgtccaactaaacgaattttttttgtatattttcgatatatttcctttgcaacttcctgacctatttgtccattactacctaatactgtttgcacctattttacctcctcaagaaattgttttgctaccgctcttacagaaaaaggattttgtcctgtaatgattcgcccatctttaacggcaaattccttataaaatcttttcttcttaaaatttgcccctctttttattgcttcaacttcattaaaaaaaggtactattttagtctttctagcaagtatttcttctgttttagtaaaaccagtgatattcttatctttaatataataatttcctgcctcatcttttatgttaagaagcccagcaataccatgacaaactgataaaagaaagccttcattttcatatatttcacttgctaaacgctctatctcctcggaatgataaaaatcccacatcactccatgaccgtctgtataatatatagcaaaataatctgcaggattcacctgtttaggcgataaagtatttgacagtccacgaactataaaatctcgattagaatatattttcataatggatccatcaatatatttcatacttcttgggtcaataggtacataccctcccttaggactaacaaaatcatactgaactccagccttatttaactcgtcaacaaattctgccgcttcccccagccataagccggtagcttcataactattgccatatttttcaacatttgtttcaactattaagacctttttcatgatttttcctctattatttctagggtattatctaacaagtcttttaatctttttatattatccatattgtgtgtcagatagtagtgatttttggtgccttctcttttaaaatctaccatgttaacactttttaatacttttaagtgatgtgatgttgctggtctcgacaaatttattttgtgggctatttcctcaactcgaagtccttcacaagaaagattatcaagcagtgccataataatatcctgacgattcgtattacccaaagcctgtaaaaatccggtcagatcagagaattgtgtttttaagtccattttatctcctattttctatgaacattcttttaatagtttaataaattaaaccattaaaccgttaagaagtcaaaagattaaatttttgtgtgttttaaatcaatttcttagatatcaaaaaaagaatatacatacaatatccctctatctaattttttcttagtagctattcctttgatatttttcgtgtcatgatttgatacaacaaagtttcattatatatgaaattaagtgttttaaaagaattgaagtgactctctagttagatgtttaattgtttcaaaaacagaataaagatttataatagctttaatactgaccacaatatttacttattttagagaatgtgaatttatcaggaaatttaagcctctttatgcaatttttcttagcactattcaaaaattgaataccgagtctatatatacaaacatcattcataattagtattttacaagtaccggtataccatttataataaactttacaaaataaaaatggagatcaattatggtagtaaaaattacagataaaatgaaatttagtcaatcattcgattatgtagataatggtatggaacatggtgtattaagtaagtttggacctaaagaaattttattaaagaaaggaacacttatcgctgaaggtttcaaaccgttggattgtgatatcaaattgcttaaagatatccctgtgaaattaagagatggtgtaactatttacacggatatctacttaccaaataaaagtgagaaagttcccacacttattgcttggagtccctatggtaaaagcgctgggactgcgcctcgctataaaaatctcttcaatatgaggggggattgcacacagtgaagtcaataccactatgatagggtctcaagaagctcaagatggttatgatttaattgaacggattgctaatcaagaatggagtaatggtaaaacagcacttactggtacctcttaccttgccttttctcagtgatacatagctgctgaacaacctcctcacctcacttgtattaatcctactgaagggctctcagatggctatcgagatttggcctttattggagggattccagataaaaacttcattgagagactacaagttaatcatgtaagtgcaaaaggagtaaagcgagaagacttggtaaaagaaatggggtgctaccctctagccactgctgcagtttggaaagataaagtagctgatacatcaaaaattactgtacctgcttttgtcattgcaagctattctaacacacttcatacaatgggtactttccgctcttggagaaacttagtttcaaaagaaaaatggctgagaattcacgataagcaagaatggccatactattatgataaagacaatgtggaagaattgcgtcgtttctttgattattacttattagataaagataatgactggaataaaactcctcaagtacgttattcattaatagatttccaaggaaataacactaacgatatctcagcagacacatttccaccctcagaaacctcaaatacaaaatacttctttaatccaattactagaattctccaagatacagcggggaaagcggatgttgtattacgatacgatactcaaagtttgccaggaaaaatctcctttcaaaaaacttttgataagaaaactacgtttataggttatcctaaggttaagttatacatggaagttgaaaattataatgatatggatgtatttgtgtggctacaaaaactagataaatttggtaacgtactaagtgaatttgttgtacctaatcacggtgcagcattgcaagactttacccaaaatggtgcctcagcacttcggtataaaggtgcttggggtaggttaagagcttcattgcgccatcttgatgtagagcattcaactgacgaaatccctgcttatagttttgatcgagttgaaaaactctctgagaaacaagtggtagaacttgatatcatcttaagcccaatcggtctatcctacgataaagatgaaacacttagaatcgttatatgttcaaaagatgaacttggttcagtaatgccaggcacacctggttgcactcccgataatgcaggggttcatattttacatactggaggtattaatacttcttatcttcaacttcctcttctaaactaattattctagcttttaccatatgactttacggatcatttatgatattctaataatgatcggaggtcagatgaaactatcaactctacgatattttgttgagatatcaactgagaacagcttcacaaaatttatttatatctcaaccaactttaagcagaaggatacaagaattagagttagagttgggggtaacactctttaacctcagtaatacaaataatataatcctttctccagaaggtaaacaattactggtaaaagttagagaagttttagaccaaattgactctatatcatctatgtttgagtctgacggtcttaccgagaacaatggggcattaattaaagttggttgcttatctaattttgactttagtaaattatatgatttaatagagcagtttaaaacacaatatccaaatgtaaaatttgtaattgaacaaggttctcctatggaactaagtaatggacttactgatgacgactatgatttagtactgaatttagaggattatattcctcataataataaaattaaaacttctttatttaaaaccaataatttacaagtggccattcaaaataatcataaattagcaaccaaaaaagaaataaaattttctgatttagctgatgaaactctcattctcattgaacgaaataaatccccattagtatttgattatgtgattaacaagtgtttgcagcatggatttcatgcaaaggctaattattatgttaagaatttagatgaaggactttctaaaacatcacttggtgaagggatcgcatttctttactttggcatggataatggttatttatcaaaaaaatatcgtgtaaaatttttaaatttgaacgaagagagaagttcacaaaaattggtttatgcttttaaagaaaataatcatcctatcttagatgcatttttaaacttcgttcatcaaaatagatctaatttatactaaaaactcagcttgctatttattgcaagatgagtttttgactgaccataattattttatatgttattaataccaatccgctttgtacaagctttttttatataaattagtaatcaaaaagcacctaattgcgacagtcaattttttacatacattttattatgcataaagcttattttaatgtaattggtgatagaatgagctaatatattttttgctactattgctgctgcagcaatggaattaatactcaaagaaatataattgtttcttcaagatttaatacttaaaaatcgtgaacaatcttcactaaagatattctcactcaaaatcttacttaaattttgacttacatttcgatagatgagtgatggagtattaggaacaacataatagtattttccatcattttcgtagatagggtcatccatactagtaaaatgtgttccttcaattgtatttccagcatcagctgctacatcaataattaaagtcccttttttcaatgatttttgttctgataaacttaaaattgaatcatcatctttcccaatttcaattccattgataatgatgtcgtactttgtataattttctttgaaaattgacattgtttttcgataatacattcggatgtttgaggaatattttgagataccactaaaggcaccctgcgcaacatttccagaacctaaaatagctatttttgtctcttcagttggaataaatccatattgcaacaaagcatctataacccctgcatatcctgcgtaaaaactatttttatataatagtcccttcggaatacctgattcaaatatctcattttcataataaatacaaggagagttactatctaaatctactacaattaactttttaggtagagcttgctctttcatgaaaaattgtcctgaaccaaaaggatgtgtccagcctataatcatctgtccctctctaagatgggaatagtcagtaggctggatgagttttagtgagaagattgcttctgattgagcaaaaacttcagctcttgataaaatgtggcatcctttgtcaatgtattcttgatcatcaatatcaagaaatcttccaaacccctcctctaccaatatttcatttttaaaatctttaatgtctttcggtagaagtgggactcgtctttctccagggaagtttgcttttactaggccaattttcatagtttttccttcttttcttaataattttataaatttttctaaagagattttttcttttttaaccagtaccaaactaatacactgattagaagtgaaataacaattacaagtaacgaaccataagggacaccttgaaaaggcaacttgagatttattccccaaaacccataagtaattgttggtattgttaagacaacagtaagttcagttaacgttttcataatattgttcaactgaaacgaactattattatttataattgtatccaaactagaaaggtacttattataagctcttaccaaagagtctaaggtatccattctctcttcaagaagagttacttcattttgcatatgatactagacaaaaggtcggctcctaaaaatgcgtttgtgataaacaccattttaaaggaagctggtcttttttgtccgaacagcgtcggattaattttacaatctacctattaaccaaaatatcaaaaaaagcgtatcattgaaagcgtaatgattaaaacgttttttacaaacgttatagaggggagaagttaatatggacttagtcgaagaactagtcaatgttgttggtaaaaaaaatgttattactaacaaagcaaaatctttacgttttaggaaagggtaccgctcaggtaagggcgatgcagttgcagtcgtatttccaaccactttaatggcaatgtggcgtgtgcttaatgttttgcatgataacaatattatcattattatgcaagcagccaacactagtttgactgagggatccgtaccagccccaggttatgaccgttctgcagttgttgtgaacggcatgaaaattaaagatttacagttaatcaataatggggaacaagtactagcattccccggtacgacactgtttcacttagaaaatgaattgcgaccacttaaacgtgaaccacattcagtcattggctcatctaatttgggtgcatcggtcattggtggtattaacaacaattctggtggtgctttgatcagaagaggtccagcttatacagagctatcattgtatgtttggattgatgaacatgacgaaatgcacttagttaaccatttaggcattgatttgggcaaaacgcccgaagagattattactaatttgcagaaccgcaattttgatttgaatcaagtaccagctactgaacatcatggttcaatgttccatcatgaacaggttgtgcgtgacgttgaatctgataagcctattcgatacaatgcaaatcctaaagaattgtatgaagtatctggatcgtccggtcacgttgcggcattggctgtccgcttagatacattcccaatggataaaaaaacacaaatgttttacattggaacgaataatcccgatgagttggaagatattcgtcgccatattatgacgacattcaaagaattgcctgtttctggtgaatatatgcataaaaatgcttataaattggccaagaaatatggtaaagactcactaattgtgattgaaaaaattggtacgggtcatttgccccaaatgtttgcgctaaaagcatggggcgaacgctttttgaagcacattccgtttttcaaaccttatttcccagatcgtttgcttcaaacattaagtaatttatttcctaatcaaatgccaaagcggttagatgattattacgaaaagtacgaccattacctacaattgaaaatggctggtaatggtattgaagaagcgcgagagtatctcaaatcttattttgacaaagccagtggcgactactttgaagccgatgccaatgagaccagtaaagcggaaactcaccgctatgtaacagctggggttgcgattcgatatcaagaattaaaacaggatagtattgacattttgccactagatatcgcgttggcaagtaatgattataagtggttcgagcatttgcctaaagagattgaagacaaaataaaacacaaaatttattatggtcacttacttgatcacgttatgcaccaggattatattctaaaacctggcgtcgatgcgcatgaacttaaaaaagaaatgcttaaaattttggatgagcgtcacgctgtttatccagccgaacacaatgttgggcatctatatttggcagcaccggccttaatcaagcactataagaaaaatgatccaactaatagtttcaaccctggcgttggtaaacaaacaatgtctaaatattggggcgaatactaaaataaaaagtttgttaaaaaataaccgttatcgtcatttgtcgattctgtagtgacccctactgattgttcttaaaacagtaaccaaatatttaaagatatactttaaaaaaacttttttaaaaatttttaaaaaagttttttattgttttttatatgataaaatatagctattaaaagatttaataaaattaaattgaaagtttttttaaaaatttttaaaaaaattttatagaaaaagaaaggatattttttaaatggagaaaagttattctgattttgcaaaagaactgggagttagtaaacaaaagttaaattattacgtcaatgatgaaaataaagaaaaaatttttattaaaaaaggcaacaaaaattatgttaccgaatttggacaagaatacctttataaaaagactaaagataaaaatgaaaaaaaagaaagcgaaaaaaaagaaaaaaattttgaggtattttttgatagcataaaagaaaaagataagcagattgacaaacttcaccaattattagaccagcaacaaagactttccttacaggataaaaaacttttggaagaatataaaacagaattaagtaacttaaaagctattaaaatgccagaagaagaattaaatataggaatcgagcaacttaaaaaagaactcgaaaaggcaaatgatgagatagaccaaaatcaagcgaaacttgctgaaaaggacaaacaaattgagaaagacgaaaaaataaacaaagaatggtctgaaagtaacaaagaactggaaaaagaaaacgaaagcttaaaaatggaacttcaaaaagttcaatctaaaaaatggtttcaattttggaaatagaaaaaggaagaaattttataaatgaaacatgttgataatgcactaagaaaaactttattcattcttttaggcttaatctctttattttggcttttttggacgttcaaatatttatttactgacaacttgcgtagcacaagatatatttttttgtttgtcactattcttttagtgttgcttatattttttttaaataaaaaatttaaagacttattatttaagacttttaaatttatttatggacataagtattggtttattggtattctttttattttacaagtagttatatcattatttgctcaggctttagcacaaggagattctgctgtcctttatactgttggtactaatatacctgatacgaaacaaacaattctaaaatacttttctatctatcccaataatttttttattctaattataatcaagattataaatagcattgttacccctaaataccttatattgtcattttctatactgaatgctttattaatagacagtggaattatcttattaacttctatcggtaaatatcttaaaggagaaaagttagcgcaaattgtatttatagaatcattttttttgattggtctacaacctcaattcctttatttttatactgacccaattacctttttcttcacaagtttactttgttttttagttgtaaaatatacttataagaaatatttaatttggtggtttgttattggtctaatttttagtattgcttataaaattagagtacctgtcgttatttatcttatagcattaatcattgttgttatatatcaattggtcttttcgcctgaaaaaataaaaaaaagaaaattagtcaataaaactgtcgttttgtttagtggaatactaataacaatcatcggaattaattattatgctcatcatcaaaaaataacagaatatgatacaaaatatagcaggaattttatgtatttcattgatttaggactaacagatacaggagcaaaccattctcaattacctactgaaattctaattccagaaaaaaatggaaaaattcaaacaagaacacaactagaatctaaactaaacaaagatataaaaaacagaattaaaaactatggtatattaggtcttattaaacatcaaaatacaaaatttaagtattttgttcaagacggtactcttggttggacaaccgaggctgtgttagtagaaagtaatgttgtaaaaacaaaatttactgaatcaacaattggtcataaaataagagatattatttatgttcatagaccgtattaccccaaatatgcgatatacatgcaaataagttggatttttgttgtgctaggactagtcctttactttaaaaaatataaaaaagttacctatactgaattagtttttcaacttgttttattaggagggattctattcttatcattatttgaagcaggaagaagtcggtatctaatacaatttttaccagccattatactattatcatcaataggttattttaaaatgaatagctccaaaagctcataatttaagttttaagcacgatcaacccttaatcggataaatttataactcactcatttaaacaggatctaacgttcaaaaaatgctattctcgtgtcttttatccgaaaagcccttcctgcgttagttctttcagaaaataatgttctcttttttaatcgaggagtacaagcggagcgacaaaagcaaacaggggatcttgaacttgtcgctcacttttgctatactaaagcccttaaacataagtaaaagcgctaatttagcgctttttttgttgattttttggaaaactttgcaacagaaccgtttaaccttagatatttggttacgaaagaaacgggatatgcaagcagcctatgttttcttaaaaagtattcataaacagtttggtcaacatagagtcatcgtaacagataaagcaccttctcttggctccgcctttagaaagttacagagtgtgggtttatatactaagacagagcaccgaactgtgaagtatcttaacaatttaatagaacaagaccatcgacctattaaacgacgaaataaattttatcaaagtctccgtacagcctcttccacgattaagggcatggagaccattcgaggaatatataaaaagaaccgaagaaatggaacgctcttcggcttttcggtgtctactgaaatcaaggtattaatgggaataacagcctaagatatttggagttcagagagggggcgtttgattttcaaacttcgcaacagaaccaatttgtccaagatattgacccaaatacatattatctgcaatatttacttaataactgtaattgagattggagaatttttaaccatataagtagcatgcgaaccaaaatatcctttaattccatgcattgatcgcgatccaatgattaagatatctgcagatgttgctggcaaaatcgtcttagtaatttcctcggccggatcaccttctccactgtacagctgaatgttttttacaccgctattttctgcatattgtttgtacttttccaaattaagtgacaattgactttgtttctggctcaagtactcagggtctaacgcttcataaacattcagctcttcaatttctaaaattgaggcaatcagtaatgcggctccagttttactcgcttgctttacagcatattgaaaggctttttgagctccttctgattcatctaccccaactaaaatatttttaaattcatcaaatccttccatagtgcttcttacctttcattaattaattgattatattttttatttcctttatacagttcaataattgtccacgctaacagtagtaatactgcgacgataatgacataggcaatagaatcagctagtacaagttggcttgatgtcaccttttcaccaaaaaaaccttcaatttggccgggcaatccaatcaaatttaaatatgtcaatccaattactgaaccccatcctattatccgaataactatcgaatttttaaaccggcttcccatttccacctcactattggtcatcattaataatggtaccatcgaaaatggtaacgcaaaagctaagaagacttgtgaattattcattagtgtatttaacgctgtgtgctcccgaatcgttccttgcctgcttgtaataattacacagattaacactgggataactgaaatcaaacgcgtaattaaacgtcttagccaaattggcattctcatatgaatgaatccctccataattacttgtccagttaaagttccggtaatcgttgaattttgtccagaagctagtaacgcgactgcgaataatgtagaaagaagacctgattttgcaacggtgattaaaattccgttactcaatgtatccgaatttgataaagcctcatacaacccaaagaatgatggatctttcactgcccctgttttaaaaacagcaactcccattatgagcaataaggagttaacaaaaaaagcgagagtcaattgaatgttagaatcccatgttgaaaatcgtacagcattggcgacttcatcttcatccgtacgatttatctttcgagtctgagacacagccgaatgtagatataaattatgaggcataacggttgcaccaataattcctaatgcaccagttaaaggcgtttgaccaccaattgaatgtgtagaggagaacgtttcaccagtcggaaccaatcctttaagtacatccccccaattaggatcagacaacgctacttgataaacaaacacaaaaagaattacaaaaatcaaacagacaactattgcttcaatttttctaaaaccaactttcgttaacaacaataataataaaacatcaaataccgtaataaagactgcgacgacaagcggaatattaaaaagtaaataaagagcaattgatgcgccaattacttccgcaatatctgttgccataatcgctaattccgttaaaatccataaaatgattcctagttttttacttgttctcgctcgaattgcttgagctaaatccatttgactaacaattcccaatttagcagccatatattgtaatagcattgcaattaaactagacattaaaatgaccgacattaataaatactggaagttttgcccacccgtaatcgaagtagaccagttgcctggatccatatatcccacagcaactaatgctcccggtccagaataggcgaacagggttttccaaaagcctttgcctttgggtaccccgacagttccgttaatttcctctaaagagggaccattcgcatgctgaattaatcgaggtttgtgctctttaccagactgacttgttgtatctttcaaaatatttccaccttcctttaagaatattataagtatacacctcttttttataaaattaaagcaaaatattaggcaaacctaaaaaaaaataaacatcgcctaatttaatattatttgccttcatttcatttgtatcggaatgaatcaattgtacactggaccaatgtcaaatatttagacacaaaatgagctatattttcttaaaataattttcttctttctgatttggagttaaacccttgttggcggaatgaggattataattgttataaaattgttcgatgtattcaaagcaagagagttgaacttcttgaatggagtgataagttctgcgattaatttctcgttgtttaagatacttgaaaaagacctcagtgacggcattatcataaggatatccaggcttggagtaagaagcaagcaattgatgctcatctaataactttctaaaggaagctgatttaaattggcttccttggtccgaatgaaagataattggttccttaggcttcctcttatttatagctatctctaaggtgtcacaggcgagtttagcatcaattcgatcacttactttccacgcaatacatttccttgagtagaggtcaagaatagcacagagataaacatgtcgtttaggtcctatagagatataagtgaaatctgttgtccaaacttgatttggggagttcgggttaaattcttgtttaagcagattatcagaagaaaatacaggagatttctttgatttaaaacgaggtttgatggttgacattttagggagtgtcatagacttgagaagtcttaagatacggccttcagaaatattaacgccataatcacgcaggagaatgattttaaaagctctcgttccaattcttttcttggctttcatataaatctcaaggagtaattttctcaagcgttgattttctacttcacgcttcgaaggcctcttgtttatgaagttatagtaggtggaacgattgacatgtaaaacacgacagagcataactgtcgtgtgttcaaatcggagtctatagatggctttcaatcttacttggagttttgcatgaatatggcactcgctttttttaagatcagattttcttcctctagttgggcattccttttttgtaatttttgaatctgtttagcagtcaacaccgtattatcttcaagacgcacttgagagtactgcttaatccattttgcaagtgcagaagaagataccccataatctttacagagttcagtttgtgttttaccagtttgatagagattaacaagcgattgtttgaaatcctcgtcgtaacgtttaaaaactgacataaaagtcctttcatttttgtgtcttaatagacagattataacacacaattttctgtccacttttatagtatagctccatggcacgtgttggtgatcttttaggaatcaactatctagggacgcataccatgcgtaaaacaggcgcttatcgtgtttatacgcagtcgaattataatattggtttagtcatgcatttattaaaccattcaagcgaagccatgactttaacatatcttggattagatcaagctagtcgagaaacgatgttagaccaaattgattttgggtaatgaatgtttagaacttagtagtcgtccaaaaaacgactacttttttagttgaatcgtccaaggacgattcaatgcttttgacttgtaagaacaggattgaatgaagccatactgttcgcatatttttagtggatgaacaaacaaaatacgagagattttttgttcgttcatccatggttttagaaaaaagagggacgatttcggaagaagaaaatcgtctctttttttttcttctttttgtatgacaaaaagaaagattttttgcccattttatttttataaaatgggtaggtggcgtttgcgtaaagcaaatcgacacaatccaaaggggataaaaggggaaagtaaaacttcccccttttcaagccacattgtaatacaagaacgaagtgatttgtattacaatgtgatagcttgcagtatttatggttttatatggtctattttgttataatgattgtaaccgaatagggcgcaatgcttattacaaaatcaatgacaaagggcgattgaggaatgagcgctggggcattttatctttgaggaggctatttatggatcagaaaaatgtatcacaaaatcaaacaaagtacattcaatttagattgtctgaagaacaatacaataagctgaaaatttcaggagaaacatatggactctctccgaatctttatgcgaaaaaattagcacaaaaatctcatttaaaaaaaccttatctcgaacatgaccaagcgaaatctttattattagaactctcaaaacaaggaaccaatttaaatcaaatcgccaagaaactcaatcaattcgatcggatggacaaccaagataaagagctgatcgaggctttacgctatacatacggagtactcgctcaagctcaaaaggggtatcaagagttatggcaacaattgcaaaaataagcaatggcgcaagtgcagcgagcgcccttaattatgctttagggcaagacagacccatgcatgaaaaaactgaacagtggctacaagaccatcaattggaacgtcctgtggagctgacaaattgtcgggcagttgccgtgggtggaaccaacgggattgatccctttatcgccaaagaacaatttgatgtcattcgacaacttcataaccaaaccaaagaatccaatcaggtcttgcgtattacccaatctttcgccttagatgaactgaatccgaaagtacaaaaggactggcaaaaagccaacgatttaggcgttgaattagcagaaaatctctatcctaaccatcaaagtgctgtgtatacgcatttagacggaaaaaatcacgtcttacacaaccacatcattgtcaataaggtcaatttagagacaggaaagaaattaagagaacaaaaaggagaaagcgttcaacgagcacgagaaatgaatgatcgactcgcttctcgagaaaactggcacattttagagccaccaaaagagcgccaaacagagacagaaaaagaactaatcgccaaaaatgagtattcttacatggatgatttgagagaaagaatcaataaatcgcttcaagatgtctctgtgagctcatatgagacgtttaaagagcgcttatccgataatggtgtaattctatcagaaagaggccaaacgttctcatacgcctttttagacgccaataataagcaaagacgagcacgagagacccgattgggttctgattttggaagggagaccattttacatgagttggaaaaccgagcaagacaaaacgaatttagcgctgttgaacaacgagaaccagcgattactccgcttgagcgagacactcaacaaagagaatcagaaattgttagccttgaacaagcaattgaaccaagaaaatcagaagctctcaagcgagaatcaaaaattaatcgatttattgacacaatcaaacagtttgcaggacgagtaccagaacttactcaacgcgttacaagaaaattaaagcaaacaaaagagaaaatcctcgatgattttgaacgtcgcttttcaaaggacatgaaaaattacgagcaagaacaacagaaaagcctagaaaaacaagcgaatagagacgtacagtccgaaaagaaaccaacaaaagatcatgatcgggggatgagtcgatgaataaagatgaacaactcgttgttcaagtattaaatgcttataaaaatggaaaaattgatttcagtcacgttccagaactagacctcttagtccgtcaagaagttaataaagactttcgggactaccaagaaaaaatagaagctgttgcgaatcaaaaaatggagtctgccattcaagaacaactccatcgtttagaggcagaaaacttaaaagcgaccatactgaaagacattcaagttgaaaaacaagcattactcgctttgaaaaaagaactgaatgaacaaaaagagcagataaaagcagatcgcaaacgtgagattgtcgaacgttacggtattctgattgcgaatattgtctgcctgttctgtttcttagttgtcggtattctcatcggacgatggatttataaaggtatctgggatggttggggtttgcatattttgtatgacacagtgatggaaatacagcctaaacatccttatggggcagtcgttcttggattaggtggttttggtttaatcggtgctggaatttatggcagttttcgattaatgtataccgcttcaacatggtttgatcaacgtccaaaaattttcaaaaggatctttccaaaaaaatagagagtgaggggatattttggttttagacaataaattaggtttaacaaattcagcagaattagctaaacaagaagaaatcttaacgaaaaaaagagccaaagaattgtttgagtctggcaaaatagaggatctggaaattgggacgtttcaaggcttatctgatattcatcagtttttattccaagatatttacgactttgcaggaaaaattcgagaagtgaatattgcgaaaggaaactttcaatttgcgccacgtatttttttagcgcaaacacttgaatatattgataaattacctcaagaaacatttgatgaaattattgataagtactcggatatgaatgtggcgcatccttttagggaaggcaatggacgagccactcgtatctggttggatttaattcttaaaaataaactacacaaaatcgtcgattggaatcaaattgataaggatgaatatttaaatgccatgatccgtagtacagtcagcaccaatgaattaaaatatttgattcaaaaggctttaaccgatgatttaggaaaagaacaattctttaaaggaattgatgcgagttattattacgagggctattatgaaataaaaacagaagatttataaataaccgatacaaacagactgatcaaattctatattgattagtctgtttgcttacgggatgattttgacttttgattttaaatttttgaaaaaaataaaaaaaggcgaagcctatattaatttatcatatatattttaatcttttcttcttttgcgtcaaaaaaaagtgagtgttttcaaggggttaaagaataatatgtggagaaaaaactgtttatatatggagaaaaaactgtttatatatggagaaaaaactgtttatacatggagaatgtctattatcttctccatgtattatggtataataaaagcatgaagaaacacttttcgtcgagagaatcttcatgcgtatctaaaaacactcaaaggagcgtatttctatgtctagtataccaaaaaatgaacaaaatcagaagcaggtgcaaatcttgaacgaattatcaaaacgaaaagtagtggagcataattctttaattaccagcattgccaaaatggataaaaccccactcaaaatgtttgagttagccgtatcgtgcattgataccgaagaaccgcctaaagatcatacagtctatctctcaaaagaagaactttttacgttttttaaagtttctgataatgacaaacatagtcgtttcaagcaggcagttgagaatatgcagaaacaagcttttttcaaaattaaagaaaaaaaagaacatgggtttgagtttgaaaatatcgtccctattccctatgtaaagtggaccgattatcatgatgaagttactattcgatttagtcctgaaatcatgccttatctaatcaatcttaaaaagaatttcacacaacatgccttgtccgatatttcagaactcaatagtaaacattctatcatcttgtatcgttggttatccatgaattataaccaatacgagcattatagttataagggtggacggagagaagaacaagtggaagcctaccgcaatccttcaatttcaatccgagaattacgagaaatgacggatatagtcaatgaatataaactttttgcagatttagaaaaatggatattaaaaaaacctttggaagaaatcaatgatcatacttcttttaccgtgacgtatgacaaagtcaaaaaggggcgctcgattgattctatcgtctttcatattacgaaaaaacgtcgagcagacgataacagctacaagttggaagataaagtctaccaagaagataaagcacgtaaagcagaaaccgaagacatgctgacggtacaagccctaaaaagtccgtataccaagctgcttatggaacatttcttattgtcttatctagacttgacggatactaaaattctttcaggcttacaagcacacgtgtaccctctctatgacgaactgaaagacttacgaggtttgaatggggtcaaagaccacttgtcttatgtgagagccaagcgagaagactactcaaagaaaaatatcactaagtatctcaaaaaagcaatcgagcaatacctacccacggttaaaaggcaggacttatgatgagtgaaaagttaaagacaatcaaagagcttgcggatgaaataggtgtttcaaagcaagctgtatggcaaaaaataaaaaaagaatcgtcaatagatttacgtcaatttacgtcaaaaaaaggaaataccgtttacgttgacgttgatggtcaaaaagttattaagaatgctttttttaacaaaacgtcaactaaaaaacgtcaacaaaaagtttttgttgacgacaacgtgaataattcagttgatgacaatccagaggggaatgaagagattttatttttaaggaatctagtgtccgaactccaatcagaaaaaaaagaccttcataagctattagaccagcaacaacgtctagccttacaggataaaaaagtactagaagagtataaatcagaaatcaatgaattgaaagctcttaaaatgcctcaggaggatatgaaagatggctcgtcgataaggggtgaggcgcaggaagaaattgaacgactgaaagctcaattgaagttatcagaagaagaacgaaacaaggcaaaagaaaaagagccggtaaaaacagaatctaaaaaatggtggcaacgatggaaatgagggggatcaaatgagtcattcggaacaaatgattgaaaaccagttcatacagatcttaagtgagaaagaaaatcagtggacttatcgtccggacttgaagtcggaagaagcactttggcaaaactttagaagccatttgaaccgaataaatttagcagtattggaagaacaactattaacggacaaagaatttaagcaagtcaaagtcgagttttcacgtttgaccggaacaccttttttagcttctcaatggcttagaggagaaaacggggtggctcaagttttattagagcgagaagatgggaaaaaagtgactttagaagtctttagaaataaggatatctcaggaggaacttcttcttatgaggtggttcaccaagtggtcccagattcctctagagtagatcgtggagatgtgagtttgctgattaatgggctcccaatcattcatattgagctcaaaaaagagtccgctaaagacggtttcatgcaagcttattatcaaattcagcgttatgcagaagatggattttttaaagggatttacgcaactactcaaatcatggtgatttcaaataaagtcgatacccgatactttgcaagacctagtgaagataccgctgaagcctatgctcagatgaagaagtttttatttaattggcggactgaagacaatcaaacggttcctgatttgtttgattttactcgtacagttttgcggatacccgatgcccatgaattgattagccaatataccattctcgtcgatgatcaaaaaaatcaaaaattcctcatggctttaagaccttaccaaattcatgcgattcgtaagattcgtcaaaaagcggcacagcatgaaggaggattcatttggcatgcgacaggttcaggaaagaccattaccagttttgtcgcaacgaaattattagcacaaaatgcgatcggtgtcgatcgtacggtcatggttgttgatagaacggacctagatgctcaaacgcaggatgagtttacgaagtttgcctcggaatatcataccggacaaacgaccggaaattcggtagccaatactttgattgttgggatcaaaaatcaaaaacagttggctcgaaacctcctatcatcaaaaaataataatacgattttagtgaccacgattcaaaaactctctgcggctatgcgaagtgcccaacaagagagtgaagaaaaaggctccaatcaatttgaaaagctacggaaagaacatattgtttttattgttgatgaggctcatcgtgcggttagtgatgaggaaatgaagcgaattaagaaaatattacccaattcaacctggtttggattaacggggacgcctatttttgaacaaaataaaaagcaagaaaatggaacctttgccagaacgacgagccagcaatacgggccactccttcactcctatacaaccaaaaacgctatggatgatggcgctgttttaggctttcaagtcgagtatcattcactgatttcagaagaggatcaagaggtaattgtcacccaactcaataaaggaaagttaccagacgatgtcttacaacaagaaaaattgttgcctacggaactttatgaaacagatgaacatattcggaccatgttacaaaaaatctttaatcggagaagtgtggtcaaaaagttcaaggtacagaatggttttcctacgatgtcagccattcttaccactcactcgattgcccaagccaaacatatttaccggattttaaaggaaatgaaagataatgggacactcttgaatgggcgacaatttgatgaacgtcatcaactgattgataaagatttcccaagagtagctattaccttctcaaccaatccggatcaattagaaaaaaatgaacaagacgatgaattagtagagatcatgaaagagtatgcgaaacagtttgatgcttctccttatcaagatgagaaactctacaatcaaaatattaataaacggttggcccgtaaggaaaagcaatatcaatcggatggtcagtggctagattttgtcattgttgtcgatcgtttattgacaggctttgattctccaacgattcaaaccttatatattgatcgagaaatgaactatcaaaagctccttcaggcgttctcaagaaccaaccgtatttatacaggaaaagattctgggttaattgtctcttttagaaaacccttcaccatgaaagaaaatgtgcaaaacacgtttcgtctattctcaaatgaaaagcaaaactttgatcaactgattccaaaagaatatgaagaagtcaaaaaagaatttatcgaatgttcaacactttataaacaaagcgaagccgacctatcggataatcccaatgatcttaaaacgatgattgcgcaagtaagtgcttatcaaaagctagaaaagagttataaagcgctccgaagctatgatcaatacgaagaggactttgaagcattttcagaagtagtggagcagttgccacaatatcaaggaaaaacggaaaatattaaaacaaagattaaagaaatgatcgaggatgaggggcatcctgaggaagacttcgagaagcttttacaagagattgctttttcttcgcagctcaatgcgacacataaagacgtcgtggatagtttttatattaatcaacttttgaaagcgattcaattaaacgaagcaggggccgttgaaaaatttgaaaaagaaatccaacaaaaggatcctcaaatccaaaagatgtatcacaccttgaaagatcaactcgtcaatacgactgaagagattgatgtagctcaattaaaagagacatcgattcaaaatgaaattcaaagacaacttcaaaaaaaagccgaagaatttggattatccttcgactttttacagtctgcaatgaatgaatatcaaggcgataagaaaacgatcccttatttaaaccatttactggattcgatgacccttagtaaagaagagtttgaagccaaaacgggtgaaaaatacagaagaagaacaaaagttttagaagaacgactacaacaaaactttgaacaacttcaaaaatggaaagaagaattataatggcgacaggtttaaatcaacaactatgggcttctgcgcatatcttacgtggaaagatggatgcaagtgagtataaaaactacttactgggattaattttctataagtacttgtctgatgcgcagctgagagaagtttatgaacaagaaaatgggaagacagataccttcccagaacgttccactcagtatgcaggcttcatggaatggtacgaagaagacaaagatgatttaatcgaaaatatccaacccaaacaaggctactttatccaacccgatcaattgttttatagttaccgcatcaaagcagacaactatgaatttaatttgaccgatttacaagcaggttttaatgagttggaacgtcaaggagaagaattcagtggattgtttgcggatattgatttaaactccacaaaattaggatcaaatgcacaacaacgtaatgtgacgatcactgaggttttgcgtgccttagatgagattgatttatttgaacacaatggcgatgtgattggggacgcttatgagtatttgattggagaattcgcgtcaagtgcaggtaaaaaagccggtgagttttatacgcctcaagctgtttcgaaaatcatgtcagaaattacgtcgattggacaagaaacccgtgcgccttttcatatttatgatcctgcgatggggtcaggttctttgatgcttaatatccgtcggtatctcaataatccagatcaagtgcactatcatggacaagagttaaatacgacgacctttaacttagcacgtatgaacttaattcttcatggaatagataaagaacgcatgaacctgaataacggagatactttagatgccgattggccctcagaagagccttatcagtttgatgctgtagtcatgaaccctccttattctgcgaaatggtcagcggcagataaatttctctctgaccctcgttttgagcgttttggaaaattagcgcctaaatctaaagcggactttgcctttctccttcatggtttttaccatttgaaagaatcgggaacaatggggattgtccttccgcatggcgtgctctttagaggagccgcagaaggaaccatccgtcaagcccttttagaaatgggagccattgatgcggttattggcttgccggccaatatcttttttggaacgagtattccgacaacggttattattttgaagaaaaaccgctctcgtcgtgatgtcttatttatcgatgcttctcaagactttgaaaaacaaaaaaatcaaaatgtcctgttggatgaacatattgataaaattgtttctacctacaaaaagcgagaagatattgaaagatatgctcatgttgcaagttttgatgagatccaagaaaatgactttaacttaaatatccctcgttatgtcgatacctttgaggaagaggaaccggttgatttggttgcagtgaataccaatctccttaaggtcaatgaagaattagttcaacaagagcaagtgctcttatcgttgattgacaatttttcagaaagtgaagagaatcaagcattgattgattcgatgcgtcttcttttgagaggtgggcatgatgagtaaaaagagtccacaattaaggtttgaaggttttacggatgattgggaagagcgtaagttctcaaatttagctgaagtaagacggggcttaacatataagccatccgatgtccaaaaatatggtattagggttcttcgttcttccaatattgcagaagatacttttttaattaaatcggacgatgtctttgtaaataaagaggcagttaaaattgacaaagtgaaaaatggggatattcttatcacttctgcaaatggatctagccgtttagttggtaagcatgctttgattgaagggattgaaaataatactgttcatggtggatttatgcttgtcgcaagggctgaaaaaccggaatttgtaaatgctattatgagttcttcatggtatagtaaatttataaacatttttgtttctggtgggaatggggcaattggtaatctaagtaaatcagatctcgaagatcaaaaggtttatgttcctagtgaaatagaacaaactaaaataggattattctttaaggggctcgacgatactatcgctcttcatcagcgtaagttagatttgctcaaggaacagaaaaaaggctacttgcaaaaaatgttccctaaaaatggggaaaaagttcctgaattgcgatttgcggggtttgctgacgattgggaacagcgtaagttggaagagttaggtaatctcaatagaggtaaatccaaacatagacctagaaatgattctaggttatttggtggcgaatatccttttattcaaactggagatgtagccaaagcacctctttttttgacagaatacagtcaaacatatagtgagtttggaattcaacagagtaaattatgggatattggaacattattaattactatagcagctaatatagctgatactactattctagggattaaagcagcttttccagatagtgttattggctttgaatcaacttcttgtgatgtcgttttcattaaaaattatattgatattcaaagtgatctattaaaaagaaaagctgaaacaagttctcaagcaaatttgaatttagcaaaactaaaagaaatgaatttaaatattccaaaattaaaagagcaacaaaaaataggctcattcttccaacaattagatgaaactatcgctcttcatcaacgtaagttagatttgttgaaagaacagaaaaaaggctttttacaaaagatgtttgtttagggtctataattataaattagataatacattagaagctggagacgagattgtctagataatgtgcgagataaaatttttagcaggttatcatacataagacaaaatgtttttaaaactgataacgtatttattccacaacaattacgcatttatttttgagaaaaatataaagcaggaggattacaatgctgaaaacttattctttaacaaaaaatacattattagtttcgtcagaatcaaatatcaaaaattcgtctgttgtttatgtgtatggtgacgaacgagaatatatcgaatcttttgaacataaatctgactttaacatagacaatatactaacgtttgatgatcgagttgcatatgacacgatgatagatcagaacgatgaaaaaagtttgctcgtaagttttttgtttcccgagatacatgaaggtgggcatctagataatctgacgacatctgttgttttcttggtatttaaaaataagttgataatttttacaaaacaaaaattaaaattcattcccgaactcttatccaatatggttttacatgatgtcgataatttcatgcaggaagtacttttaaagatcatgcaaaaagatttccatgtgatgcttgacgaccttcgtggagtcaaggaaaaaattgatgatttagactcagaaatatcaacgtccggttcactcagaccaacgtttggtgatttattgactcttcaaaaatacatgatagctttgtcaacaacctatggcgctaatcacaaagcgctggatttcattaaaaaaaattttacaactattaatgatattgattttaccacccaaaaaatagttgatgagatatacaatacaagcgacacaatggatagaattattttaggttacagtcaatatttggattatttggaaaatatgataaacaatatgatttcgtatcagctaaacatgattatgaaaactctaacagagatatcaatcgttttgactattccagcaatcatttttggtttttggggaatcgctgtcgatggtcagtttgaaaaatcttcttatggtatttttgctgtgctgattatctctgttatactaagcctaatttgctggtttttgctgcgacgcaaaacatatttgtaaagtatttgtgataccccaatatgatttaaagcagaatttctttgttggcttattaaaaggctgattcctttcagtaattgaatagcttcagcggcttccttccagtatgagagttagaatattcaaagatagccatatatcctctgacaattgatatgttgattaaatggtcacatgataagggtataaacgaaaagttgtttgggatgccagactagggactatactagaaaacatcagtacattccttagctcagggtctataattatataatggcccctaggaaataccattaaaacaccccctataatctttagttcatattacaggggttgtttttctgtttattgatataatagttcttaaaaatggaggtgatattttgaaagtgaattggttaaagttgattggaatttttttacctttaaaatgattcatatttactgtcttcaattgctttttttaaaattttaaactaaatacaagtattgataaacttttcaaatatagtataaaagtcctaactgattatatcttgattaatgcattactattccgaatttaagaacttgacttaatatcataataaaaaacctccaaaagtttaaattttggaggtcatataagatatatgtttattttatttgcttactgtggttagaatgaataaaataaatactatagctatactaaaagcacctaaaataatagtattagttgagtcagacttagtatctttagaaaacttagctattatcactgcacttagaatgaaacatagaaatataaaagctaaaaacattgttggagagatgccaacttgaaatttctcaaaaaacaaatgataaatagaagtaactacaactcctaacattcctattatataaagtagggttacgagaaaatttaaattaattaattgatgatcgagatttttattagtcatacttaaaagactttccttaaaaaatttattatatttatattctaacataataaaattggctctgttgcgaaatttccaagttccaaaattttagtgtaaaattgaataataagttagtgtatctataatatattgttcacctatatactttaccaattgcaagaacataaaaaatactaccaataaatgcaactattaaccccagtaataacatccaaataatattttctccattgcgaattagcagaggaagaagaaatcctatcatagatattaatggtgtatatgttcttttgtaataaggctcccaatttaatattaaagaaatcaaacaaatcaaaactcctaataggtagacgataattaacaaaggtgaattgagttgagagaaattaccattaagttgaagtaacccttttggtaaaattgcactcatcttattatagtaattaatatcattactatatctaaccaaatctaatttataaaaagtggaattaaacatgatataaattactgtaacaaccgcagaaaagattgaatagatgagcagacaccaacgttttagattaataagattgatgtacatagttcttacgtcctttcttatattttggataatatcagtatactcccaaaaaaaaaaaatacaagaattttcaaacaatttaaaaaggtcaattacattattaattatttcacattcccttatctaatggatattgttttagtgatcccagaagatagtattatactagatttagggaccggacatggacttgtactgataaagttcgcctctaaaatatcaagcgaaggacatgtgaccggaatagatctatggaaaaatagggatcaatccaataatagttttaaaagcacacaacagcttttacaggaaaaaaatctagaaaatagatctgatttaaaaactgcggatatgatagagctaccttttgaaaataagaaatacgactttgtaaccgcaagtatggcaattcataatattaaaccaaaacagaaccgatacaaagccttagatgaagctacacgtgtactaaaaacagaggggctattaataatattagatactggaaatcataaaaaagaatatctcagttacctgatcgctttaggttatcgtattaaatatgctaagacttatggcattattggttggtggactggcccttggatgtctagctatgctattatagctgaaaaaaattatgatatgattgagaaaggatatctaattatatggttcaacaaatcgttcttcccatcaaagattcgaacgttctaaaaatggtgcaagatacgttacttgatagttttcgggctggccgtcgtaactatacgatcttccaagtcggtaaggccacactactccgtgtgagtgatgtcatgacattaaaaaaatccgatgtctttaacccagatggttctatcaaaagcacggcttttattcatgataaaaaaacaggaaaagcgaatacgttatatttgaaaccagtaaaacaagatttattgatttatcatgattggctggtccaacaaaatcttaattctgaatggttatttccgtcaacctctcgcccaaagcgtcatatcactgaaaagcaattttataaggtcatggcgcacgttggagatcttttaggtatcaactatttaggaacacataccatgcgtaaaacgggcgcttaccgtgtttatacgcagtcaaattataatattggtttagtgatacatttactaaaccattcaagcgaagcaatgactttaacttatctcggtttagatcaagccagccgagagaatatgttagaccaaatagattttggatagtttaaaactaagaatgatagaataaagaaaagagaaaaagggtaaaatcatggataattatgtagataatccactaactatagtgggagtagttgtttttttaatcggaatgagtattttttgctttggaaaaaaatggattgttttacgcttagtttttggtgatagaagtatgttttctcaaatattttttgggggtattataactatctttggattaatcttattgtatttatctggagcttttaactagcatacaagcaaaaatccgaaggcttgcacgtctttcggattttgaatatatacggaaatcaaagttttaactacaaaccaaaaaaatcaatctatttccaaaataaaataagagatataaattttactaatgcagtatctttttagagttgtttcccacttaaaacactctgcccttctctattcactttctttttatctcattttaaactaaaatagacttattaatcaaagcgtaaattaaagtcaatggcactatatctaatttataaataatggaggtgtgttttgaaaagaaaaaagacctatggacagaagaagacaatcaaatcaatttttgatactttagtcgattctatcactacaatatttttatttttacgatagggattttaatttaaatactataaaatttttaagagaggatgataacaatgaaatataaaatgagcaaggggctgaaaatcatgataacagtttttatttctgtttatcttggtaatttggttttagatgtactaagtgacgagtctaatatcaatatttggataggtcgtattattggactttttgttgtcctcatcatttatcttcctttaaattttttatggataaaaaattcaaaaagtcagaatgattaataaagaactgggagaacttaaatgatttatacaattggttattacattgctgttataggattagtcattatgatgttcggttttaaaagtttttattcacaaatgaataaatggagtcgttttggctttatctttttagctttaggccttgcatttccaatattttatgattttattgttggatttataaatggtttattaaaaaatgtttaaatcataattttttaaagaaagggcacttttaaaaagtgtaagtataatattatgggaattgtgacaccaacacctactccacctccttaaaatgataacttttttaagcaaatagaaaaattacaagccaatttttcaaaagaagataataaaatttggactgatgtcaataaagaatataaaaaactaaagaataaaaagtccaaaacagagcaacatgaaaaataaaacaataataaaagcagtttttagtatgattactgcttttattatttcctccaaaactgttgttttacctttgtgtcggtagattgtcgttcttttgtcgtctatctgtcgtgtacatgtttaaaaaaatagtttattatatattcatgaataaatatagagttgctgagttaagaaaaaaaagaggttggacgcaagaagtactggctgaaaaagcaaatataactgttagaacggttcagagaatagaaaatggaacggatgttagtttagatactttagcctcaatatctaatgctcttttagttccagtaagtgaactatttgaaagcattgaggaagaagcaaaagaggtagaaatcatggatatgtctaaagaacagcttattcaactgaaatatagacaaactataaccgtctcaattactttattggttatagcagctatacttttggttatgtcaattttaggtgttgaaattaatgaattagcatctggctataatactacactttcttggctggcatgggtaagtttattattattgttaataggtctagcaaattattatttaggagttaaattaaatgaaatgcttgaccaaaagtaccctcttactaagggcataaaattaaaagaaaaaaaagaacgctttgaaaacttttggcaatttttttcaatttattggtggatgattttcccaatttttggttttataacttggttcatttctttctttaataatctataaagtttttgttatcgagcggagagacaatataatgattaaaaaaaaagtcacatttttttgtagctttttttggctttaccatggtaaacccgttgcttgcccagtcttgaaaaagttactggcaagcaacgggtttgtgtacacaaccctcaaaaagtaacgttacgtacatttttgtttaggagtacctaatacaataccctttaaaaagagtgttttgaataaaactcgctttcgctcgtggtaacgttgaatggataaattttttatctcatattttaaaaaataaattgataaattgagattttaatgttgacaaaaaatttaaaattaagaaatccagaggatagaaaagctcaaacacaaagataagtcttgaaaataaaataaaaaaagaatattataaaattatctataataagattcccgaactaattaaaataccttcaatcaatgagattataccactcaatagaaagagactactatgggatatggatttaactttaaggattacaatgatcgtttaacattcaaaaaatcaacgctcaaggatgtaaaacaaactctagatgaacgagattttgtaaaagccgaaatatccaaaaaagaaaagaagttagttaaaaagtaatagaacaatagggatttgggcacttccaaaatcaacataaaattcaaataagcgtcaacacatggttttgagtttttatttttttgagcaagtgagtacccacttgctatgaccgcgagagcaaaactctccccaaagtgggtttttagaaattagaaaataaatgggttggcaaaagatgactaaattttgaagtagctttacaaactcatatttttcattttaaaaagtcttaagtagtttatcgtaaagtaacattcaaaacggataaaaacatcacattgagcctaatataagtccttccagggtattccaacaaatacttacgttttttcaagactgtcgtatgattttttgtaataaggaatacccacggagcaacaaacaattacaggaggaatgacgattgaaatattttgtgaccactttatctccatcaaaaaatatgggaacaatgaattggcaaacgatgatattgagtgattattgtgtcaatgattcttattgggagaaggcaaaacgagaattatcagaagaagttcaatgggtgacacaaagtgacctttataaaaagataaagtggaatcatgattcgaacgatgacattatattatcaaaaccagtaagtatcattttagaaacggtaaaatcagattttccgcatgccaatgtctgggtttatcaataaaaaattattatgaaagcaaagtataagcttgattattgagtctttttaagcactgtacaatcctttaaaaagactatattatgagatttttctaatttctctattttatataaagctgtggttgagcgatttgaaacactttacaaacactataaatgagaaaaaatcttattcctcgctaaaacaagtcgtactgcgactttgaccaacttttggggacactttcccttatgctcttggataaaaaataggaaaataaaatgagaaacgttttgataattatgagaacattatcataactatcaaatcatcttatgaatctgatataaattattgataaacgtatgacgttcacatactggattagtccgattgtattttgatgctgtttatcaagagcgtaaatatggttctaaaatcgacgaggaaacaggcgaaattttataaatataatttagtgattctatttttacagctaaattagtgaagttattcttgataatttttttattaacaattgttaatgatttttttaattaaagaattataatcaaattattaacaatatcaaaggagttagaaaatggaaattcaaacaaattttcaaattatatctgatgaagaactttcagaaatagttgggggtggttatcctaataatcaaagtatgaatgatgttcttcattggcttaatggtcataatgatgggaatcctaaacaattacctaaatggatgtgtggattggggtgaattagattgacaaaatatatttaccctaatttaaaagataatcaaaaatatttattaaaaattattgatgggattttaactagcaataatatttcaagcgaagaaaagaagctttttctgattgcaaaaagcaatattgaaaagggtagaaattttgatccccaaatcagtgaattaatttctagtttacagtaccttgttcattcagatgatgtgcttgttttttttgaagaagcacgaaaaataatgcaaattaacccaggaaccggtggttctccatatggttggtcaaattttgaaagtaaatagtcatttactaaaagcagagaacaaaagagacaggaaactgtcttttttgtttgcttggggtctggggcaaacgcccaattttggcaactgcagttgccaaaactttccgcaggaatcgtcagacagaccttacctttatgttaataaagtctagtaagttatactttttattttcttgatagttatcaatttttatctataagggtagcgctatactagtatcataaagaaaattaaaggaagtagaaaatatggcaaaaataacactgaactttcaaaaacgacttcaacaacacagtaatcacttggttatcctctcagccattctcattgtactcggataccttggtaaatatggtgtaaatcaaatatggatttggaattcgacaatgattattgcaagtattatcggttttatacctgttgcaattcatgcctatcaagcaatcaaagtgaaacaaatttcgattgacctgctagtttctattgcagttatcggtgctttgttcatcggtgaatatgaagaatcagcaattgtcacttttctcttcgctttcggtggatttttggagaaaaaaacgcttgaaaaaacgcgatcaagtatcaaagaactcacgaatatggcacccagcacagccctatctgctgatggcgaagaaatggacattgatgaagttgaaattggcgacaaactcttagtaaaaaccggacgtcaagttcctgttgatggtcgtatttaccaaggatctggctatgtcaacgaagccagtatcacaggtgaatcacgtgaaatcagaaaggaagctggtaccaaagtttttgcaggttctatcttagaaaacggtacaatttacgtagaagcagaaaaagtcggcgaagacacaacctttggtaaaattattgaacttgtcgaagaagcccaagataccaaatctcctgctgagaaattcatcgaccgctttgctaagtattacacgccagcggtacttgttattgcagctattacttgggtttttagtcataatctagaactagccatcacgattctcgtacttggttgccctggtgccctcgtgattggtgcacctgtttcaaatgttgcaggaatcgggaatggtgcaaaaagaggcgtccttatcaagggaggtgatgttatgaataccttcagtcacattgatacgcttctgtttgataagacgggtactctgacgaaaggcaatacagaagttgttgttgtcaaaaattatggtgcttcaaaagaattgattgatgcagttgcttcagcagaaaatgaatctgatcacccattagcaacggcagttgtacgcatgatcggaaaattcaatcctatcaaatttgaaaaaacggacgttgttaaaggacagggaatcatcgcagacaacctattgattggtaatgaaaaaatgatggtggttaatcatattacgatttctcccgagcagaaacaggacatcacagaaatcactgattcaggtgcatcagttgttttggtcgcagctgataacagattgcaactaatttatggtattgcggacgaaatacgttctggtgtcaaagaatccctcgaagaactacgccacgaaggtatttctcgtatgattatgctgactggagacaacgagacaacagctaaagcagtcgccgcccaactcggcatcgatgaagtacgtgccaatctcatgcctgaagaaaaagctgaagttgtcaaatcactcaaaaactctggtaaaaaaattgcttttatcggtgatggtgtcaacgattctcctagtttggcacttgctaatataggtatcgcaatgggttctggtactgatactgcgattgaaacgtccgatatcgtgctaatgaagtctagttttgatgaacttgtccacgcatatggtttaagtaaacgcacggttgccaacatgacacaaaatattgtgattgcgattgtagttgtgctctttttactggctagtctaatccttggaggtacaggcttagtacctagtttcgtcaacatgggaacaggtatgttcgtccacgaagctagtatcctcatcgtcattgtcaatggcatgcgactgattaggtatcgagagaaatagaagaatggaaacaaaccaaaatttacgcggtttgttttctttttttttgagaggaattaattttttggtatcaataaattttataataactttatcaaaaataatttgataaaatcatcgagacattttcgatggcttctagaatctttacaattaaagttttccttgctaatagggacgttcaatacgagattgaatttgaggtcgtgaagtagactatcgcaggcaatgtagcaagttagggatttgaacttatttaaaagctttgatagctatctcaatataacttttttataaaaatagatagtgagttccaaatgacaattatttaaaaaagggaaactcgcacatttactagataggaggattatcaggtaagaaggtatatgtcgttttcagagcacttcaaacattttatggatgaaggacgcttacaaaaagtgactaatggatttgctcttttaattttatacaggcaaaattagggaataatttaaacaccgttccgcggaccgtctcggtagactctagttgatgctactttacgctcctcatatcaggttattcagcgttaaaaaagagagttgagaaattttatcattttgtagataaaaaaataaaactgttattcttgatagatatcaattttttgttagtactgacgagctataattaatttataaagaaagagaaagaggtaaatcttatgtcaaaagtaattatgagactcaatgaattaagctgcccatcttgtatggcaaaaatcgaagctgcaatgactacaactaaaggcgtagcaaatgcaaaagtacttttcaatgcatcaaaagttaaagcagaatttgacgaaaatattgtcagtactgatgaacttatcagcaaggttgagaaacttggatatcctgttttgagtagcaaagtaactgttgtgtgatttataccaggaaagataccactataaattgaataaaggaaaaaaatgatgactaaattaatgattgatgaaaaatatgctaaagaacttgataaagcagagattgaccaccacaaacctacggctggtgcgatgctaggacatgtcttatccaatttgttcatagaaaatatacgactgactcaagcaggaatatacgcgaaaagcccagttaagtgtgagtatttacgtgaaattgcacaaaaggaagttgaatatttctttaaaatttcggatttacttcttgatgaaaatgagattgtaccaagtacaactgaagaatttttaaagtatcacaagttcattaccgaggatccaaaagccaaatattggactgatgaagatctgcttgaaagcttcattgtggatttccaagcacaaaatatgttcattacgcgagcaatcaagctagcaaacaaagaagaaaaatttgctttggcggctggtgtagtcgaactttacggctacaatcttcaagttattcgcaacttggcaggtgacttgggtaaaagcgttgctgattttcatgacgaagatgaagataatgataattagtttttacgaaactgtaggctttagttgaatgaggcttgcagtttgataattttagcgcgataataagataaggagaatccccaaaatgagtaagtataaacatcattttagtcatcatgaacaccactgtgtacagctcgtgccactatttggtttactttcagaaagtgaattagtgcaagttgagcaggttgttaatcataaaatttttgaaaaaggtgaaacagtcatcagcccctttgcagtgcctcaacttgcaattgtggcgcatggtaccttgaaaatataccagctttctagtgctggtaaagagcagttactacgtgtgattgaacctggtggatacgcaggtgaagacgccttgtttggagtaatgaatgataatctctatggtgaaacattggaagaaacgcaaatttgctttttgcgacaacaagatttcaaaaatttgttgttaaaatatcccgagctcagtttgaaattgcttgaaaccaccgtgagaagagctgcggaaatgcaatatcaagcacaatttctcatgatggaagatgttgaaagtcgaatcgctaattatcttttgcaactcgtcaaagtagtagattcaaattctgttatgattccaatgaaaatgaaagatcttgcaacgttcatcggaacaactcccgaaactatttctcgtaagttcaaaatactcgaagaaaaaggattcattgagcgccgaggaaagataatcaaaatactagatattgatagccttgaagatgattacgcttaaaatggtctaaagagccaatagattctgatcctacacaagatccagacctaatgccagattggaccaatgtcaaatatttagacacaaaatgaaagggtatttacattatttgcaattgctcaggcaattccggtattcaatgtagcagtagatgcaatttctttaactttaaccacactttggggaggaagaataggagcagaagatataatcttactggtatcttatataattaattttataaattatcaaaatggagcttcttcatgttttaactcattatgaaaattataaccgcaactttacttttagtaatttctttattaggaattttaggaacagcatttctctacttaggagaattaactcaaggaaaggggggagggtatttatttattctaggatgttttctaatactaggaatccaatcctttacctggcttgaaatcattttcggaaaaagacaaaatggagaagttaaaaaatatgactattttttatttaacattctgaaagtcattttttcaattggagcccttcaactttttattcaattgtgcttctttcaagattaaaaaaacacctttaaaaaatttagcagaaaatacaaaaaggctagcatatcaatcgtttagtcttttttatgttcctcactataccaaagttacacagtaggtaaagaaataaacatggttaagctagtttcatttttttaatattttagtgtttgttaaaaaatagataattgatcttttaaaccaactaaaatctaatcagctcataacttaacagttttgagctttttttgtgtatactataaataaaaaatttttaacggctcataactaagagttttacaaatatctgtcataatgttataatgagaataaagaaaaaggacttgctaccaacaagccccatgtagccgttttaagaacggtagcacacattttaatctaaatgaccgtcaatgctcgctaagctgaacggtcattttttgttacttgtgtttataacaagaatcattaatgttgcgaatgcaatcataagactcaatgtctgataaacagtcaaaaaattttcgcctttcatgttttgtgaggaattgccactaaaaccatggcatcacctccaatcagggctaccgttcataaactctactttatcattataacaaaaagaaatagtctaatctatcatagtaggaagtaattcagaaattatttattagcaatatctttctataattctttttttttgggggggggggagttaatataagttcataactatcatatataatgcgatataatagtgatataaatttgttttttgtaaatgatgggagagtaaatggaaaataaaaaaaaatatctttttaaagaaatacagacttttttagtgaatgttggttggacacataaaatacaaatttgccaggttgatgtatatatggagctttcaaaaaatttaaaactggctaaaattattttgacatctttaacttctgctggtttggggagttttattttgaagattttcccaagtattcaggacatagccatgactattacatttgcaatatcgcttgctacaacaattgttatagctttagataaggaaaaagattataagaaattagctgaacagaataaagtggctgcagataaatacttagaaatgcgtaataaagctatgtcgcttctttatagaatgaaatatgaagaaggtattactacaattgaaaatgaatttttagaattgaaagaacttagaaatgaggcagatccaggtttaccacatacatcttatcaagctgttgaactagcaagtaaaaaattgaaagaaaataaagataatgattacactgaggattacaaattatttattcctaaagatttattagacttagaaggtgagatatgattattgactatgcaaaaactttagaacgttcagaagaggaaattataaaatgggaaaatagaattattaagattaataataagctatgtgataaatattacctagaaagagacaattactctatacttgttggatcagttggaagaggaacagcaattacgaaaactagtgattatgacgtgctatttaaacttcctcagtcgctttacacaaaatttgataaatatgaatcaaacggtcaatctcagttacttcaagaaattaaaaatataatcaaagaattacatcctaaaacaaaaatgaagggagatggacaagtagtttcaattgaatataatgatggggtaattgaacttgtcccagcatttgaacagagtgatggtaatttcaaatatcctgatagtaacaatgggggatgttggaaggtaacaaaaccacttccagagattgaaggctcagtaaaaaaatctaaaaatacttctaaaacttttaattacttgtgctttctgatgcgacaatggaaaaatcataatggcttttcttttaaaggattgcttattgacacattagtgtctgagtatcttgaagatgaaagttacaaaaataaaacagagttacaattattagaaggtttttttggtcaattatctaaagaaaataaagagcaatcatattggtatgccttagggagtaatcaaaaaatctataatgacgataatggtaaatttgtaaccaaagctaaaaaagcattaaaaaaatttgatgaggctacggaagaatcaattttaaaagatttgtttggctataaacaatcagaacaacaggctaccaatgaagaattcattgagaataaatttattgtagatattcgatttaaccttaagattgattgtgatgttatacaaaatggttttagaggtatgaaacttactgaatatatacgaagtaaatttagactaggacgtggaaaaacattgaatttttctgtgattaatagcaatattccctcttatctaccagtaaattattattggaaagttagaaatgttggtagagaggctttaggtaaagagagaggccaaattttcttgggttcgaaaaaactaatcgagcatacaagctttaatgggaaccattatgttgaatgctatgcaatatctgatgggattgtgattgctcgggataagattaaagtacctattgatgtattgcatgggagatagaagaaaggctaattcaaagaattaaagttagtagaaggtgttctcccctctttagtttttataaatacgaagtttaccactacaatgtactattggagctttatttggcaatcatccaatatattaaaaagaacaagaaaacaaagttaaggtgttttcttgttctttttattttatacatactatttatttattaatatatctatatattgttgttctagagactccccatgattccgcaatattcttaataggtgttccattatctacaagtgttttgagtagttctatatccttctcagtgaacttttcaggacgaccacctaatcttcctcttgcacgtgctgcagctctccctgcagcacgtgcaagaataaggttacgttcaaactccgcaaatgctgcaaatagatgaaacatgagctgtccagtagagcttgatttgtccatcgtgatattttcttgcaaactatggaaacttactcctttatcgtttagtgagttgactatactaatcaaatcttccatatttcttcccaatcgatctaatcgccaaacgacaattgtatcaccaggccgagaaaattctatggctgattttaatccaggtctatcttttttacttccagatatgtggtcagtgaatattttctcacaaccatattttccaagactgtctttttgtaaatctaaattttgtagtccagttgaaactcgtgcatatccaatattcaaatttcagcacctccgttactttaattgtatcataacttaaaataatatatataattgaacatagattaaattatgagttaatgaacactaaatataaaagaaatagatgaaaattgtagaaaatataaagtgtccagaaaatgaccattttatgaacactcaaatattgaaaaaatatagctcattttatgtctaattatttgatagtggtccattttgagttgcgttcaaatttttagctcatttacacctatggttgagcaatttgtgattttttaactttctttatagcaaaaaagaatgcaaacaagaaatatcctctgttagaaaaaaagcttctcaaaagagaaactctatactgccccccaactttgcctgcagtctgagcgttcaattgaactcttttttactggcgaaaaattattaatagtaaaatcaagaagacaagaagagacaaaatagaaataatataaaatgtgagagcgatgcctattaaatttgcaaaaaacacaaagattgctccaccaaatggtaccgaaaatgtaaaaatagtcgtaatccctccaccaattttccccaaattttctgaagaaacattttccagaatgagacgattgactttaggactcgctttggccgatatgtaagccaaagaaaagagaaatattaaagaaatcaagccaaaatgagttaccaaagctgcaaaaagtgcaatcatcaaaaaagtagcaatcattaatttgggaagttcccaatcttttagtttatcccccataataaatgagcctgcgagcattcctagcatcaaaacaacgttaaaaatcattatagcaatcccgtaattcacagaaaatggattaaattttaacatggccaagctggtcaaaggtccaatacccgccaaaataaagttgataaaaactaatgaaaatactagtactaaaaaatttgatgaactatttacagtaaaaacatcacgaatttgtgaaaaactctctttgatattaaatttaaacttttcatcaaaattgacagtcttaaaagtcaactttttacggaaaatcaataaaaagaaaccactcagtaaatataagatcccattaatcaaaacgaccaaagaaaaggattgatgtgaaagagccagaatcgttacacccaaaggttgtccgataatttctataatagatgataaaccttggatttgtccaaatgctggttgtatttcctctgcgcttagattattttgtaaaattggtgcgcgtaacccagatttataactggtaatcaggtcggtcaaaattttcacaccagctatgctccaaaaactaatccaatttttctccatcatcaaaaaaatcaataaaaagaataatacggcttgaatccagctcgcacgaatcataaaatttgctttattttttgttctatcggccaaaaaccctgtgtaagctgcaaatataatcggtaacaaaaggcagagttcagctaatgaaatcatcattttcggatgaggcatgctactcgcataaatcaaaaaaacaatgttaaataaactcgttcccaacatagaaaaaatagagctggacaacaaggaagcaaatgttttattttttctcagtaaattcatagtttcctccttaattctttgataaatttataaccctcataaccttttaaaaaaccttcttcataacttttagtataaaaattatataattttttgtttttgataaataatttgcaagttcttagctgttcatcagcccagctcaaatattttttattccccgttttttgataaaccatcaataaaaagtatgcaattcctgataagcctttctcaaaatccattgattttgaaaatttcacatccattccatttgctattttaataatttgcttttcatatttttcaaaattataggtcagcaaaaacaatgctagaccactagaaccgtttaataagtagggagaataactattttcagataaatgtaaaaatgaatcacttaattgtgaaagtaaatattcaattttttcatcaattaacttattttttttaaaaattgataatttccacaaataacctgttaaaccatttagtcctagattttcaaatttattttctttgataaatgtgaccaagttctttggttcttccaagtactctttagaaatatgtaaaaaaacatctgatttataaaaataaagttttttagaaatttctaaagcctttttggtagaacttccagtaaataaataagttaataactcagaaatattcgttttaacttcaaatctttcaaagattttagcagctaaaataatcgtttcttcaaggcttctttcttgctgattgaacacatttaattgaccaactagaaataaaatcaactgaccaacttttcttaggtcttttttcatttccgtcaattttgaccaactttttaaatagaatccttctgtttttgcagtaacttttcttgattcatcaaatttatgagcaaattccaaatcaataaaatgaattttattagctttgtcaatcaaaaaattatcagggtgaatatcatctaatattacatttttatgatgtgcttcttccaaaatttcaattaattgttgaataattgttgaaaaaatcactaatttatccacggtcaaattatcaaataaggaaaagttactttgaaattctctaagtgtttgtccatcaataaacttgtaaacataataatgattaatccaagcacgaaatttttcaattggttgtgaaaaattagctgaatttaaaaactcgctcataagaaattcgtttttgcgcaattcttctgattttaaattcacaaaagttaatatattggcccgactttcttttacaattattttttgattttttaaagttccaaaataaatgtttccaccattattttgtcggataatttttgtcaaatccaaatcatttaatctatttttctcatttagctctttcttttcttgataaaagggatcaactagccaagctggtaaatcaaaatatgttttttgaaaatctttccaaattttcccatttcttacgagtgtacagccatctatattttgaaaaaaaccaaatcgataaaaaaccgttttagaactatgaaaatttctatcacttaaaatataaactctgtcaaatttgactaaaatctctgacaagtcttctagaatcttctctgcggcctttatattttcaggataaattgtaaataattttccgctttctgctggaaattctgttttagaaatatttttgataaaatcctcacgagttgatagatatttataatataatttttgttttaataaatatcttttcgttaaatcaaaaactttttcataactttcaactgtcgcagaaacatgaattttaaagccatactttggaagtttatatctctctgtcgtaaaataagtaaatttttccatattttttccttataataaaaacatccggctgtacaaagccagatacttatagactagctccctgtaacgggacacatgaaagtaataacaatgtcttcttcattatcaacttcttttggaagaaggttaagctcaatcacctgttctttcattttaaagacctcctttatttgataattttatcttactgcaaaaaaatatacttttttgcgatttcctatatataataaaaaattacaacttttgttgcaatttttttatttcttcttgataaagttttgctttttctggcatatagaattcttcatacgtttttgcaatctgttctaaaatagaaatggcctctcgaaaattacctgaaacctcatataaatcagcttcttgtacagcatatgaaattccaatttcgatgtttccaatctgcggaattaaagatttaaacttttctaaataaaattttactttttcagtttgattattttgtgccaaaatgtaaattgcgtttctcaaaatcatcaaaatcaagttattatctaaattatcttgctccaaaatattatccagataaaaaacaatggattgactgtcaagttgtgtcagcgcaatcgcaaaaaattggagattagagtatttccattttttaatttcataaaaataattctctaaaatttcttgttcaattatcgtcagtcgttcaaattttccataattgattagcattgattttaatgcaattatatttaattgatcttgttttttgctcgtttcacgatatttttttcgctcctgttcgtacaaattggctaattcatcaatttttccggcttgttctaactttccggcttgttctaacaagagagtcgtttcatccttttttaaaaggtctgaaaattcattgattgaaacattgatgtttccaatcagagcaaaaaactttcctatcgtcaaatcacctttgccacattcaaagtgagagagttgagaaattgataggactccctcacttgctttagccaatgacatttctttttcttgccttaattctcgaaacactttcccgatttctgtcttcatgattttcattatatcaaaaaaaacataaaaacaacccccattacctgtccaatagataacaggggttgttttaatagcgttgtataggggtcataatataattatagaccctatattattcttgaatttcaaattctggtaattcctcaattaattcaagggttcgcatacttactgtaataacggataataagaggttcaaaatatatttaggattatcactaaattcgttaggatcatccgttattcctgattttttatctgtttttacttgatattgatcaataatccattcgatagctggccttccactaaccacatactcataagctttctctggtatgttcgagatagttattgaattattgaaaataatagtgtctaaggctccttttttaggatgtttcatcttagtcactttataatcatcagagctaactgacaccgtcactccagggtatgacacttgtttctcgtaattcagatgcagattagataactcctttccaatccgaataaacgcttctttatttcggactagcggaatccgcggcaagctcttttttaaatcattggcatacatatcccgatattcgggtgaatgaagcaaaccatacacataataaacaatgtcagccttatcaatatcataattgcctactacattgtcatatttaacgtcaagaagccctgtcgtatcttccaaattcttcaaaaaacctttaccggacgtaagcaacgcatattctggaacgttatttgtcatcaagacagagaactcggaatttgtggacacatacaaaaccttgtcattaagtgacatcgcagtatcgtagtttgacggacggtgaattaaatctcgtccataatacaacctttttctggacagaggatagaaatatttttataagtttattaaataacgaaggagcaactttagctacaaatcttgctatttgtaaatctacatttttttattgaaaaatagatagtttatagttacagttgcaactgctttagccgcgattaaaatacttttctcattcattttaaataaagggctatgatggggataatttccgccgtcttcaggctgtgcaccaatgtaaaagaaagtacttggtacaacttgcccataatatgaaaaatcttcagaaggattttgtggtcctaaatcgactatattattgacttctgaaatattctgatcttttaagctgtcaactacaaagtgagtgagattttctgaattaaagagtacaggatagttatcgtcataatctacaatcacttcaaccccaaaggttactccaacgcctttagcaatttgtttcacttggtctcggatgacttttctagttgtttctttcatcatccgaacatccccttttaacactactttatcttgtatagcattaaaacttcctgctccatcaaatgatccaatagttacagtacccatgtcaaatggatctattcttcttgaaattactgtttggagttcagttacaaagtaactagcggctactattgcatcattacttaattgtggcatagaagcgtgacctccgtttcctttgattgtaatggtgaaattagaacgtcccgtttgagtttctttattatgataggcaatgacccctgttttaattgtagtcatcacatgaaccccgatcatattatcgacaccgtcaagagctcctgctttaatcatacctttggcaccaccaggagatacttcctctgctggttgatggacaattctaactcttcccggaagttcttgttttatttttactagttctctagcaagtaccatcaaatatgcagtatgtgcatcgtgtccacaggcatgcattactcctggattgaccgatttaaaacttaaatcattatcttcaaaaatagcaagagcatcaaagtctgctctcaacgcaagagtttttccggattttccaccttcaatatcaacgatgattccaaatccctttccgataagttttggttcacagtcaagttctttataaaagcccataatatacttaaatgtttctttttcttgaaaagaaatttctgggtattgatgaagatgacgcctaatttgaatcatttcattctcatattgtgttaagctagtcaacaaattattaagtagtttcatatgatacctctaaactttctacccgaattgctagttaatttcattggaaaataaataagtcgtgctatcctaatcttaaagcactaagcattagaaagctcacgacttatatgacttataatagcacacttccaaaagtttttgtttatttactgacaaccattgagacgctttatcaaacgagtgttccccttgaggttcaaaaccgaaagggttctgttgcaaagttttccaaaaaatctattttagtgtaaaattgagaaaaaagacagagaggacagagtaatgaatcattttaaaggcaaacaattcaaaaaatcattaaagattttaaaaatgaaatattggtagaagaggggtttggaaaatttcttgatattgatgatcaagaatacagtgataaaggatgtcatattttatcaagagctgaggtttttgcggaatcagaggcgatcttctcactaaaactcatccagcctactgattactatcaccttagagaggggcagatgattatagggtggacacatccttttggttcaggacaatcattcatgaaagagcaagctctccctaaaaagttaattgtagtagatttagatagtaactcgccttgcatttattatgaaaatgagatatttgaatcagatattccgaagggtctattatataaaaatagtttttatgcaggctatgcaggggttatagatgctttattgcaatatggatttattccaagtgaagagacaaaaatagctattttaggttctggaaatgttgcacagggtgcctttagtagtatttcaaaatattcctcaaacatccgaatgtattatcgaaaaacaatgtcgattttcaaagaaaattataataagtacgatatcattatcaatggaattgaaatcggtaaagaggacaatccaattttaaatctttctgaacaaaaatcattgaaaaaagggactttaattattgatgtagcagctgatgccggaaatacaattgaaggaacgcattttactagtatggatgaccctatctatgaaaatgatggaaaatactattatgttgttcctaatactccatcactcatctatcgaaatgtgagtaaagatttaagtaagattttgagtgagaatatttttcgtaaggattgttcccgttttattgaaaaggttaaacctcttaataaatgatattttatattttgattttttaaattatatactatcataccaagggtagaaagccacaaaatataaagatagttctttacctaaataatggtgtattagatgacgttataaatttattgctttttattgtggtattaaagtaagaaaatgctcggaatgcttaaaataagtgattttgaagtttgataaaataaaactaaccaaaaaactaaccaagcaaagaaaaagtgtatataaaaaatttattaaataaaaaatcacgggtaataataactagtgattttttaattaataaaatttttattttattgataaagacaataaacttaactggacttcaatttcattgattataagtggtttgtttctactttttagtttttttgctaacagaaaaagagaaaaatacttctttgaagaggcggcaagtacagagaaaaagctactagaacaatcgttggaactacaacaaaaaatttcagatgaaaaaattcatgctgatataatttctcaagcaagaatcaaatggattcaagatgttagggaaacaacttcaaatgttttttcattatattatcaatgctatactgttgaagacgaaaagttaagaactgaactatcaggaaaatacagcgcagaagtattaaagttaagattatcttttgccacactagagtataaagatgaacaaaatataaattttaatcaaattagcagtcacgacaaaccagatgaatatttaaaagatatacaagtaaactatccagatgatccttcatcaaaagcattaaaacttttaaaaaatgttgatagtaatgagggtaaaaatatttatatggtagaacttattaatgaattagaaaggcaacgtgcttttacgaaaaaaatatatgtcaagtttattttcagaattagttgtagcagtttctatttatttaaaaatagtttgggaacagtctaaaaaaataaactaaagatctgggtgagagaccaaattgtgtgagtattattcataattataaaagtagaaagataaaactctgcaactattgtaaaatacaacatatagttaattatttatactttacataatttgacactatatctagtatctttaatttgactagatattttttatacattataattaatataggttttattcaggaaataatttaaggaggtgcctcagcattatcaacttaattattaatgaaatattagcccctccaatgaaaggtttattttagaatctcactctaagagattacaagatgtattaacaattgttaaaatttgttattacattgcgtatatcatctttataatttgtagataattccacactactgtggtggaacagaaaaaccgcaactataaaattgcggtcaagtgtaataatcctggataaaatcaataaaaagtctgtttgccgacaggcttttttacatccttaatatagttatattatatcatgttttaaaaaaaatagtaatattttctctcatatttattgaatatatcgattaaagggatatgattaccaacagagaaaataatcatatctataaaaaatgattatatttaaaatgatttatcattgttattttcactttctttttcttcacttttacattaaaataatattattggtcaatatttcagtaggagcaaaataacgtacacttaaataaaaaagcaagactcaaaataaaggttaaatatgtataaaacagaacaatattatttggaactcctaagtatgagttacgacgaagctattaaaagtttagagaaaataaatggaaaacctgacttcaattattttactgagccatcatatgaaaaatataaaaagaatcttgcaaagaatataaataatcctaatagatattataaaaggagaaaacaagaaatccatcatattttagaaaataaatacaggaatctttcaaacaaaaaggcaatcagaaaaaataatattccatattatactcaaaaaaaacagcatttaatttatgtagatattatagaacatgctatattgcataagttgattgcaatagaagctggtgaggaattagtaaatagtgtatcgaagggtataattggaagagcgacagatgtcgaagaaataaaacaaaaaaaactagaacatataattgcgattttacttgggtaattcagaaaaaacgtaaaattcttatttcaaaaaaatcaatttttagatatctatttttcttcactagatatgaaattataaattcttcagaaaatgtggttcaatggcaagtactaaaaatctagtacttatgaaggttaataatctatcaaaaaactgacaaaaagactagcaagtcctatgataagggataatgaagatttgaaaaataataactaaccaaaaaactaaccaagcaataagatgtgtgtaaaatttataaaataaagaaccacttgtaaaattatagtggctttttattttgtaaatttatatatattgactttgatataataagaagttataattatatatagtaataaggtttattagtaaaataataggaaagggagtgtgatgttatgaatagactagcaattggttatcgtaaactaaatttacaaatccgtcaggttaaagagcttaaaaaattttatggaagtgagtttgctaataacacaagatatttagaacaaaaaaaagttttaatcaaacttttaaacccttttgtgttaatgaatactggtaaattaccatatacaagtgataaacatgaagtaaaatacttaaacggattaactaagttagcttctaatgacagagcatataatattcaattaaatgggtttaaatcgtgatacaataaaagcaagatttgagattgttaatgatgaattaaaagcacaaaacatctcagtagaatgcatattaatcggtggtgctgcaggaatttttctttcagaaaatgtaagaccgactatggatattgatgtatttttaaaaaatcaagttactaataaagaagttaacgagatttttgatgaaaattttatagaggcggtcacagttgcttctgttcctgatcctgaagaaatgactatttctgatagattaacttggtcaaatttaattgtatatataccagacttttatagtttggcaataacaaaattatttactgatagaaagaaagatgaagaagacttgttgtcttatatacttccaggaatcagtgactttgataagcttgatgaattaatccgtgagagtaggatagattacgttgggaatattaataattcatttttaaatgtaaatagactcgatgactataagaaagaattaaatattaaatagaatcactggtatataactagtgattttttattataaattttgacaaattaagtatactctttttagatttttgtaatggtttagtatttatattataattattaaaagaatttcgaaatgaatttaggagatgaagatatcatttggggtatttttgttaatagcgtttgttatagtaaccattgcaagttttatctggaaatatagaggactaacctattttgtaggaatagtatttttaatttggttattttttaaatttttctttgtagctttaatcgtcattttagggctcataatagcttattttataagaagagtacaagagaatgagagaatgtcttctgaagctgacagggcaaaacaagctcatcaagaggatgttgacgcatggagaaaagagcaagagagaaaatatggccctaattggtatcaagcaaatagagatgaacaaaaagctgaagcaaataatgctagaaataatcaagcaactaaattaatagattataatagacgttgggatagtatagacccttatattattttaggagtaagagaagtttcaacttttactgagatgaagaatcaatataaattcctctcaaaaaaatatcaccctgacgttgcaactgaagcaaattctgacgctattatgaaaaaaataaattgggcttgggatgaaatcaaaaaagaacaagaaaactactaaactattgaagactagtagtttttttataagctcaaataagaattattgatgtttctgataatattcattcacggataaattcttaaaaagtaaacacatacgttttgaatgataacaaatccaagagttgtttttattcttgacaagatatttactttcaatatggtttctactaaatattggtctaatgactttttttattttttgagttatactattagagagataccagttttacagagtggagaatggcgataaattgaatgtgggaataagtataattgatagaataataacaaaaattatattatcggcagatgataggcatttagggcaggtgattaataggataccgcaaaaaatttcgggaatgcttcctattaataaaagttcatctttaaatgcaaaaaagatgtcaattgaaagaattttaaaaatcaaaaaaaatcaaaaatatatctatgagatattgtcaaagaaatttttccatgatatgattgatgaaaattcagtagactataataaatttatagactatgacttggagaattttatattagaggcttctaattctttgtcttttaattatatacattttttaatcacaattatagaaaataactcaatatcagaaattaactctttctttttaaatgatattaatcaagttgaaaatgtcgaaaatcaattaaacgaaaatagaagccattttcaaagtgatgttttaaaaattcaacaagctaatgtcgaaaacgaaaatcaaaaattaattaatgaaatcacacaacttaaacttgctttacaaaaagagaaagaaaaaaaccaaaaatctataagtaaagaaaaaagagttaacaaaaagctatctgaattagagaagacacaagagagaatcactaatgattttacaaataaaatagaaaatataaaggatcaatatgaacgaaaaataaaggattatgaatggaaaataaatcatttaagtgaacgtattgaagataaaaatttaaaaatagaaaagttaaatgaaattgttaataatttaaagattcaagaagataaaaagaaactcttagtagttggtaggttatcaaataatatagtgaaaaattttcctaactttttaattgtcaatctagctattgatggtcaacttatggaaaagttaaaaattgagttatcaaaaaattattttgcagtttttattttaaaataccaaacaaatactacaattcaaagaaaaataaagagaaaatttaataatgtaagttttcttaaagtggaaaatacagaagattttatggaagaggtgagaaagtatgagatttaatgagaatgaagaatttgatgttttaggtttttgggatgaaagtatatctcaagtgcgcattaatcataataatcaactgtatttttttattgaattgctctcaccttttcccaaaagtgtaaatgcaaatgttaacaaaaaaattatacaaatatatgctaatgagttatttcgttttgactttgttgatgatatggacgatactccagattctagaaaagaaaatttgaaaggttttctaaaagactaccttattatttgtaatccatcctttaaacaaaatgatgatgatggagaaatttatatccaaggacataatattaatttagtcagaaaagatatcaactttaataataatagatcaacaacatatattgcgattcctttttttgacataaaatcacgaaaaagtatcgaaagtaaaaatgcatttataaaaaatttatatgatgagaaaactgtaggtaacccggtcgggtggtcaaaagaagatgaagattattctagaaatattatatggattgatgatgatgatcaccggacattagtaggtgagataattggacaaaattattctcagtatggagtgacatatgattttgatgatgcaaatagttacaagattgaattatcaataacaaatgatgaggattggttttatggagagtacagaagaccgaatgggtcagttatttttgttcctcaaaatatatataataaaaaaatagatcagaaaaatcatttgaatttatttgaatctttaaatatagtaaaagaaaattttaaaatagaagaaattgataattctgaaatgtccatactaaaaaaagaggatgaaataccttttgaagatattcatgaaaaagaggcacaatttattgatagattagattacctcgcagaacgtacaaatcatcttcattatgataaaaaagatcttattaactttcatacttccctgaaaggtgatagcctaacgattctgtctgggcttagtggaacaggaaaatcacagcttgttcgaacgtatgctagggggcttggtgtaactaataatttaagattcattccagttcgccctttttgggaagatgattctgatctattaggatatgttgacacagtaaactttgtatatagacccggggatagtggtctactagatttgttaatagatgcgtctaaaaatccagataatatatatatggtctgctttgatgaaatgaatctatccaaggtagaacactatttttcacaatttttatctgtgctagaattggaatcaggaaaaaggaagttaagactatataatcctgaattaaaaacgaaactttataattcttctaaatatgattcggaaatatctattgattctaatgtactatttgtaggtactattaatactgatgaatcaacttatcaattttcagataaagttttagaccgttctaatgttattccacttcaaatagttccatttggtgatatacaaaataaaaaaaatgttgatgcaaagaaagtaaacgcggaagagtttatcattaaaaatgatgattttaaaaaatttagaaaaagcaatccccaatatgcattgacacagaaggaaaaagaaatgttatgggaaatacacttagaaataaactcacatgatagaaacgtggggataggatggagaattttaaatcagattgatgagtacttacaaaacattcccagagattcagaattatctcgtgaagaagcgcttgactatcaaattcttcaaagaatcttaacgaaaataagaggatctgaagagcaactatctggtatgcttgggagttgggataatactaactccacaaataatattggcacgcttgaaaatatattaaatagctattcagatagttcatcgtttgaaaaaagtaaaaaaattataagagaaaaagctagggaattgaaacttcatgggtttaccatttaatgtcagtataaacacgcgagatttaggcgatttagagttagtcttttttaaagattttgaggatatttttagcgatggaaatatcatacctgaaataaaagagttcgcggaaataaatgtaaaatttatatcagaagacaaaacaaataaactatatttaagagaactggatgactttgagttaaacaatagaaaagattcaggggatgatgatctttacttttggccttcgcaacaaaatatagtaatatatgaacgtaatacacaagatgtgcctcttgttccgggatattacttttttgaagttcatctactaagtgataaatatttttcagctattaagataataccaaaagatttatcttctttgcaatgggagaatatgagggatgagatagaatcaaaggttagaggattatcactagattttattaaacgaaagagaactgagcgaagaaatacttcagataaagtggctccaaatgatacatttgtaaagataaaaaatctatcggaagatattcctgcagttttatcatcattagaggcgttaaaaaaagaagcaaaagttaaaataagaaaagattattcttggaaaaataacggaagtaaagctcagatagattttaaaactataaaaatgatgcaaaagtatcctgacagaaaaggtcaattatattcggctaatcgcttcatagattatgatactgaagaaaatcagtggttgaaatttatattgacacatatattgagattttctaaaaattctattgaatatcttgatagaatgttggaagtcattaataagaactttgaaggggaagtgagattttcaaattatagaagtcaagccaacaatacttttataaatagcacttattatcatagaaaattggaaattgaaaaattgagaaaacagcttttttcattttatatttatgttaacgattttcttggtgagagatatttttcttcagtttctaatagaaaatctatttttattcccaaaacattggtgctatctccaaaatacaatatagtttacaaaatgtatttaaaaaatattagaaccaataatgagcttcatctagatgatagctataactatttttggagaaaaacagatttattatatgaaatatggtcatatataaaaacaattgactcattaatagaaatgggatttgtaccagaatccggttggatttttgattatgattcttgggtacaacctttaccatttcttgaggatggtaccaaagtaaaaatgggtagggggtctacgagtgtttcagttgttttcaatgaggtgttaaaaggacaatcattcagaaacactttagagaatccattaaaaacttcttctaataggaaaaaacctgatataagaatagatttattcgatgaacaaaaatatgcaggtagtatcattttagatgctaaatataaaaagctaataaatataatttcatcaagatataataatagttctctaactcaactaagatcatacagaaatgacccattctcatcaattattgatattccggattacttactgagacatgttaattcagttgcttctgtatttgcagtatatcctattagtgaaggaaagagctctccgaaagattttgacgaacagcaactatttttttcagaattaagacctgggtatggttttgaacaatttactattgatttatcacgccaaattaatgaacgattgaatatgcacaaggaaacaaataaaggctaatatgaagaactgctataattaagaatgtgatatcttgtctgaattccgtaaaaatatatttaagataaaaaaatgacttactttaaaatgtaagtcatttttcatgtttacgtactatctgtccacttttatagtatagctctattttgatgtgtaaccaaaaacttagacttttttctcaagtcaggatacttgggatttttattttactttaaacctcaatgaaataattaactcaaattttctgatataaagaatcaatataaattcttctcaaaaaaaatatcctgatgttgcaaattaagcaaattcagataccattttgaaaaaaataaattggtcttagggtgaaataaaaaaagaacaagaaaactactaaactattgaagtctagtagtttttttataagttcaaataatgattattgttgtttctgatagtattcattcataactaattgttctaagacaaagtttttagttgaatgggcatattctagctcattgattaattcatttatggataaattctttaaaaaagaaacgcaagcgttttgatcgataacaagtccacgacttatttttattaatatagtcttgtgttttctaagttgattatttttattattgacaagatgtttaatttgaatagtagttttataatcattatctctgagcttcaaaacaagctctaatgcttcagaattacttaatcctaagatgtgatttaaataatttaaaagtctgctatgcagtcctttaatgctcataccagttatactttttattttgtcaaaagaataatttctagttaaaagcatttctaattttggagttgaacaaaacaaaagtgaagcgataatattggcttcatcttcaaatggtaagacatcatcaggatatactcctgaaaattttgaagcgaaaatttgtttgttattactcatatcatgaaaatataaatgagaaagttcatgtaaaattgtaaaaaaaactctaggtttaggcatagtttgattaagcatgataacatttctattatttttaggaatggtagcaccagaaattctattaactaaatctttattgagagtttgatatttgaaatttaagacaatatcattatatttgattgttgaagttggttctgattcaaaaaaaacaaaaagaatattaaagttattttcaaaataatctattatgtctgaaggtgaaattttataaatagatttttgagtatattttgaaattttatcaaggagactatttgccatatcaaggcattttgtataagcaacaggactaacaactctgtattcaaactttttcataaagataaatattattttttccagtttgaatcatcatttaataagtctttagcgatcttcatcatatctttaagagatttattaaattgagcctgttcttcttcagtcatatcttctgattcaatacggaaagcacgtacaaggtcgttttcttgttcagttaaattctcatctatctttttatcgtctcctcctagaagataatcagcgcttacgttaaagtattttgctaattggtttaatctttcagaagttgggttactttttttatagttatacatagaattttttggaagtcctaaatctcgttcaattacggcaaaagattttccagtttttttagataattcttgtagtttttcgtaaaacatctgttatcctttcaaaaaaaataaatattttcgattaattacttgacaaaagttaataaatatattaatatagctgtagagttaataaatatattaattctagcaacaaaaagaagcggaagcgcgctgaggcaactcccacgaaaatgttaaattaataacgtagaacactattattttaacatttttaaaggagataagtcaatgcaagcactaagctttaaatcaaactttatacaattgaatagctgtgtgttaagtcacgtggcaggtgcttgttccatttatctaacaagctaggggagagagccgatgaatgcaccccgataaccgaaaggtcgtattgtcgtgagacattctgaatataccgtttaaggggattagtctgtcaatgagagacagggaaatactctcttgatattaaacaattaaaatttgaaaatataaagtttaaatagttgtcagaaatggcagttttttattttagaaaaatagtggttttagtaaaaatctatcttaataaatttaattcgcttagggatttgttgatactgtctttaggaaatttgatttataactaagatagatttttttatgggaatataatttaataggctagagtaattacttttataagtaatggtactggttcaattccagttgttcccttataaaaagaatggagtttttttatggaaagtttttcagaacgtttgattcatttaagacacagtcacaatttaacacaaaaagaagtaagtgattctttagagcttgtgtactcaaactataatcgctacgaaagaggagtgagaatacctgataatgatacgattgttaggtttgctaacttcttcaaagtttctcctttctacatgttaggaattagtcatcttagaaatggtgaggaatatttgctagatgtattagaaaatattgaatctgatgatactgttgaaggattgaaagctaaagcaggcttagcagaatatcgaaaaaattatatgtagtaatatatatgttacgttaattataaaacaaagaaacaatattaatcaactttaataaatcatttggtttgtgatataataaacttaaattagagtaaagataggaatgtatttatgaataacaatttaaaccctttgaattggactaaaaaacagcaaattattggtggagcagttgcgattgttttaatcggtggagttactactggaatagttaatcatgcaaaccatcaagcaaaagtaagaaagattgaagctttaaaaaataaaaaaattaaactttgtaatgatagagccgaaaaagcaagaaaacttgaaaaagctaatgaagcagacagtaagaaattacttgatattgctgaaaaaactcctactgacaaaaatattaaactagctgaagattcaattcttaaagttaaaactgctgaagtaaaaaaagcgtttgataatcaagtagttggtattaaaaatcgtgtgaagttagaaaatgaagcaaagacagcagttagtaactatcaaaaagacgctatgaatcaagataaatataaaacagctcaacaagcaatatctaagctcataagctcttattcaaaaggtttgaaagatacgttgaacaaacaacttgctacttctaagaaacaagctgatgacgctacaaaagcacagcaagctaagagtgcaagtgattcaaaaacgaaggtaaccaataccaataaagaacaaacagattcaactggaagtacaactaataatagtaacaatgataatacaggtactgattcacaaagcacagtaaataatgatgttgctagtggttctaattcttacggtggaggaagtcaaaataactattcataaggtgattcaaatacttctcaaaataactctaattcgggttcaagtaatcaaggtcaaggtaataacggacaaagcaattctaactctaattcaaatacaaacacaggtggtaatggttctaatacaaataataatggttctaatggggggaactcaggtcaaccaacacatactacaaaatatttaggttgggtatctgtagatggtgtacgaaaatatacaaaaatgtgtgatacggttgctgaagctcaaagttatgtagattctacagtaaattctgctgaagtaattaatttagggcttgaccatagtattggttatggtcttgatacggttgaagtttaaaaaataaaattatatataaaaaatcactttcttaaatgagggtggtttttttctttaagcgaacgaagttacacggttgaatggggttcaagtccctgcgttcgcataaattgaccgagatgtcattaaactaataaagaaaggtggaaacatgattaaaattccaattaacgcaacgaaactcttaggttcaaaagttactgtcgataagaccattgaaccagtcgcaaaaacatctactgaatcaggttatacgaaatatcgagctacaagtccgttacaacctcaaggttttgaattacgtgtgccaaatggtaaaggggctaaacctactcgccgtcaagaagttgttttgacagatatcacggttgcttatgttcgtaatcgcacaccaaagggcaaatattcacaagaatatgttgtttatgctgaagcgctcaaattagcgtaattatagggggaaattaaatgtcgttaaaattaagtaaagtttttgaaaaagaaaacaagttgactgaagaaatcggtgattttgacaaagcattaggtaaagttttgttcttgcatgctgaaccagtaatggtctttgaggacggagaaccaaatgaagaaactggggaaatcaaacgatatccaacggacaaagttgattattatgaggtcaacgtttattctgacgcacaagacaagcaaattgttgtaaaaatgcctgctgaagctgatttttcagggctcgaatatgaagatgaaattaaattgacgaatcgctcaattaatttttggtctgataaagaactcgtacctactggaaacggacagttcagaaccaattacttttcaggtgaaaaatggaatgctgaagggattgaaaaagtaggtaaatctaattcaaaacctgaacaatctccaaagcctgaagctaaaaacaatgaaccgaagaaatgataaatggcaaaacgtacaataagtaaaggctctcgtttaaagcttagagataagtatgaccgtgaattttttgtattgattactggtttatttgtcgctagtcctgtagggttcttttataaaaattttgaaaccttgccaccaaaagtgctagcaatttatgctgtaggtattttgctcattgcattttcggtggcttttggtttattgattttgctttatcacaagttccttttcttttcaaaaaataattataaaagattgttactgaactatgttgtgaagcataatttagttgaaaaagaaacagtcaaagatgaaaaaggaagtcatgaaaagttaaaaatagcgcctatttatctgaaacaacctaatacttatgaacttcatacttattttccaattgacggtggagttcatcaagaaaaatttcttgatttagctgacggtttagaaacaactttttttgctgattatcaagaacaaaattttatcaatgaaaataaaattctttctaaaaagacatttgttgagtatgtttttgcaattgacggagaacgtaatcgtattccagttaataatgttatagttgataaaaagctaggtttaaagttaatgaatggggtttactggaattatgaagctgacccacatctgcttattgcaggaggtactgggggcggaaaaacagttcttttgatgtctattttatcagcccttgcaaaagtaggtcacgtggatatatgtgaccctaaacgttcagactttgtgggaatgagagatgttccagtttttgaaaatcgtgtgttctttgataaagagtctatgattgagtgtttacgttcaaaaatgcaatttatggacgaacgctatgattatatgacaaatcaccctgactataaggcaggaaaacgatattctgattatggtttgacacctgaatttgttctttttgatgaatgggctgcttttatttctagtttagattttagagaatttgatgaagtgattcaaattttaactcaaatcgttttaaaggggcgtcagtcaggggttttcttaattcttgccatgcaacgtccagacgctgagtatcttaaatcagctttacgtgataactttatgaaacggttggcggttggtcgtttgactggttcaggttatcgtatggtatttggagatgaaaatgagaaaaaagttttcaaatacatcaagggtaaaattggtcgtggttatgttgccaataatggtgaacttgcccgtgaattttatagcccttctgtaccatttgataagggttatgattttcatgaggaactttcaaaattaccagttttggctgatactactgaagttcagcttgaagctccaccaatttctaacgttgaacaggaacgagcagaaagtggggttttggaagaaaaatcttataagattacctctttatctcgtaagttgggtcaaccttcaaaaactgtgaaaacagccatagagcgtttaacaagtggcggatattctataagtgaaaaatcaccttacaatgaagatgattttattgctttacaaactgttttcttaactaaagaaacagaagaatgtactttgaatgaagccattgatactgtcctagctgatgaagcagagtttgaaaaagaatttgtgacttttcacaaagaagatgttgcttaatttataaaaaaactttatatttttataaaaaaatgatacaataaatcattgtaaaacatgttagacactttaataaaaacacgaaaaatgtacctttttctttagttatatgatataattgtataaaataactaaaagaaaaaggtgaactatggtaaatgaagaactaccgcaggagttactacaggaatatgctaatagtgtagtgagaggaaataaaaattttttaaatactaaacgatttactcaagcaacacttgagctagatagtaatttgaaaaaaactagaagagactttattgattgttctattaaatctgatattcaaaaaggtttaatttcttttgaatgcactaccaatactaaggataatggttttggtaataagtactttgaacatactggggaaactatctatggtcagagtgttttaattgtaaagagaagaagtacacttattaatggttttgaggaagatagagcggttcatttagtggattatgccagaaagaactcgttatctactgagaaacctattgaaactattgattttatggaattacttgagaaaaaagataatagtcttcctctagcaaaaccagaaaaaacaaaggcttttttagctttatgttatgattttgaacaagtttcaggacaaattacttatcttggaatatatactttagactccaaaaaaggtgcaatagaattacaagattttagtgactgtattcgtcaagcttatactgttgatgatggggaagttgggaaagaacgtatgccagagcataataactaccaattccaagttcgtgaacaagaaggtaaaggcgaatcctagtcttagaagaggattaaatgtttaaaggagaaaagctacaagaattaagattactttatggcatgagtagggcagagcttgcagaaaaactcgatgtaacggagcaagctgtttggcaatttgaaacgaataaggtaaatccaaagctttcaccgactgttttaactcttgcaaaattatttaaagtaaatattaaattttttgaagcaaacccattggtttctcatgtaaatagaggaagcattgcttttagaaatggagatttggcttcgaagaaaacaatccaaatgcaagaagtatatgtcaatgcggcacatgctctaattgaggatttagaaagttatttgacatcggctcctaaaaccatatattcattggttgaagtagttgaagaaaaacttcaagggaagaaactcgataaaagacttatttctgaaattgctttattagcgcgtaaacacttagacatttcgatacataatgatgatttactttacagaatagaaatgtcaggaattaatgtgctatcaaggtttatgcctgaaggaagtagcgctgatgcttatagcctttggaccaacgataatgttccgtatttggtcttggcaattggtaaatcttacgctcgaagaaattttgatttggcacatgaattaggtcatttactactccatagggctgtagattttgaacttttagatattaatgaacatgatttaaaagagcaagaagctaatgaatttgcttcaagtttattattacctgaaaatgaatttaagaagacttttgaaaaattggtaggtactaaagttagccaaccagatcgttatattccgttgaaacaatattttaatgtttcaatacaagctttagaatataaggcatttaagttaggatatcttactccggcacaaaatagttatttttatcgtcaaatacacaaaaaaaattataaaatatttgaacctcttgaccgagaaataccagtatataagcctggaaaaattttgagtatgttagatgttgttctttcaaataatttaacagatgtccaaagtttaacttattcaatgcgtatttctaaggaaatgttagcagaaattcttaatgtagaagtggcgttctttgataaatataagagttcattgaatgattattctcaaataataaaattagttgaccaacgagaagcataggatatcctatgctttttattttattaaacatcatgcaatcggcggtgagtaaatgataggaacttgtttccgtttgtctttagacaacttgccgcaggcaagccattttccacggtcgaattgccctcgcaaacggtagtgcgcgacagcggtttactcttgaaagaattggagagaaaattttgggttttgttttaaggttattgcgtttaaaacgtaatgctttttttgaaaaagtgcaagaacgtaagcatagctccgagcgtagcgtaaggagtgagcgtgtgattgcacggctgacggcttgccgtcagcttggacttgaccccccccaaatgctaatgagggggggtacaagtgacacaagtctaactatcctagtcataccaacggtatagcttgtgtcacctcttctattttttagaaagtgaggaacgaacgattgatttaaaggatatacgctctagtgcgaatgttactcaacagtttatgtgtgacctcttagggatatctttgagctattaccgaaaaatggaaaaaggcgaacgtgctgttacttctgacatggaagaaaaaataagacactcctttttcaaaaaaagagagagttcaacagtctttgtgggtacaaatgactatacaaatattcgctttcagactttaaatgttcgtgaagtggtttctaagattttaggtttaagcgttgagaattttcagctcaatgattataaccgttatcaataccctttttttattagttacggtcacatcaatgtttattatcatgataaagatataaaagcaggtgtgctgattgaaatgagcggtcaagcgtgccgtgaaatggaatatgagtttgaatatcatcaaaaacagcgtacttggtacgatttttttaacgattgttttctctatgccaataaaaaagcaccagaaaatggtgattttgtaaaaatcacacgttttgatttagcacttgatgaacaatacaacccacaagaaggaaattttgacttgttcaaacttttaacttctgcccgtgaggggcggtggaatggtcgtaaacaaaactattctgcggtacttggtggaagaagaacaaaagagggaatgattaatgacggtctaaccgtttattttggatctaaacaaactcatttattttttcggttctacgaaaaagattatgagagagcaagtcaagaaatggcttcggttgaagcaatacgtgaaatgtatggtttgcgaaatcgttatgaaatatccatgcgaaaagaaatatcaaccgactttataaaaagatatatcgaggaagattttgatttagccgatgaaggggtcaaaattattaatgataatctgacattttatgataaggaaggaaacttagatagtgaatggtacgatatgatgggtcgaatggatgcttatcattttactgttcatcctgaagcgcctgatttgaaccgaaaatatacatggtttgaacgaggtgggcctgtatcaacttatcttctgttaaaaaaagctgaagaactgacaggtgaaagtcgtttggatgaaatttttaatgaagctgaactcacagaaagacaagaaaagttcctgaaggaatttagaatgataaggggtgcaaatggatagtgtacttagactaataggcttatcagttaatgaaatagtttataaagtgttatttatcattattttatgggctgtaattggagcaatacttggagaaatttttggttcataatgataaggagtgtatatggatagtagtgtaattttaacaactgtgttagtcacaacagtttatttttttctttgtatgatatggagtgataaataatgattagacctaatgtagaatattttcaaaaaagaatattaagagttccaaacaacgtccgaatgctccagtataaaatgagtggatatgaatttaatttgaaaaaatttgagcagggagtttatgaccagctctttttttatattccagatgaaactgaagcgttaggattgctcaatgaaataggcttgatgtttccgcctgattcaatgacacgtaaaaaatattattcactctatcaagaaaaaagaattgctgatttgcctgaaggctataaaatggcaatttactttttaattgataatgatttagcacaagcaactttatgatttttcataagtaaaaacaaagttatttttcagataagggaagacaaattttgtggtgggaaataaaaaaagaaaagagataaaatatgccaactttaaaaacaggacttaaacaacttacaactgatttaaacgaaattgaagctgtaatcaatgcaggaaatgcctatcaagaagctgtttcaaaactcaaaggacaaggaaaagcacttcgtacacttgaaaatgatacctcaatttcagatgatacagttgaagttattgccaatcgtacaaatgatttgattagaaatcttctcaaaggttcaaccgcatacaactttacaaagaaatcatttaatgaattaaaaggaaaactggaagaagcagaagcgcaagcacgtagtggcgctaaataaatagtccacgtaaaactttaaaataagggtagggtttgcctttccttatctgaaaaataacattgtaaaagcctcactcatggtaaggcataagagaaaggacacctcaccatgagtgagaaataaaaaatatgacagtaacaaatatgagcaaagcacgcccagagattgatttttcactccataaaccaccacataaagatttatatgatattacaattttctttgctaatggtacaaatcaattttggtctggaattaatgaaaaaaaggtgatgtggctgtgtgagaaatacaatccgatttcaactccgctgtcaattgcgattgctcctcgatttttgcctaaaagcaatatccaaaaacctaactgggaaattagaaagggttagaaaatgaaaagatataaatgtataaaaattgctatatactttacttttttcttagatattttcttagcaatttttggactaacttatttattaatgaaattctttggaggttgaattatgagtgtatttgctgaaagattaaaagagttgcgaaaagaaaaaatcagctaaagaagaaggtgaataagttgacctatgaaaaagcgtggcgaatacttgaaagacaggctcaccaattctttctgaaattacaagaaagacaaacaagcgaaacaaatgaagttaaactccatgattttattagagaaaactttgagattgtggaatttgatgaagatgtgattattttttgtgatgaaaatgagcaaacttatgaacatgatattgtttagaaaatagcagatttaattgtctgctttttattttgggtgaaaatgaaaaaaacaaaatataaatcaagaactccgccaaattattttggtgagatattattttaaattgaaaaaagaggtgaaaatgtacgttgtaaaaacgcgtggtggctatctttgtgccaatggtggagcgactaaacacttaaaatttgctactacttttgatactaaaaagaaagctgaagaagtggctgaaaaatggttaagaagtgatgtatcttttaaagctgttgaaaaagaaagtgaggaatatgagcaaaattaaaatttatgaattagctgacaagttaggggttgagcgaaaagagttactctctaaggctcaagaatttggaatttcagctaaatcaacatcaaaatctttgagtgacgctgaagtattaaaactagaaaatttctatcaaaaatcagatactcaagaagttgttggcgaagaagaatctgaagtggaaacaattgatgttcctaaaaaaaaggaatcgaagttttctctccttgcaggtagaaagcctgaaaagaataagccgaaaatgttaaggaagttgcccaatgaaacaccgcctaagcttaaaaggatttcagctaaacaggtaggggctttggttatgggtggggtcggtttcttaatattgtcaaacgtggtcttgttttgtttgatggcaagtggatacaaaccaacacagaaaatcatttatcaagaagtgagtgctacgcaaaaagcttcaggtaatggacttgatttacaagcgaaaaattatcttgacggatttgtgcaaacttatttcacattccctgaagatgaaaaagaccaagaacaagcagttaaagatattaattcttactttgttcaaaatctaccagtgattagtcaaggcattcaacgtacaccttcaaaatttgagagtgcggtcatgatgagtttgactgacaatgaagcgacttataaagtgacttatagtgcaggtgaagtcacaacaaaagaagtcaaaaaggggaaagatacaacaaaacaaaatgtcgtgaaatatcatgatgaaacaactttgtttacgattccttaccaaaaagtaggttcagcttactatatttcagatgagccttatttttcaagtgttcctgatttacaggcaactgaaaatcaagtacctactaaaacatggtcaggtactgataacaatagtgcttcagtcaaaaaagatttagacaagttcacaaaatcattgtttactgcttatacaactgatggtgatacattgaaactaatttcaaaaggactttcgcttaataaggggcaagagtttaaatccttagaccaagccacttatgaatcaaaaggtgacaataaatatcatgcagttgttcaagttacaatgaaaaattcactcggaacacatgtagaaaattatcaatttacaattgaaaaacaaaagcagtcatattttgcgactgacttcaaacacactttacctgaaggtaagaaagaataggagaaatcaaattgaaagagatactaattaatcatatcagcgtaacttatggtgcgattggattgacaggcttttggaactttttccaagaaaatgcaaaatatgtcatttttgcaggagggatttattttgcaggtagagaatggcaaaagaaggcaacaggtaaaatgataatgatgattgttgttgcagcggttttgtttgttctcacattagaccctcaaacggttttacaaccagttggtcaaaaactatttgaaatgattggtgctaaataaaaaggagttaagattgtcaaaagaaaataaaaaaggactgaaatattctaataaaagttcactttctcaaccattaagaatccaaaaactttttgaaggatggtcgctaggtaaggcttggcggttgtccttttttatttactttggattgattggttttgctttgtggaaacttttattttcaaaatttactgtttttcctgttggttttcgattaatggtgctagggataatttgctataaaagtgcattatttatctctgaaattcgtcctgacgataagacaccacctgtttattttaaagatatgattgtctttttatttaactttggatttgcaggtaagagcatatataagggatggattcatccattaagaaaaggaaaagaggaattagaagaaaaatgaagaaaaaagcaatatgggaaaatcacgtattatcggtgcatgataatttagttttaaaagatgatggcacagtatttgcaatgtttgaagtgcctgcatctattatctcaatgatggataataaaggaaaagaggcacacaaacaagcgacacaagcagtcattaccagtttatacgaaaatttaggctttgaaattttagtgaagccactttcaaaagatttacttaaatcatatgaagtattattaaaagattgcgaccctagaactcgtgaatttggagagtatctattagagcagtcttattcagaattaatgaatgaattaggaaacttacatcattataaattctttttaactgttcctttgagtgatttctcattttcaggtgatttaagaaaaatgatgaaagaaggctggcaacgtttcagaaaatctgttgtaaatttgattcgtagagaattagaattcaatcttaattggtatgaatcctataaacaaacggcttcagatttagaaatgaatttaaatttacttcaggctcgccctttgaagagagaagaaacgctcctttataattcacttaattatttacgtggtattgaagtcaataaagatgaagtgttagctgatgttaaaaatgccattgaaaatatggatgatacaacgatagatgttcgctccgatggactattagaaattcatcatccacaaggaaatagcctattaaaattcttaccattggctgattatccagaagtggttaataatattcatcttatcgaacacttgcaaactttaccatttccagttgaatttcgtatcaaggctcgatttagaaaaaataaaggggctttaggaatggaagctaccgcagagagaaatcgagatagaattggtacggaactttcagaagcagatgaaaaaggaaatgtgacaaaatcttcatctgttggtgcgtatatgattcttgaagatattatttctggggtagataatggggaatatttcctagacttcttacctgtttttgcgattactggttcaactcctgaagaaattaattattataagaagatgttaatgactgccatggaaggtttaggagttaaaattgttcctagtcaatgggatcagccttatcttttttataaaatgcgttcaactgaagaattgacacgttcagacagatattgggttcaaaatatgaaagtgtctgcttttgttgaaaacttgttttttgtcagtcaaaaagtgggttcagatattggattttactttggacgtgttgaccataccactttaaattgggcaggaaactatgaaaaggcaattgcaagttcacctactccgtttttctggaatatgtttcaagccaataaagaagatattgaagggaaattaggagatagtcctcatgtgggtatttttggtgatacaggttcaggtaaatctttcttcgcaaaacttgcatttgtttatcattccatcttaaaagggttgagcctttatattgaccctaaagatgagatgaaatcacagtttttatatgtgagggataaattagaatcttatttgccagaaatggaagaaaaaatagcggatttagtcgctcttattgaagatgatgaaattttggaacgaagaattagaaatctagagtttgtttatcataagcctttgattgattatattaatcatattcattttgtcagtctaaatacaaaagataaaaagaatattggggcattagaccctattgtatttttggaaagtgaacaagcaaaagaactttctacacaagttactgaagggctgattggtacaaaattgactgaagatgatagatttgaaaactcatttaactatcatttacaacaagtcattgaaagaagagcaaaaggtgaaactgttggattgcttaatgtttttaaagaaatggcaaaatcaaaagaagaacttattaaagaccgttcggaaaatatcctttcaaaaatatcaggtacaatgctagaacttgtcttttcagaaggtaaaaatccgtcagttagtatggacgaccacatcaccgttttaggggttacaggacttaatctagctaaatctggtgaagtaaaaacagctcaaaataaaatgtcagatattatcatgtatgcgttaggtgatttttgtcgattctttggtgcaagaaatcgagaccaagaaacggttattttccttgatgaaggttggttctttaatacaacggatattggaaaaggtattttaatgcggatgaaacgtgttggacgttcggaaaataatttcttggctttgattactcaaagtgtaaaagatggttcgtctgatgaagatgatacagcttttggaacaatttttgcttttaaagaaactggaaatacaaaggcagttcttcaagcatttggtttacctgatgatgacgaagatgtgataacttggtatgaaaatcaaactaaaggtcaagctcttgctaaagaccctttcggtcggattggtcgtgttgtaattcatggtcaaaattcagcattgaatgaatgctttaaaacaacgtttagtgaaatggaatcagcaaaggcggtggcatagtgaaaaagaaaatgttgttatttgtagggctattagcattttttatgccttcagccctgcatacttttgcggatacaggctttactccgccctctactcctaatttttcagtttcaggtgataagaatagttctaaaaatgattcaaaagataactcaaaggataattcaaaagataattcatcttctaattcatcaattaatgatggcataataaaaccgccaattggtgatgatttaaatgattatggttcagatgattctccaagtaaagtcatgactgaagcagaaaggaaaaaagcaagagcaaatttagataattatacctcttatatgtattttgatgatggaaaatttctgacaggttcaatgaatgcaggaatgcaaacctttttcattcgttctcaatttttcgttacaaaaacaatttatcgttttgtaaatgcggtcaatgaaaagttaaatagtgattcattaatcactcaatggacagcccaattgttcgtgacggttcaaaacatttataatcaattttctaatcctcaactttatccaattattgcgatagctgttattagtagtcttttattttactggtttaaacgtcgcttttttgaaggggtcagaaaattggcgcttgtgatgatactggtaggtctatttattaatggtggtcaaaagttaactgaacaagttaatactgctttaaatgatgttacaactgctttgatgtcaacggttaaggtggcaggagtttcggcgaaaaattctaatgatttaaaaacaacaatggttgaagttccttttctttaccttaattttgataacgtgaaaataaatgcggatggttcgtctaatatctctgaagataatattgtcaatctcctaacttcaggggatgataatgacaagataaaagcgattcagtctgatttaaaagattcacatttgacctcgaaaaaaatgggtgaaaaagtattaactgctctagcaagtattttcaatgcgatattagtcggttttatttacctagcttttgcaataatggcatttgtaatgagaatgtttttcttaattctcttacttttactaccatttgtggggattctttccttatttcctgtctttgacgtagtaattttaagatgggcaaaagtaacaggtgggtcgcttattgtttctaatgtagtcgttattggtacagctttaattagtgttttagatagtattgtttcttctacagtaacgtcaatgattgggagtgattatttctttatcacccttataaaattaattgtatatattatcctatttaagaaacgtcaaaaaatcttagatattttcaaagcaggacatcttagtaatagtggttttgcaggtcgtatggatggcttactttcaaatgttcgcagaaaaggctcaaatatgattaaagctccacttttggcaggttcttcagcaggactggtcgcaggtttaactgcaggtcaaatggcaactggtaaggcgaaagaaatagctaaacaacgatttacaggtggaactggtagtttgtggcatggtggcttgaataaaaaagcagaccgtactatgaataaaacagataaagcaaatcctgatactaaaaaaggtcaaaaactacaggctaaagaagaaaaaatcaaacaacgtttggaaaaacgcaaacagaaatttgaaaatcctaatctgttaaaacgaaaagtagctgactatcgcaaacagtatcaacaacgaaaaaatgcaactaacccaaatcttgctcaaaaagtggaacaaaaaaataaagaaaagaatgcttcaattcaagctctttatgataaaaacaaaacacaacttcaagcgagagcaattgagcgtagattgcgtgaagctgttcctgatcaagaaaaaccgaatctatcagaattagctaaaaataagcaaaaagctttagctaaagaaaagttagatgaaagagcaatgaaacaatcagcaggtagaatggctgaaagatttgaaaaggaaaaagtcagtcatagtagttttaaacgtaaaccaaactatccttgggatagtaatgataccaatcaaaaacttaacaatccatttgtgattgatgaaaaatagggggtgaaaatggaaaaagcaattaagcggaaggttatattagttagccttccttttttgttgcttttattgccaatattagctttcttttcattatttgttggttcaaattcttcttcagatacagatattaatactaatacaccacagcaacaaactgctaaagtgatttgggatagggttctaaaagaaggtggaacgaaagaaggggcggctgctttacttggtaataatcaagcagaaagtgaacttcaaccttcaattattcaatctagtgcaacttataatgaagcaaaagcaatggataccactctaggtggttatgctttcggcttggctcaatgggatagtggcaggcgagtaaacttacttcactatgcgaaaagtcagaaaaaatcttggacagatactaatcttcaggttgagttcatgtttgagcaagacggtacagattcaacgttacttaaaaaattagtcaaaggaactaatgttaagcaaacgactgaagatattatgcgaaagtgggaacgtgcaggggcggttgatagcctttcaaaacgtcaaggttttgcggaatattggtacacgttcatgacgactggtggtgatagtggaactggtggcggttcaggtattactccagatataccttcaggttggactttggataaaccaattaacacaagcggttatattgcttcaagttatgaatataaacaatgtacttggtttacgtggaatcgagcgaaagaattcggtattacttttagtccatttatgggaaatggtgctgattggcaacatcaagcaggatatactgtaacgacaactccgacaattcatagtgcggttagctttagcggtggtcaaacagtaggcggtcaatggaacgcagacccagtttatggtcacgtggcttttgtggaaggaatacattcagacggttcagtcttgatttcacagtcaggaactggtttaagtacggtttatactttccaagttttaactaaagaacaagccagtcgattacattatgtggctggtaaataatgctttatactaacttgatatttacgttgaaaccagaagtttataaagtatttttccaaataagtagaagagaaatatagtgaggagttaatatgaaaaacttttaaaataatatcagtacaaaattcaaaaagatactaagactttgaatgaactacaactaattatgttttaaaattgaattaagtataaaaagttatgaatttttgtataattctttttaagaacctcaactaaattatctacatttccttaaaaccccaatttaatgctagtcatgcacaaacatatatgatataattacacatataaacgctgtttagaatttactttattaaaattacattttttaggagaaaactatggcactatcattaaatgtttgggaagaactgtcagaaaatgaaaaaaacaaagtagtaaattttctgagaaataactgtcgcattgattgtgaggaaccagcatcggataaaaataaaccaaaggcttacccaattaatagtggcttaacttctggagggtttgataagaaatttggggaacaataccgaattaatattcatagcattgaggggattcctagttttttaatggctgagttaaaagaacctggtacgaagaatagagtcggtggaagtgaagcaataaaagcaatcatgcattacggtcaatttgaaattggttcaaactagaacttgcttttaactatcttgattagtaattaaattaaagaaatctaaaaattataattgggcgaggctgtaacatctacctcgcttattatttttcttaaaataaaaaggtaaagtaactatttagttaaaaattaagttcataatatagttttgtccaaaaattaataattacggactatagtttttagacaagcaacagtaaatagcatatagagtttttattatttataatattcttttgtgaattgaagaatttttaaaagaatgatgaggtattgaagtatgagaggaaactcaattttaaataaagcaaagtattcagataatactgatgagtggtatacagactacgcaactgtagaaagtgaggtaagtaaatataaagagcagtttgaaggtaagattgtgctgtgtaattctgatgatccttttgaatcatcattttctaagtattttttaaagaattttaacgatttgaagttaaaaaaattaatatgtacatcatatagctattcaagaatatatgaaatagttaatattgaaaacgaattaggaatagatcagggctatggaatgatagttgataaagttccaaatgacctaaacaaaaattcaaatgaagaatatcttgtagactatattaaaaaaaatgcaaaactatttaaattaaaaggtgacggggattttagaagtgaagagtgcatagaatatttaaaagaatcggacatcgttgtgacaaatccccctttttcaaagttttcggaaatgttttcattacttgtaaaatataaaaaaaaatatctaataatagggaatcaaaatgcattattatataaagaaatttttccaagcattaagaataatttaacatgggttggataccattttggggatatggcattcaaagttcctagtgatagtatgcctagggaaacgagatactggatagatgagactggtcaaaaatggagaagtataggtaatgccatgtggcttaccaacctctgggttaataaaagaagtagaaaattaatattgaaaagtaaatatgtttctgagttatatccgagatatgataattttgaagcaatacatgtttccagagtagcaaatattccattggattatagtgggattatgggagttccgttaacatatattaaatatcatgatgaaaatgactttgaaataataggagaagcaaatcatggttctgataatgaatatgatttatttaaaccagtagtgaatgggagagaggtttataagcgtatattaattagaagaaaaaagaggaattaaaatgtttaaaatactagatttattttgtggtgcgggtgggatgtctcatggaatggacatgaatcctaattttgaaacagttgttgcagtagatataaatgaaaaattatctcaaactctgaaagaaaataatcctagtgtagagttaattattggagatattcagaaaaaaagtataaaagacgagattttaaaattatctagaaatttagaagttaatatggttattggtggtccgccttgtcaaggtttttctttaaagggaaagaacctaggtttagatgaccctagaaattttcttttcgtagaatatttagatatagtaaaacaattaaatccagaagtatttgtaattgaaaatgtaaaaaatatattgtccgcttcaaatggctggtttaaagaacaaattctaagtactattcatcagatggggtatcaaatatctttcggcgtattaaaagcaacaaattatggtgtgccacagacaagagaacgagcgatttttttatgttctagagataaattgattgaattgcctgaacctacggtcgaaaaaacggttactgttaaagatgctattggggatttagcgtatttaaattcgaatgaaggggagttcgaacaggaatatataacgaatgcaacatcaaattatcaaaaaatgatgagacgcaatagtataaagctctataatcacaaggcgtccaaccataataaaattgcgattgaaaagttgaagttgattccagctgaaaaaggtaaggagtatttaccaaaagaaatgcagggaaagcaaaagtttaagactacttggggaagattagtttggaatgagccatcacctacaattgatacaagatttgatgcttcatcaaatggaaaaaataatcatcctttcttacatcggtcaattactcctagagaggcggcgagacttcaatcattcgatgataactatattttttatggtaaaaaagtagaaattaggacacaaattggtaatgctgttccaccattaatggctaaagcaatagcagataaaatctctagcgtattaaattagaatttatatcttgtgctttcaggctttagtactacaagaactaagtatgcatatactttttagtgaaaataaaaaaatggaaattgaattagatttccattttttgttttgtctgccttaatgaaactggaagaaaacctataagattcttagataaacaaattattaattagaaaaaatgaggatagaaaaatggaaacaccaaaaatttatgttgtgaatttaaacagttttaacaatggaagaacaagaggtaagtggtatgaattacctgttgatttttcaagaattaaatcagacttacttttagatgtagagcatggggaagaatatgcaatacatgactttgaaaatttttacggttacaaaataggcgagtattcatcaattcaagaactaaatgagtatgcggacaaattagaggaaatttctgatatagatcatttaaaagattttcttgaaatttatagtattgatgatattatctataatagagatgatttggactttgtggaagctgaaaatgatgaagatttggcacaggaattaattgaacaaatgggaggtttagaagttctaagtatagaaacgttacaaagatattttaactttggtgcttacggtcgtgatttagcgattggtgattattcaaaaacaagtcatggatatatcagagatatttaaaggttaagtaaaagagcaagaggaatcttgctctattttttttttgcgttatacgaaaaagataaaggagaataaatttaatgaatcaaaaactaataaataaaccaataattacaagtgaagatttagagcaattaggcattccaccaactcaggctaaaagggtagtacatgatgcaaagaagagagcagtttcagcggggtataccttttataatggcaagcaaaattttgcaccatttaaatttatttgtgaaattatagggattggagaagtggcataatggcaacaataagatatagacaacgtggagtaaaaaaactttggcactatgaaattagaaatgaatcagggaaaagtctagcttatcaaggcggttttaaaacaaaaagaatggcacaattagccggtagtccaatttttcaggaaattcaaaaaggaacaactctcaatagtgaaatgagcttgccacaactttataaacaatggtatgaattgaaaattgaaaaaagtggtagaagtaaggcgacactacagaaatatttacaatatgagcaaaaaatcgttgagtatttagattttcctttaaacgttatcactcctatgctttatcagaaacagcttaatattattggaaaaaatgttaatcgaggttttctaagtctaatgacaaatgctgtaaaaaaagcgatacaaatggcaaaagcagataaaatatttgtagaagattttacaattggggttgaatatttttcagataagacggaaaaatcatcttctgaaaaatatttacacaaatactctgatattacattggttttgaaaacattaaggtctgaaatggactataagcaaagtgttgttagatattatctttatttattatttactacaggtatgcgccctggggaattattggctcttacttggaatcatgtagattttgaaaaacaattattatatacagataatcgagtaaattcaagtacactagaagttgttgctcctaaaactaaagattccattcggtatgttcctattaacaatgaatctattatggtattaaaagagttgaaaaaagagcaaaggataactaataatgaattaggaataaaaaacgtgcataattatgtgtttcagcattacggactaaaaaaagagattccaacaaatgcgagttgcaataaaatattgagaaaagttttgaatcatttagagattaaaccagtcattacaatctatggtgcaaggcatactagagcgacatttttgataactgaaggaattccactcgacgttatagccaaagtattggggcactcggtggaagaattaacacgtacatatagacatttgctttcagaaacacgtgaccgtgggtttgaaaggataaaaaatttataattaaaagtggggcagattttggggcagaaaaaaataaaaccacctgttagctagtaacaggtggaaaaggagtaagcatgttataaggagtcaaggggatttgaacccctgcgccgctttacacggttcgacggatttcgagtccgctgcattaccactctgccatggctccagtcctttatctaaattaattatatcacagttgatcctcttcttgaaataatatgaaattgctagaacgaaaataaagcgcatatttatacaaaaatgttgacaaatgaataaatatgctgtacaattgcatttatattaatttgaaagaagaaaaatgatgggaaacaaaaaaattgtcttggcatattcgggtggattggatacaagtgttgctgtaaaatggttgactgataaaggatttgacgtcattgctgcctgcatggacgttggcgaaggaaaagacttgaattttattcatgataaggcgcttcaagtaggggcggtggaatctgttgttttggactgcaaggaagaattcgctaaaatatttgttggagcagcactcaaaggaaatttaatgtatgaaaataaatatcctttagtatccgctttgagtcgtcctttgattgctcaaaaattagtagaagttgccaaagaaaaaggggcaacggctattgctcatggttgtacaggaaaaggaaatgaccaagttcgttttgaagtagccatccattctcttgcatctgagcttgaagttattgctccagttcgtgaatggcattgggctcgtgaagaagagatcgaatacgccaatcaaaatggtgttcctattcctgctgatttagataatccctactcaattgatatgaatttatggggacgtgcgattgaagctggtgttcttgaaaatccttggaatacttgtccagaggatgctttctttatgactaattctgtggaggacgctccaaacgaagctgattttattgaggttgaatttaaagaaggattaccaatcactttaaatggaaaaagcttagaattgcatgaaattatcaaagaagtgaatattattgcaggtaaacatggaattggtcggattgaccatattgaaaatcgactggttgggattaaatcacgtgaattttatgaatgtcctgctgccattactttattaaaagcacataaagatttggaagacttaactttcgttcgagaacttgcacattttaaaccagttcttgaaaatgaattggcaaacttgatttacaatggtttgtggttcaatcctgctactaaggctttggttgcttatcttgatgaaactcaaaaagtagttaacgggattgtaaaaattaaattatataaaggtttagcaacaccagtgggacgtaaatcaactaattcgctttacagcgaaaaattagcaacatatactgctgcagatgagtttgaccaagcagcggcagttggatttattaaattgtggggtctacctactcaagtcaatgctcaagtaaatctcaaataatagctataggaaaatttggaaagtaagagaatggtagaaaaactttggggaggacgttttgaggcgtcactagataaacaaacggaagaatttggagcatcaattaaatttgagcaacgacttgctccttttgatttaaaaggctcattagctcatgtaaagatgttgggtgaaacaggaattattactaccgaggaatcccaaaaaattgccgaaggtctgaaaaaagtagaagaaaagcttcttaatggccaaattgaattcaagatggaaaatgaagatattcatatgaatatggaatcttatcttcatcaagaaattggtccactagctggtaaattgcatacggctcgctctagaaatgatcaagtggcaacagatatgcatttatacctcaaaagtatcttagaggccgttttagaagctttaaaagggttaagagaaacaattgtaaagctcgctgtaaaccaaattgacactattatgcctggttatactcatttgcaacatgcacaaccgatttcctttggtcaacatctaatggcttattatcaaatgctgacacgtgattttgaacgttttgaatttaatgttaagcatacagatatgaatcctttaggagcagcagctctagctgggacaacgtttccgattgatagaatgttgacgacaaaattacttggttttgagaaggcttatgataattcaatggatgcggtcagtgaccgtgactttattttagaatttctatcaaatgcaagtttgttaatgatgcacttatcaaggttttgtgaggagcttttactatggtctagtcatgaattcaaatttgtcagtctgtctgatgcatattctacgggttcttctattatgccacagaaaaagaatccagatatggcagaattaatcagaggaaaaacaggccgcgtttatggaaatcttacagctttattgactgtgatgaaaggtttacctttagcttataacaaagatttgcaagaagataaagaaggaatgtttgatagtgctgatactataataacttctttaacagttatgaatgggatgttgtcaactttaactgtaaaccgtgtaaacatggaaaaatcaactgaacaagatttttctaatgcgacagagttggccgattaccttgcagcaaaaggccttccttttagaaaagctcatgaattagttggtctcttagtattagattgtataaaaaaaggaatttacctccaagatgtaaatttacaagattatcaaatgctatctccattaatcaatgaagatgtttatgaaattttaaaatcaagaacggcagtttcaagaagaaattctctaggtggtacaggatttgaatcggttaaaaaacaaatagaagaagcaaaaaaagaacttcaaatttgaagttcttttttataattagttttttacagcaagtgatttagtatgtgtaaagtagtttattaagttaaagacaaccagaattgctgaacccacaaagacataacgatagtcaataaatccagcaatagctgaaccaagtaagggacctgcaaaagcaccaattgattgagcagattgattataagagaaaattcgaccagtaatagcttgaggagattcttttgctaggatggcttgaactgaagggagaattgccgcatcagaaactccgacaagtagtcgcataacaattaaaaaccaaacattagttgtcattgctgtgattgagaagacgattagtgaaaagaaaagtccaaaaccaaggatttttctttgaccaactttatcacctagacggcctaagaatggagcagccactaatgtaacaattcctggggcagcagcgacaattccggccatgaaagtaatgtttccttgaccatgcataagttcttggacatagagtgaaagaacaggattaatcgattgattggtcatttgagtaatgagggttgcaaaaaacatgccccaaataatggctgggtgggtaacaacttcccaaacttgtttataggaaagcatgtttttcttctcaacgggcttaaatgtttctttgacaaaaaataaagcaaggaaaaagacgagaaacataatgattcctgtgacgctaaaaacgcgacgataaccagttatattaacaagtattccgccaatgattggaccgataagagttccagcaacagatcctgttgtaaggagcgataagacggcccctgatttttcctttggtgcagaactggccattaaggccattgaattagaaacaaaaccggaaaatgccccaagtagcatgcgtaaaataagcaattgccaagcagctgtaacaaaagccattaatgaaattgaaattgccatcccaagagaagcgcgtaagagcatcaatttccgacctttctggtcagctaatcttccccaaaggggagaaacgattgctaaaacaataaaagtggatgagaagaccaagcctgaccagatgtttaattccgtttttgagtaatggccaagtgtactgatgtaaagtgatataaaaggggcgataaggcttgaacctatccccgtcataaatgtcccaaaccaaaggacaattaaatttcgttgccatgattctttcatgaatgaatgtccttcttttttgatgtattcataataatattataaaactattgttcgtagtttgtcaatgacgaaacattgcttgaaaaagattgagaatagttttatactgatagtaagatagtttgaatcgactataaaagttcaaacttcgagtaaactttcgacatcgaaagtattgaaaggaatccaattatggcaaggattgcattgactcgtgataaaatcgttcaagctactattgaactagctggtaaaattggtctctctaatgttagttttccgcgcttagctgagtattttggaattaaagctccgtcactttataatcattttaaaaatatggaagaagtacgtgtggcaacggcagtctacctccaaaaagaattaaactatgaactaactcatgcaatggtgggactaactcctttggcagcacttagggcttatgctgagagttataaaagattcgctgaaaaatatgaagcagtttatgaactgattaatgtaatacaccaaacaaataatggggaacttgaatatttggcaaaagaaaatattcgtttggttcgtcgaagcttggaaaattttcatttgtcagaagaagaaaattttcatatcagtcggatgtttcgctcaacgcttcatggatttatcactttaacacaattaggatatttccgtcagtctggatcaatttctaaagaagaatcctttacttacatggttgatcatctgcttagtcgtctagataatccagaaaatatttaaaaataccttgttaaatacatggtatttttaaatgctaaaagggacaccatctttggggacaatgataaatgaagcgactaatccagaaacaatgactgataagccttggacttgggttccagcaacagtggtcatcctaattgtggtgcttgctattatctttattggaaatgcgctaagacgagtggctgaccaaagacaagctacaagataaacaacattcaagagtgataaaaatgtttatctattaaaaatggatatgataaattaaatattatattgaagcaagtaagaaataaaaagaaattattggagaaactaagatgaaaaaattaaaagtaactttattggcaagtggtgtagttttagcagctgccctcttaagtgcttgtggctctaaccaaagctcaagtacaagtacgaaaaaattaaaagcggggaattttgatgttgcttatcaaaacccggacaaggcaatcaaaggtggagatttaaaaatcgcttatcaaagtgactcaccaatgaaagctgaatggttggctccactttcagatgacgctacctttggttctatgtctggtcctggtggtgggcaagatggtctcttctttaccaacagttcatttaaatatatcaatggtgggcctgctaatgtaagtcttgacaaaaatgcaaaaacagcaacgattaccttgcgtaaagatttgaaatggtctgatggctcagaagtgacagctaaagactatgagttcagttatgagcttaccgctaatcctgcttatggttccgaccgttggactgattctctggcaaatattgttggcttgagtgattatcatgcgggtaaagctaaaacaatctcaggaattactttccctgatggtgaaaacggaaaagtcatcaaggttcaatttaaagaaatgacgcctggaatgaatcaaacaggaaatggttattttcttgagactgtagctccttatcaatatttgaaagatgtcgcccctaaagatttggcttctagtccaaaatcgacaacaaaacctttggttacaggcccttttaaaccggaaaatgttgtttcgggtgaatctattaaatatgtcccaaatccttactattggggtaaaaaaccaaaactaaattcgattacttatgaaattgtatcaaccgcaaaatcagtcgcagccctttctgcgcataaatacgactttatcaattcgatggctaatagtcagtataaacaagtaaaaaacttaaagggatacaaggttttaggacaacaagcactatatatttccttgatgtactataacttagggcactatgatgctaaaaattcaattaatgtccaagatcgtaaaacgccattgcaagaccaaaatgttcgtcaagccattggttatgctcgaaatgtcgcagaagtggataataagttctcaaacggactttcaactcctgcaaatagtttgattccacctatctttaaacaatttacgagttcatcagttaaaggatatgaaaaacaagatcttgataaagctaataaacttttggatgaagatggatggaaattgaataaatctacaggctaccgtgaaaaagatggaaaagaattatcgcttgtttatgcggctcgtgtaggtgatgcaaactctgaaaccattgctcaaaactacatccaacaatggaagaaaattggggtaaaagtgagtctttacaatggtaaattgatggaatttaattcttgggctgaccatatgatgactccgccaggttcagatgactgggatatcactgacggtgcatggtcactctcaggagagccttctcaacaagatttgttctcagcagcagcaccttataactttggtcactttaatgaccctgaaattacaaaagatttgaatgatattgactcgaccaaagctgaggattcaacttatcgtaaagctgcttttattaaatatcaagaagatatgaataaaaaggcctatgttattccaacggcttatgctatcaactataccccagttaacaaacgggtagttgggatgacgcttgactatggtgcaatgaatacttggtcagaaattggtgtttcatctgataagatggcaaccaaatagttttgtttaacttttgtttacaagtttttttgtaaaaataccctcactttagttttcgcaattctaaagtcaaagaagctcaaatttatgatttgagcttcttttttttgatgatttttaagatttgaacttacgaatttaaaaattaattaatttaaaaatgctataataagcctaactaataattaatcgagggggcaatatgctagtaaattttagagatattcaggcacaaaactcaaaagaatccggactaaaaaagaatatattttttagaggaggtcagttgaccgatttaacagctgaggataaaaaaattcttacgaataaattccaaattgggaaaatttatgattttagggggcaagaagaggtcactactcaaccagatgttgaactcaaaggaattaaatatgaaaatatagatattttagcttctgaaacttcaggaaataatggctctttacaggatatgattattaatgccacagatattagtgaagcgatgatgaaaacttatgaaagtatcgtcatcagtaagtctgctttagaaggatatcgagcttttttactggatcttttagagcaaaaacaagctgtttattttcattgttttgctggaaaagatagaactggatttgctgctgccttgcttttaagactggcaggagcttctgatgaggagattctgaaggattatctcaaaacgaatattgctcgcaaagaggtgaatcaagaaattatcaattcattgaaagaaaaactcactgaagaccaaatcgagggattacagattgctcttactgtggataagaactatttatttcatgccagagaaataatgaatgaaaattttggttcttttgagggctacttaagtgaaggactctcacttgagaaggattatatcgagcattttcaaagcctctatttaaattataaattataaaaaagtgattttgaactcttttgctaattgatgtataattaagttaatagaatacattggaggtacaaaagatgattggatgtagtagttttacactagagagtcaagataataaacattttctttctcgtacaatggattttcaaatagaaatggcggaacaaattctttttattccaagaaacaaggagataggaattgcccactctaatgaagagacaattgaaacatcctatgcttgtttagggatgggtgcgatggaagaggggcatccagtactctttgatggaatcaacgaaaaagggttaatgggtgcgactttgtatttcccaggctatgctgactatagtgagaatatccaaaaaaatcaaaagggaatttcacctgatatggttattccaacggtcctcactcaagctagtaatttagaagaaatcattgatttatttgataagaaatttgttattattaatgatactaatccaaccttaggtcttacgcctcctttacattttattttttctgattctagtggtcaaagtttgattattgaaccaaggcaaggtggactttcaattataaaagattcaattggagtgatgacaaatagtccagattaccaatggcacgaaactaatttaagaaattatctttcttttacacctaatcaaaaagaaagtatcgaactattaggaaagacattaaaaccatttagtcaaggttcaggtacttttggctttccaggagattttacgcctccttcaagatttgttagaacagcttatttaaaaaactacgctgagaaaccaagtaatgaattagccgctattacgctttgtcatcatatattagaatctgtaagtattccaaaaggaattgttataactgagcatggagcaaatgatttcacttgttattcggcatatatgtgctcataaactctaagttattatttttcaacttatggtaatcaaagaatcaggaaaataagtttgtcagaatccttgaaaaatgagaaggaatttaaaaactttcctattgtcaatgaggaagatattttagagttaaattgataaatatttaatcgagtaaataggagggatattcattaagttctttgaattcaagaagtattttttaaatattagttttaagtatagcaaacctaaaaagaaattcgagaaataatagagagaaattaaggaaaaaatagtgattttaaatttatttataatagttttaatgatttttcttacggcattttttgttgcggctgaattttcgctggtaaaaatacgtaaaagtcgtttagaaacattagaaaaagaaaataataaaagggcaaaattagcacttaatatcgtcaatcaccttgattcttatttaagtgcctgtcaacttggaatcactttgacttcgttagcaattgggtgggtaggtgaaagtacaatgcatagtattttagctcccctcttgtcttatgttcctctaccttctgcgttattagacagcttgtctattatcttagcctttttattaattacttttgttcatgtggtaatcggagaacttattccaaaatctttaagtattacaaaaactgaaggagttgtcttaacggttgctgctccgctccattatttttataaacttacctatccttttgtgtggttattaaatgcttcagcaagttcaattggtagattgtttaatttaagtttggctactgaaggtgatgaaatccattcagaagaagagttaattttaattgctaatcaaagttttattaaaggggaaatcaacgaaaaagagtacgaatatctcaacaatgtctttgaatttgatgatttgatagctaaggatatcatggtgtcgagattagatatggagacgattcccgttgatgtttcgattgaagaagctttaaaatttgcgattaaaaaagggcacactcgtttccctattattgctaaaactaaagatgatattctaggctatgttacgctccaaaatttgattaaagagtatttaactgctcctggtcaagaaataaagaaaatcatgcaagaacctattatatttattgatactattcctgtaaagttattactctcagagatgcaaaaagagcataaacattttgctattttattggacgagtatggtgggacaagtggacttgtgacaattgaggatattcttgaagagttagttggtgatattcaggatgaagaagatcatgagaaagaattggtaataaagctttctccgactacttatcaggtagatggtaaattgcttttatctgaatttgaagaactgtttaatattgatttggctcaaaataatttaagtaaaacgattagtgggtttattacaaattattcactagagcaaaatgagccacttgaggtaggacagactttcgaatttgataatttaaaaattactattattgaaatggataaaattactcctcatattttagaagttaaacgagtgtagattgtatttgaggtataaaaaaacggagctttaagaggctccgcttttttttattttattgacgaacgacgaggacatcgcatggtgcatttttgataatgtaatccgccactgaaccgataaagatacgttcaatgtaagaaagaccagtagctccaagaacaatgaggctaatttcttcttcttttggaagagtttggccaagcatgacttttggagaaccaaattcaacacgagttttgacttttttaacgccagctttttttgcttcgtcagcaaagtcattaatgaggttttcagcacctttgtgtgtatcatcagcaacaactgaatcataggctgagatagattggaaggcacgaaggtcaatgacgttagcgataacgagttcagcatcgttacgaagtgctgttgcaactgctttgtcaaaagctttagtagcttctaccgaaccatcaataccaacaaggattttcttatagttatctaacataggcgactccttcataagtttttatctatattttaattttactcttattttgtcaatttgtaaaaagaaaactgttaaaaaatggtttatggtataattgatgaagtgaatttctttaaaatagtggaaaaaattactgacagaaatagaagttctctattgaaagtctgtcagcaaattttgatgacttatgaacttaaagaaaactgtaagaaataggtgaaaaatatgactcgatatgctgtggtggatctggaagcgaccgatgctcatagtagtgaaaataaaattatacagattgggattgttcttgttgaagatggagaaattgttgaaactttttccactgaagtcaatccacatgaacctttgcttccaaggattagtgaactgacaggtttgtcagataaacagttaaagacggctcctgagttttcagaagttgctgcaaaagtacgagaattactgacagacagtgtttttgttgctcataatgctaggtttgattatggacttttagaaaaaagttttcttaatgctggcttggaatttaatgaaatgttgcgtgtcgatacagtcgatttggcgcgtgttttttatccaacttttgaaaaatatggtttagaatcattgagcgaaaagttagatttggcacatgaccatccgcatgccgcagtttcggatgcgtatgctacagctgaattattgctgaaaatagaagcgaaaatccaaaagttaccaagaagcgttttggaagagttgcttagacattcggacaatttactttttgaaagtaaaacttttttacaagagcagttggataaaacaaaaattcgaccagctggctttaaagtggttcataatattgcgacacgtaagtttagggcttctgtcagtaaaaaaaatcccctgacagccttgtcagcaaatttttcagaaaatatcagtagattgggcttgtcttctcgctcaaaacaagaaaaattagctcatttaatggaaacagagcttacacatttacaagcaagttttattgaggcaccgacaggacttggaaaaacttatggttatttactgccaattttggcctcaggaaaaggtttggtcgtttcaacagcaaccaaagttctccagaagcaattagtaaatgatgtggcaccaaaacttgggaaaacatttggtttaaaaatggccaagattgttgggactaaaaattacatttctctgagaaaattttctgagcttttattaaataatactgacggcaaaaattttgaaatttttaaaatgaaaattttaatttggctgacagaaacaaggacaggcgaattggatgaagtttcaaaagtcatgactaatgatgactattttgaaggcattcgccatgatggctatgtcaatacaaaacagcttcattatgaacaagatttttggttgaaagcccaaaaagaagctgaacaggctgaaattaaagtggtgaatcatgcctatttgattgaacgtttagctgactatcctgaaatttttttggaaaatcgtgttcttgttgttgatgaggctcaacaattatttcctatcatggaaaatgcgggtcaaaaatctttaaaaattactgacgaactgataaaaattgatgctgaaacaagtgaaaatccccagctgaccgaaaggcttcaagaaagtcttgtttttcagcttaataaaaaagagcttgatttaaataaaataaagatagatgctgatgaacttggcttgagaaatctgtcagcacttttagaagctgataatcaaattgtctggcgtgaaaatgggatgctttatgcgagtgaccaagatttctataattttgaacgattgattcctaaaaataccaaactttttatgttgggagcgacattgtcattatctaaagacaaaccgtcatttcctgacttgcttggttttacagactatcgctttttcaaaattgaaggaaatcaagccactaatcagcaattgctgacggtgacagatgcgcctaatatcaaaaatctaagtttaattgattatgcagattacacagcaaattcaattggagaactttcaaaattgaatttgccaatggtggtcttatttacttcaaaaatggctttgacttttgttgctgagaaattatctgctgaagggtttgagattttagcacaagatattaatgggagtccagcccaaatcaagaaaaagtttgataaaggtgaaggaaaaattttattaggtttgggttctttttgggagggagtcgattttgataagcaaaatcaagtgattcttgttattccaagacttccttttgcaacgcctgatgatattttaactaaaaaatatgcgcaaaagtttgaaaatcctttctatgattttaatgttccaatggcaactttaaaattacggcaggccattggtcgggtaaatcgtcgtaaatatcagtactcaagtatcgtcgtattagataaaagacttgcagggaaatcttacgctaaaagaatgcgaaaaaatctttcagaaactttacctgtaaaaatgctgaatttactagacacaatcagcgaaatcaagaattttttgatataataaaacatgtttaagcaaaaacttaaaatgggaaattggacaaattattttttcctaatcatgagaaattttactaataagccttcaaataatctttgaaaaaaagattttctcaaattttgaaagaagaaaaatatgaaaaagcgaaaaatgactcgacattcgcaaattataattggaattttagtgataattttagccatttatttgtctatcagtcttttcttttggaagagtctaaatccctatcattccgttcgagcgcaagcgattgacattgccacagaaaaaacagatttagttaaagcgacaggatttgatattgctgcaactgacaccgtgacttattcaattgttggccttaataaagcgaatcaagaaattggaattctaattccaaaaaaatctggtaaaattaaagaagttaaattatcgcaaggggtttcaccagcaagcttaacgacaaaagatacgaaatcagttgtcttagcgctttacaaagggaaaccggcttgggaagtaaataatagcaatggttttaaagtttatgactttgagtcaggaaaagagttgatatgaaaaaaaattctgattttgtattaaaaatggatgagtccgtcactcttgctgcggcaaatcgcgcaaaagcattaaaagcacaagggcgagatattattgacctgacacttggtcagccagacttttcaacaccaaaaataattggtcaagcagctattgaagcaatcgataatggcaaggcgagcttttatacacaagctggtggacttccagaattaaaaaatgcagttcaacattattggacgcgtttttataattatgaaattcaaccaaatgaaatattgattacagctggagcaaagtttgccctttatgcttactttatggcaactgttgaccctaacgatgaggtaatcattcctgctccttactgggtttcttatgttgaccaagtgaaaatggctggaggaaatccggtaattgtagaagccaagcaagagaataattttaaagttacggttgagcaattagaagaagcaagaacaagtaaaagtaaaattttattactcaattcaccttctaatccaacagggatgatttattctaaagaagaattaacagccattggagagtgggctcttgctcatgatttattaattttggcagatgatatttatcatcgtttagtttataatggagcggaatttacagcaatttcaagtctatctgatgaaattcggaaaagaacgacagtgattaatggtgtttctaaaacatttgcaatgactggttggcggattggactagctgtaggtgatccagaaattatttctgcgatgactaagattgcgagtcaaacgacttctaatccaactgctgttgctcaatacgcagcaatagaagcttttgaagaaagagataatagttttgagataatgcatgcagcatttgaagaacgtttaaatatcatttatggtcaactttctgaggttccaggatttgaacttgtaaaaccaaatggtgctttctatttattcccgaaagtgactaaggcaatggcgatgaagggatatagcgatgtgactgattttacaactgctattcttgaagaagcaggtgtagccttggttacaggagcaggttttggttcgccagaaaatgtgcgcttgagctatgcaacaagtcttgaaaatttagaagttgcagtggcacgtttaaaagattggatgaatgaatgatcgataagaaagaagcaaaattggcctataaactttcaaaaaaagttggagcagttgttgcttataagaatctcgaaacgaatgaacgctatattgatatagcaccagatttagcaggtgtaaaaaatcgttttgaatttgccaaaaaaacgggaattggcttaccttatgccattgaaaaagcagcgaaaacagctgattttgaattggaagttcttgaagaattagaaaaagatgagctgcaaaccattaaagaattcaaagatgatttaaaaactttaaaagaaatctgggttgaaaagttataaaagtattagtaaggaccccattaaaaactcaaatctccgctttgtgtcagctttttctgtctgcgttgtcagtcctcctagacggtgctcgcaccgccttcgtctgatttactagcagacaaaaaaatctgttcacaaatcaaaaaagcagtttttagaggttcctaaaaaaaattataaaatagaaatatagatagaaggacttatttatgaaagacttaatttcaatcatcgacgtcaaagaccacgttggtgaaacggtaaaaatcggcgcttgggttgctgacaaatcaggtaaagggaaacttcaatttcttcaacttcgcgatggaacagcatttttccaagctgttgttttcaaaccaaatatgattgaaaactttggtgaagaagaaggaacagctaaatttgatgaaattaaacatctctcacaagaaacttcagtttatgtgacaggtgtcgttaaagaagattcacgttcaaaatttggttatgaacttgatgtgactgatttggaagtgattggtcaatcacatgattatccaattacaccaaaagaacacggcgttgaattcctccttgataaccgtcatttatggttgcgttcaaaacgtcaaatggcaatgatgcaagtgcgtaatgcaatcatctatgcaagttatgatttctttacgaaaaatggcttcattaaatttgatagcccaattctttcaggaaatgctgctgaaaacacaacagaactctttgaaacagattattttggtaattctgctttcttgtcacaatcaggacaactttatcttgaagctggagcaatggctcttggacgtgttttcgactttggaccagtattccgtgctgaaaaatcaaaaactcgtcgtcatttgacagaattttggatgatggatgcagaatatccatttgttactcatgatgaatcattggatattcaagaagcttatgtgaaagctttgattcaaggtgttttggataatgctgcttatgctcttgaaacacttgaacgtgatacaagcatgttgcaaaagtatattgatacacctttcaaacgtgtttcttatgatgaggctattgatttgttgcaagcacacgaaaatgatgaagatacagattatgagcatgtagaacatggggatgacttcggttcgcctcatgaaacatggatttcaaattactatggtgttccaacatttatcgtcaactatcctgcaagttttaaagctttctacatgaaaccagtccctggtaacccagaacgcgttttgtgtgctgaccttttggctccagaaggctatggcgaaatcattggtggttcagaacgtgaaactgattatgatttgttacttaagaaaattgctgatttcggtttagatcctaaagattatgattggtatttagaacttcgtaaatttggttcagttcctcatgctggtttcggacttggtcttgaacgtatggttacttttgtcgctgggacagaacatattcgtgaagcaattccattcccacgtatgattaaccgtatccaaccttaataaaaataaaaaacctctactttaagaggttttttatttttactattaagaggtttaatgctagttttaaaagaatattgtatgaaatgattaataaatttggagaatgatagcctttgcaagactgtgatataattaacttatgaaaaataaagaggaacctcggatgaagtggtcggatgatgaatatgaagcaatgatagatttggcaacaaggcagttagctgagcgaatggctgaaagagctttgatgacttatgagatttataaatatgattatcttgattcgcagtttgtggccgattttattgcagagtttgtcattagtgcttatcgttcatatttaatcaaaccagaaaatcttgatgaagaggtgatgcttttactatttgtcaacatggcttatgaaaatatgcgaggattgccagatgaagtggcacaataccacagactttttagacaactttgtgacctttattatgaacaaggttgtttacgtcatgctctgattgacgaagcagactatcaggaaatggttttggcaattttagctgatatttttatggaagtgaaaatgagaaaaaaatttaaaaagtaattttgtaatcttaaaggggagaaaatggatttagatgcttaccaaaaagcaattatcaaatttgatttgaatgaaaaaatagagagtcaaaatgaagtagattttgcatttgtggataaagttttgggattatctggtgaagcaggtgaagtggctgacaaggtaaaaaaagttatccgcgaccaagagggaaagctgtcagtcaatgataaaaaggccatcggtcaggagcttggtgatattctttggtatgtagcaacgagtgcacgttatctaggaatttctcttgaacaaattgcgagtgaaaatattgagaaattagagagtcgattgagtcgtggcaagatttcaggctcaggggatgagagatgaaaatattgattgtggctggtttgccagattttatacctaatgaaagttttgataaatatattggtgtggatagagggtcactatttttagtggaaaaaggttatcaattggctctggcaattggtgattttgattctgtcagtaaaactgaacttgataaaatttctgtcagtactgacagattgattaaattgcctgctgaaaaagatctgacagatttagaagcagccttagattttattttagaacattttgctgatgcggaaattgtaattgctggtgctttaggtggacgtttggaccatttactgaccaatgcttatttagcaacacgaccaaaatatcaagccctcgctccaaaaatgactttagttgaccaacaaaatttggtgacctacttgttgcctggtcagcatttactaaagagaaagccaacttaccaatatgttggatttgttcaagtagaaacaaaggatagtttagccattgaagaagcaaaatatcctttgaaagcagaggataattttagtcaaatctatgctagtaatgaatttatcagtgaccaaatgaaagtttcattcaatcagggaatggtcattgtaatttattcaggcgattcgcataaaaaataaataataagaggttaaggagaacggaaaaagtatgattattggagtcattggggcaacatcaaatattgcaagtaaggcttatttaccagtttatgcgaaaatgcaggcggaccatcgttttattttgtattctcgtcagtgggaaaaagctgaagaagttcgcaaacattataaatttgaatatgcgacagaggacttgtcagcactagaaactgtggatctggttattattcatgcggcaacttcccaacattttgagttatctaaaagatatttgtcagcgggagttcctgttttaatggataaacctgtttcagaaaaattatctgaagtaaaagaattgcaaaaaattgctgaccaaaataataccttatttgtcgtcgcttttaatcgcagatttgcaccacaaacagctaaattaaaagctctcccagataaaaatatggtgaaagtaagtaaaaatttagcaaattctgccagtgaaaaaattacattttcaatgtacgatatttttattcaccctctggacaccttgatttatttgctagatgatgagattttagaagtcaattattcattaaagaagaatcaagacgggcaattaacaagagcaattgttatgctagaaacagcgacaacgagtggaattgccacaatgaacttagaagctggcgcctttactgaagaatttacagtagaaagtcctagagaaagccttcgcttgtcagaactgtgcgaacttgaaaaatttacaggaattgaccgtcaaaaatttggaataagtggttggcaaagtgcgacatacaatcgtggttttgatgaaatcatttctgccatggttctagcggttgaaaaatttgatggtcaaaatcgtcaagaattactgacagaacttagacaagaaaatattctaaaatcccacgaaatcattgaccaaatgttaaaatgaaaagttactgacagaaatattagactatcttaaaatgactgacagagttaaaaaatttctgtcagtatttttttaggctgagccttgcattattgtcaataaaaaagtataattataaaaaaattaagaaaaggagtccgcatgaaaacacaacaatctacagtcttttatttttggtgcagatagtttgtgtttatgcaattggcgtagatacaacttttgagtatactcaagtttctgcgccgggattcaaagaagaccggatagtaaaaactatctggtctttcttttttaatttttttaccctttctttcgactctaaagtaaaattaatcgtaaagaccgactccaagcagggttttgctagatgaatggaagggaacttataaaagaaagctttgctttcacacattagaaaagaggaattttatggaaaattctacgggcttgaagtcttctttaaagactcgccacattgttatgctctcacttgggggagcgattggttcaggactatttttaggttctggaaaagtcattgcacaggctgggccaagtgtattactctcatacatcttagctggactgacactttatgttgtcatgtatggtgttggggaaatggtcatccatcaagatgaacataaggctggaatggccggagttgttgctccttttattggggaccactgggcgcattttgcggactgggtttactgggcaacttggatggccgtcctaattgcagaagaagcaggggtatcaactttccttgccatgctaattcctggagtgccattatgggttttcgccctgattgtagcagttctaggaacagcaatcaatctctggtcagttagagcttttgccgaaacggaatattggcttgcctttattaaagtcgctgttattttaattttaattgcactcggaatttatttattagttattaatgatgctcatcttggttttgttgctgataccgctcaaaaagtatcgactaaaagtacagcaccaagctttgctcctaatggcttttcaggatttttaacttcattattggttgttattttctcatttggtggttctgaattggcagcaattacagttgctgaaacggaaaatccaaaagtagcgattccgagagctattcgaggtgttttaattcggattattagtttttatgttattccaatctttttattcttgcatttattaccatggagcgaagtttcaaatccagatgcagcaagtccatttgctacaatttttgctcgagtaggaattccacacgctgataaaatcgttctcgtaatcattgttattgcaattttttcagcggttaactcagcaatttatgccacttcacgctcactctattcacgcattcaaggttcaaattcttatgtaggtcaaagattgggcaaattatctaaaaaccaaatcccaacgaatgcgattttagtttcatcatttgttttgtttattggtgtacttttgtcagcaattttgggtgatggattttggcaatttgtggctggttcgatttcatttacgattacaatcgtttggattctccttttagttgctgctcttgttttatattttaaacataaagaagtaacgaattggcttgttaagttggcgacacttgttgtgcttatcgctttaacgattatcttcatcatgcaaattgtcactaatccatggactttgtcagtctttgctctagtgatttgcctcctttcttactttacttaccgaaagaaaaaagcataataataaaaaacattcattttaaatgaatgtttttcttttgtttgagttctaggtattcaataaacttttctttgattaaatcatttttgataagtgacaatttttgtttgcgaacaagtttatgtttaaaccaccattcacaagacatggcatcatttttattatcaaaatcaacagaggcaagcagcttaactggcaatcttgtttttgtgtatttcgcccctttaccagagttatgagtagcaagtcttttttctaaatcagtggtatagccacagtagagagtcttatctgagcattgtaaaatgtaagtaaaatattggttcataagtttttttctaaaatagtgagaaattcaaaaggagtaaattcatgagtaggctcccaaatcttttgaaattgattaatcattccattgtgagaaacaatgagaatattttgagcagaaggaaaaagttgaggaagtttttctaaaaatattttagcacgttcatgaattgaagcaagagattcaatacctaaagtaagattttcttcattttctatattaagttgtgcccaatctcgattttcttttgtttgattttccaattttccaaggcctcgttcacgtaataaaggttcaaagagtagtaaggctcctattttattagaaattatcattgcagtttccttagcaccttgtaaatctgatgataaaatcaagtcaaattttactgacgaaagtttgtcagctaaaatttcggactgttgaattcctgtgccagtgagaggactgttcaaccaacccatcagcaaattttgctgaatacttcgcgtttcaccatgtctgactaaatctaatttcatagtcagattataccatttaacgtagccaaagttaagagctagcttgccattcgtggtataataagagtatgattacttcacttacgattctttcaagtcttgcaataattgtaaccgcagttattgcttttgcggaatatcaagctggaaaaagacgtcattcaaccactctatctatcgaaatgcttcataagcaaaaagacgattttattaaatggttttatgattatcttcatatctcacaagtattgatgcgagtaacaattcaacttaacatggaccgcttagaacaacgtcattttgaaagtacaaatgactctagtaatcagcgacgcattattcgtattaatgagaatacgatgtcaagagatcgtaatgcagcagatttaaattatcaaatgatgcttttaaatctggtgattgatgaccgtaagccttattttgaaaatactcagatcaaggtccgctcaaattttgaaacattgatgcatgacatcaatgaatttacaagaagaattcatatagaatatgatgaaaaaatgaaagaaacggatgatgcaggttgccgttccattatgaatgaagctcgaaagatggctagaaatacgatggaagctatcgaaaaatctaaccatgaaatgggtgagcaagtcaaacatgatattcaagcactcgaagatgaagtagaacattattttaaaaaataaagaaacatggatgtacaagattagagagtagttcatggtgcacgtccgactcgactagtgggttttgcccacgtagcgagagccatttcgtctattagcacgaatggatacctggtgtgtggagaatgcgccaaagtgtgcattcaaaataaagtaagcaaaggaaacataaatgccacaagataaaatagtaatacacggtgcacgtccgattcgacttgtgagctttgctcacttagcgagagtggagaacgtgcccacctattcagaccaaacaaaataataaaaggaaaataaatgccacaagataaaatagtaatacacggtgcacgtgagcacaatttaaaaaatatagatgttgaaattccaagagataaattagttgttgttactggggtttcagggtctggaaaatcatctctggcctttgaaactttatatgcagaaggtcaacgtcgatatgttgaatctttgtcagcttatgccagacagtttttaggaaatatggataaaccagatgttgattcaattgatggtttgtcgccagcaatttctattgaccaaaaaacaacttctaaaaatcctcgttcaacagtcgggacagttacggaaattaatgactatttgcgtctattatatgcccgtgttgggacgccatattgtgtgaatggtcatggaaaaatttcggcacagtcagttgaagaaattgttgaacaaattcttgagcttcctgaaaaaacacgtttacaaattctcgctcctgtcgtgcgtaccaaaaaagggactcatgtcaaaatgtttgagcgtatccaaaaagatggttatgttcgtgttcgtgttgatggcgaagtttatgatatttcagaagttccagaacttgataaaaataaaaagcacaacattgaaattgtcattgaccgtattgttgtaaaagaaggaattcgttcgcgtctgtttgactctgtagaggctgcgcttcatcaggctgagggttatgttattgttgataaaatggatggttcagagcttttatttagtgaattttatgcctgtccagtttgtggatttactgttccagaacttgaaccacgtcttttctcattcaatgctccttttggctcatgcccagattgtgatggtttaggagttaaattggaacccgatgtcgatttattgattcctgatacaagcaaaacactccgtgagggagcaattatctattggtatgggaaagcctcaacttattacccagctcttttagagcaagcaatggagcaatttggtattgatttagatacaccttgggaaaaactgtcagaaaaagaacaacaaattgttttatatggaaatggagataaacttttccattttcttcacgaaggagattttggcttacgtgaccaagatatgacctttgttggggtcattcctaatctttggcgtcgatatcgttcgggaatgagcgagtcagctagagaaatggcgcgttcttacatgactgaattgacttgtacgacttgtcatggttatcgtttaaatgatcaagcactttctgttaaagtgggagagaaaaatattgctggattttcaattctgtcaattggcgatacgcttgattatgtgaaaagtttagttctttctgcaaataatgaaattatcgcaaaacctattttgaaagaaattaaagaccgtttgactttcttgaaaaatgttggtttggattatctcacgctatctcgttcaagcggaacactttctggtggagagtcacaacgtattcgtttagcgacacagattgggtcaaatttatcaggcgttttgtatattttggatgaaccatccattggtttacatcaaagagataatgacagattgattgagtctttacaaaagatgcgtgatttggggaataccttaattgtcgttgaacatgatgaggacacgatgatggcagccgattggcttattgatgttgggcctggggcaggtgatttaggaggtgaaattattgcctctggaacaccaaaacaagtcatgaaaaataaaaaatcactgacagggcaatatttgtcaggaaaaagagccattccagttcccaaaaaacgtcgagccattgataagaaaaaaatggttaagattacaggtgcaagtgagaacaacttgcaaaaccttgacgttgagtttccaatgggagttatgacggctgtaactggggtttctggttctggtaaatcaactttagttaacagtattttaaagaaatcattagctcaaaaattgaatcacaactcagagaaacctggtaagcataaaaaaattactggttatgaaggaattgagcgtttgattgatattgaccaaagtccaattggtcgaactccacgttcaaatccggctacttataccagcgtctttgatgacattcgtgatttatttgccaatacaaatgaagcaaaaattcgtggttataaaaaaggacgtttctcatttaatgttaaaggtggacgttgtgaagcctgttctggtgatggaatcatcaaaattgaaatgcatttcttgccggatgtttatgttccatgtgaagtttgccacggcagacgctacaattcagaaactttagaagttcattataaagggaagaatatttcggaagtgcttgatatgcgcgtgtctgatggcttggaattcttccgtcatattccaaaaattgaacgtaaactccaaacgattgttgatgtaggtttgggatatgtgacgcttggacaaccggcaactactttatcaggtggggaagctcaacggatgaaattagcttctgaattacaaaaacgttcaaatggtaaagctttttatatcttggatgaaccaacaactggtttgcacagtgaagatattgcgaccctgattcaagtattagaccgtttggttgaacaaggaaatacgattgttgtcattgagcataatttggatgtcattaaaacagcagattacatcatcgacttaggtccagaaggtggtgctggtggtggaacaattcttgccaaaggaagaccagaagaagttgcaaaagttgctgacagctatactggtcagtatttgaaagcaaaattggaaaaataagactgatggaaatttgacttgtaattaaaagacttgtcagtaaatgtagagggttgataaaactgtcagcatgttcctctgtaattaaaatacttagttcaataatcgaattgacagaactgcctaaaaaatgttcacctttggttgcatttgaaagaagtgccagcatagctgacaattcctttattcaccgataaaatgcttcctccggtcgcattttactgacaggatttatcttagaaatatttatcagataagctttctgtcagtaaattttacaataaaaagcgtaatctataaacttagattacgcttttaaggaaagaaaatggataaatttaaggaaatttttgaagcgattaaagctgacccacagaacaaaaaatatacaaaagaagggatagagccgctttattctgtccataaagaagcaaagatttgtattattggtcaggcaccaggcattcgagcacaagaatcacgactcttttggaatgatccgtcaggtgaccgcctgcgtgattggcttggaattgaccgaactactttttatgagtcaaataaaatatctattttgcctttagatttttattttcctggaaaaggaaaatcaggtgatctgccacctcgggcaggttttgctcaaaaatggcataaagcacttttagaagaaatgcctgagattgaactttttattctagtaggttcttatgccataaagtattatttaaatttaaaatcatcagcaaaaacaacagaagtgattcgtgattttgaagcctacttaccaaaatattttccgcttgttcatcccagcccacgaaataatatttggttagccaaaaatccgtggtttgagcctgaacttttaccagaactaaaaaaaagaattgctcaattaatgaaataaattactgacaggctttcagtaacttttttcatggcttagtcttcaattaatgaattgttctttccatttgaatatgttgaattccggcttcttcaaaaacttgtcctacctcattaaagccgtatttgctatataaacctttggcagaaagttgtgcatgaagttctaatttatttaatttgctttctttagcaaattcaatcagacggtcaattaaaagctttgcataaccatgacctcttgcttcttttaaaatagccattcgttgaattagcgctgtttttttatccaaatcagcaagcaaacgaacggtacctttggcaagaccatcgtcataaagaacgaaatgaacagaagaagcctcttcaagagcgtttccaacttcaagttcataaggaacgccttgttctttgacaaaaacttgattacgaattcgtaaagcatcaaaataaatatcagacatagtatcacgagttactctaatttccataatttctcctaaagattagtttgcttaaaagccttggatttattataatataaatagtctaaaaatagcagaaataagttatttaaaataacaattattcaatcatttattttaagaaagacaaaaatatattaaataaaggaaatttatgttcaaaaatagtaaattattcttctggacagtggaaatattagccgttactttgttaatctttctcttgtctcagattgattttgtatttcaacccattaaaacattgttgacgctcttatttgtcccatttattattgcaggttttttatattatgtttttaatcctgttgttactttcatggaagagaagttaagaataaaaaaggtattaggaatttttattgttcttttattaatcttaggaatgattatttttgcagttgcctcagtcattccgagcttaatttcacagttgacaagtctaattaatgcaactgggaaagcttatccacaagttagggcttggattgaagggcttcaacataatccacgattcgctcaaatctacgaccaacttgatgttaatagtcttgttgagaaattaaatctttcgtatactgatattttgcacaatttgcttaatagtatcacggttagtgttggaagtatcgttggtatcattacaagcattgttatggtaatgattttggtaccaatcttactttactatatgcttaaagatggtgaaaagattattccgtttttgaaggaaaatgttttgaccgaagatagattgaatatctttgaacttcttgaaaatatgaatcatacgatttcacgttatatttcaggagttgcgcttgatgccttgcttgtctttattgtcgtcttcattggttacatggttcttggaattccttatgcctttcttttcgcactctttgctggagtaacaaatctcattccttatgcgggtccatatattggtgttttaccgatgatagtaacggtggcctttaatcgaccagtaacagcacttattgccgttatctatgtccttgttttgcaacagcttgatggtaatctggtttatcctaaaattgtggggtcagctgttaaagttcatccagtaaccgttatgattctcatgttaatttctggaagtttgtatggaattctaggaatgattatcgctgttcctgcttattgcttagtcaaagagattgttaaatttgccaatagcctttataataatcataaagccgaacaaagaaaaattatttcaaaatgagaacaaaaatatgatataataattctatctaaattgttaactctcattttcattaaatttgagttggcaaagttttgagtgttaaaataaacactataatatttttctcaaggagcactaatgtcaaaccctgatcccgagagtgtatcgatactcttgcagattcttttacttatttttttaacagctttaaatgccttcttttcagccagtgagatggccatggtcagtctcagccggacgaaagtagaacaaaaggctagcgaaggtgataagaaatatatcaaccttgttaatatccttaatcaaccaagtaatttcctctcaacgattcaaattgggattactttgattaatattttagcgggggctagtttggccgaagccttatcttcacgtttagctccactgttaggtggaacagctctagctaaaactttggctcaaattattgttttagctgtcttaacttatgtctctctcgtatttggtgaactttatccgaaacgaattgcccaaaacctcaaagaaaaattggccttaagagtcgcaccacctatccaatttttgggaaaagtgatgaaacctttcgtttggtttttggcaagttcaacaaatgtcttaagccgattgactccgatgaaatttgatgatttggatgaagggatgactcgagatgagattgagtatttactcaatacaaatgatgaagcacttgacgctaatgagcgtgaaatgattactggcgtgttcagcttagacgagttggttgcgcgtgaaatcatggttccaagaacagatgctttcatgattgatattaatgatgattcacgtgaaaatattaccgctattctaagtgaaacttattcacgggtaccagtttatgatgatgataaagataatattctgggaattttacatgtgaaaaaacttttaagatattcttttgaccatggttttgatgatattgacttacgagaaatacttcaagaacctttgtttgttcctgaaacaatctttgttgatgacttaatgcgtcaaatgcgtaaaactcaaaatcaaatggctgtattattaaacgaatatggtggtgttgaaggcgtagttaccttagaagatttactagaagaaatcgttggtgaaattgatgacgaaaccgatattgctgaagaagaagtcttcaaaatcggtgaaaatctctatgttgtccaagggaaaatgaccttgaatgacttcaatgaagaatttgatacacatcttgaaagcaatgacgttgatacaattgcaggttatttcttagcgacaactggtaaaattccagccaaaggacaacaaattgtctgcaaagtggacaatgatgaagaccatttttcactgacaagtttagaagtctctggaaaacgtgtggttaaacttcgtgttgaatttgatgtcgaaccagaagaaacagaaatttaaaaaaattactgacagaaattctgtcagtttttttatagaataaaactgataattatttagataagcccttacatttaggggctgacaagaaataatttactaaaactttttactgacagagcccttgtcattaacttttactgacagaatttgatttgataaaatcaatgaattgcggtatgataggggtgtgaaatagtgttttgaattggagaagatgatgtcagagaatatagatgaacttaaaaaagttactggactgattcattcaactgaatcttttggttctgttgatggccctggagtccgttttattattttcatgcaaggctgtcggatgcgttgcaagtattgtcacaaccctgatacttgggcattaaagtcagataaagcgacagagcgtaccgtagaagatgtcatggatgaggcacttcgttttagaggtttttggggagagaaaggtggaattaccgtttctggtggtgaggcgctccttcaaattgactttgtattagctcttttcaaatatgcaaaatctctcggtattcatacaacacttgatacagcggctcaaccatatttgactgataaatatgtaaccgaaaaaattgatgagttactagattataccgacttagtattattagacattaaagaaataaatccagaacgacacaaagaattgacagctaataaaaacgataatattttagcttttgcacagtatttatcagaccgtggtaatgcaatgtgggttcgtcacgttcttgttcctggtgaaagtgattttgatgaagatttagttcaattaggtgaatttgtaaaaactttaaaaaatgtcttgaaatttgaaattttaccttaccatacaatgggcgaatttaaatggcgtgaattaggttggaaatatccgcttgaaggtgtgaaacctccaacaaaagatcgtgttcataatgctaaagaaatcatgaatacagaatcttatcaagattacttagaacgtataagataaaaaataaaaatgaatttgaagttattcagattcatttttttgttacaaaacggacaatcgaataaaatcagtcctaaatgaaaatgaaaatgtgcttaatcagccattttttggtataatttaagggatgataacccaaataatttttagttaaaactagaagtttaagtgggaaattaaaatttttaaaatgaggtaaaaaaatgtctgataaaatacttgtttttggtcatcaaaaacctgatactgacgctatcggctcatcatatggattttcatatttgagcaaccatcgtccaaatggtgcccttaacactgaagtagttgcccttggaactccaaatgaagaaacacaattcgtattggattactttggcgtgaaagctccacgtgtagtaaaatcagcaaaagaagagggtgtggatacagtaattttgactgaccacaatgagttccaacaatcaatctctgatattgaagacttaacaatttatggtgtagttgaccatcaccgtgtggctaactttaatacagcagctcctttgtttatgactgttgaacctgttggttctgcgtcatcaattgtttaccgtaaattccttgaagcaaatgttgaaatccctaaagaagttgctggacttttactttcaggtttgatttcagatactttgcttttgaaatctccaacgactcatgtgacagaccataaagttgctaaagaacttgctgaaattgctggtgttaaccttgaagaatatggacttgcaatgctcaaagctggaacaaatttatctactaaaacagcagaagaattgattgatattgatgcaaaaacttttgaattgaatggttcaaatgttcgtattgcacaagttaatacagttgatattccagaagttttagaacgtctttcagatattaaagcagctattaatgcttcaatgacagcaaatggatacgatgactttgtctttatgattactgacattgttaactcaaactctgaaatcattgctttgggtacacatccagaaaaatcagaagcagctttcaactttacacttgcagatgaccacgccttccttgctggtgctgtttcacgtaaaaaacaagttgttccacaattgactgaaagcttcaataaataatgactattaaaatctataatgaaaatcggctgacaagtcagcccttttttaaagatttgatagaatatttagcacaacatgatgaagtcatgctcagacagattcataaagattttgctgacgtaaaaaatattgaccggcaaattgactcatttattgctgctgggttaatcttacgttctgataaacgttattcgctgggctttcatgtttttaatgacagtgagtttgattgggaaactttaaaagacaaaattgctgaaccacagaaaaacatctacgaagctccaatttttattgaaaaggagtcacggattgaaaagctaatatcgcaaagtatgctttatcaatctttgactaatcaaacgaatcaagttatcttgaatttcatgacatctttttcttacaaagaatatccacagaatactgaaattccacaatcacttgccaattattttgataaagtggccaaaaatttacctttaactccgcttgaaacagaggtttatcaaatgattggcgatgttgacccagaatatgcgcttaagtatatgactacttttcttttgaaatttatgcgtaaagaagttgtcaaatctaagtcggatatttttgtcaatgtgctggagaaatataactatattgaaaaaatttcggaaaaagaatacaaatgtcttttgaaattttcagaacaagtgattccagagcagaaatatgctgatgctaaatctttcattattgctcaaattcaacaaaccacagctattgagccattcatctcacttggagacaaataggctattagaataaatttaaggagaacaaatgaagtacgaaaaactgttaccacgttttcttgaatatgttaaagtaaatacacgttcagatgaaaacagcacaacaacaccttcaactcaagcgctcgtagaatttgcccacaaaatgggtgaagatatgaaagcccttggtctcaaagatgttcattatcttgaatcaaatggttatgttatcggtacaattcctgcaaatacagataaaaaagtgcgcaaaattggacttttagctcacttggataccgctgatttcaacgcagagggtgttaacccacaaattttggaaaattatgatggtgaatctgtgattaaacttggtgatactgagtttacacttgatccaaaagatttcccaaatcttaaaaactacaaagggcaaactttagttcatactgatggaacaactttgcttggttcagatgataaatctggtgtagctgaaatcatgactttggctgactatcttttgaatattaatcctgattttgaacacggtgaaattcgtgttggatttggtcctgatgaagaaattggtgtaggtgctgataaatttgacgtagctgactttgatgttgactttgcttacactgtagatggtggaccacttggagaacttcaatatgaaactttctcagcagctggtgcagtgattgagttccaaggtaaaaatgttcacccagggacagcaaaaaatacaatggttaatgcattacaattagcaattgactaccacaattcacttccagaatttgaccgtcctgaaaaaactgaaggccgtgaaggtttcttccatcttttgaaacttgatggtacaccagaagaagcaagagctcaatatatcattcgtgaccatgaagaaggtaaattcaacgaacgtaaagctttgatgcaagagattgcagataaaatgaatgctgaacttggtcaaaaccgtgtgaaaccagttattaaagaccaatactacaacatggctcaaatcattgaaaaagatatgtcaattattgatattgctaaaaaagcaatggaaaatcttgatattgtcccaattattgaaccaattcgtggtggaactgatgggtctaaaatttcatttatgggacttccaacaccaaacctttttgcaggtggtgaaaacatgcacggacgttttgaatttgtttctgtacaaacaatggaaaaagcagtagatactttgcttgaaatcattcgtttgaacaatgaagtagtaaaataaaagaaaaagagagagtaattagtttttaagctcgataataaaagaacaagtcgcccaagaaggtttttgattaaaaatcttcatgagcggcttgctttgcgcttatcttataattttcagactaattgctacttttcgataactttctgctactgtataaaatattattctgtttctaaatattttactgacaactttgttagtaaaattgagctattattcaagactttaaaaataaaattgactgattataagtcaattaatgtaaaaggaaagattatgtcacaaaacacaaaaggtaaactctcactcgtaggactctcgttgatgatatttacgacggtctttggttttgggaatatccctgtcgctttctaccaaatgggctacggcgccattccttggtatattattggagccctgctctttttcctcccttttgcctttatggtaacggaaatgggttcagcatttaaagatgaaaaaggaggaatttattcatggatgagtgaggcggttaaccccaccttcgccttcgttggaacattcatgtggtatgcttcttatgttatctggatggtaagtgttgccaataaaattttgattccaacggtcaatttgatttttggtaactcaacacacaccccttcattactttggatttcaattgcagctgtagtttggatggcattgattacctttatggtctcaaaaggtgtggaaacaattaaaaaattcacctctattgcgggggttgccgttctttcactcaatgttattttaattcttggtgctgttcttgtacttattgttaatggtcatccagcaacaccaattaatcttgctgcttttacttcgtctcctaatccaacttttgatggtagtattgttgcctttattgcctttcttgtatttgctgtcttcgcttatggtggagttgaatcaatcgctggtttagttgaccaaactcacgagcctgagaaaaacttcccacgaggaatcatcacatcagcgcttattattgctgtgggttatgctgttgctattcttagtgttggtttcttcgttgattattcacaatggattccagccattaaagatggatcaatgaaccttgggactgttccttacatacttttgcaaaaccttggtgaagcagttggtcatgcacttggactttctactcctggagcagatatgcttggtggtattttcgcccgttatatcggtctttctatgcttcttgcttacatgggcgctttctttaccttgacttatagtccaatcaaacagttgattactggtacaccagaaaaactttggcctggtaaattaggaaaacttgatgaagaaggaatgccaaaatttgcaatgtggatccaatttgcaattgttaccttaattattgttttgaatttcttgacttcacaaggtggagcaagtcaattctttctcattttgacttatatggctaatgtttctatgactttgccttatctcttcatcgttattgctttctggtacttcaagaagaataaaaatattgctaaaccaattgaattctttaaatcaaattttgttgtgaacttcttgacaattttggtcttggttgttgttggtggggctaacttcttcacaattattcaaccaattgtgaattatgttcaattaccagctgttgaccaaactggtaaagcattatctgaaatgttgacatcatttatttcaatgattggtgggccacttatctttggtgtaattgcctacttcatgatgcgcaactatagaaagaaaaataacttgtaataaaattattttaaaaaaataaaagctgagtttgctcagctttttttatattcagatattttgtcgataaaaagccttccatatttttcgagtttaacaggtccgacaccagaaatttgtaaaaattgacttggactatccggcagaacttgagccatttctttaagggcactatcagaaaaaatcatgaaaggagggacgccttcttccttggctagttcaagtcgaagtgcacgaatgcttgcaaaacattcttcatcaaactgatgtgaaacggttgattttggttcaatgagtaggctggctctgcgataaactttgacttgacctttgagaacttttaaaccttgaggtgaaagaagtaacaaggggaatttgcctgacgtaatatttaaataaccttcggctgaaagaaaatcgattaattcgccgactgttttttgcgaatagtttttcatgattccaaaggtagataaagattcaaaattccatttggcaatatttttatttttggaaccgattaaaacttgtgctacggctgttttcccaaatcgttctcccattcttaccacacaagaaaggactttttgagcatcaatcgtgatatcaagaagttctctttcatcaagacagttgctgcattttttacagtcttcgccttcatcgccaaaatactgtaaaatatagcgttgcaaacaggtttcggcacttgtgtatgcttgcatttgtcgaagcttttcgtattcatgttccttgtgcgcttcatcaccctcactttgctcaatcaagaaattacgaattcgtaaatcatttggtgaaaaaaggaggatagcatcagattcaagccggtcccgtcctgctcgtccagcttcttgataataactttcaattgttgcgggaagggcataatgaatcacaaatcgaacatttggtttattgattcccatgccaaaagcattagtggcaaccattattggcacttcgtcaaagagaaaaagttcttgattcatttgacgttcctgttcgctcaatccagcatggtaacgaacggctttgaaatgattatggttgagccattcacaaatttcttcaacttctttacgagtgctggcatagataattccagcagcctcactttcttgatttttaagataatttttaagaaaagttctcttatccatcactttgactacttcaaaacgtaagttttctctaagaaaaccggttttaatagtatgactgggggaaattgaaagaagtttttgaatatcatctgcaacttttggtgtcgcagtggccgtaagggctaagacggtaggatttgttggtaaatattggagatgagaggcaaaatcgacataactgggtctgaaatcgtgcccccattgtgaaatgcagtgtgcttcgtctatggcaactaaatcaattggaagtttttgtaaaaaggcattgaaatagtctaatgaaaaacgctctggtgctacaaaaagaagcttgatttcgccattttcaacctgtcgcattctttgataagattcggaatcctctaggatagagttaataaatgttgctggaattccggcaatattcagctggtcgacttgatctttcatcaagctaataagtggggagattacgagagtaagccctggttgaataagagctggtaactgatagcagattgattttccagctcctgtgggtaaaataccaagagtggcttgtccatctaggacttgttcaataatttgtttctgaccatttcggaaattgtcataaccaaaaatttcttttaatttagcttctaaattcattcttactatattatacgtaaaagaagaagaaaaatcacaaatgactcataaaaattgataacgaatggttcaaagattacattaaaagaaccaagatgtttttgttactttaaatgatacaaaatgaagttaaaagtgatataataaaacaaaagaatgcgtttacaaaattttatatatagaggagactttcttatgaaagcagcagtagtaagacacaatccagatggttatgcggaccttgttgaaaaggaacttcgagcaatcaaacctaatgaagctttgcttgacatggagtattgtggagtctgtcataccgatttgcacgttgcagcaggtgattatggcaacaaagcagggactgttcttggtcatgaaggaattggaattgtcaaagaaattggagctgatgtaagatcgcttcaagttggtgatcgggtttcagtggcttggttctttgagggatgtggtcactgtgaatactgtgtatctggtaatgaaactttttgtcgagaagttaaaaatgcaggatattcagttgatggcggaatggctgaagaagcgattgttgttgccgattatgctgtcaaagttcctgacggacttgacccaattgaagctagctcaattacttgtgctggagtaacaacttacaaagcaatcaaagtatcaggagtaaaacctggtgattggcaagtaatttttggtgctggaggacttggaaatttagcaattcaatatgctaaaaatgtttttggagcaaaagtaattgctgttgatattaatcaagataaattaaatttagctaaaaaaattggagctgatgtgattatcaattctggtgatgtaaatccagttgatgaaattaaaaaaataactggcggcttaggggtgcaaagtgcaatagtttgtgctgttgcaaggattgcttttgaacaagcggttgcttctttgaaacctatgggcaaaatggttgctgtggcacttcccaatactgagatgactttatcagttccacaagttgtttttgacggagtggaggttgcaggttcacttgtcggaacaagacttgacttggcagaagcttttcaatttggagcagaaggtaaggtaaaaccaattgttgcgacacgcaaactggaagaaatcaatgatattattgatgaaatgaaggcaggaaaaattgaaggccgaatggtcattgattttactaaataaatataaaagaggcgatgcagatgaattcaaaaaatttggtcaattattcaagtgatgaatttaacaatctttcgcaatttcaacaagaagaaattacaaacaattttaaagaagctattttgtacaaaatgaaagaaaaaaatttgcatattgatgaggtaagtgaaaaagctggctattcttcacgggatctttcagcattactttattcggatactgtaagttatgaaactcatgcggaattacaaagaattcttgctgttgttaattcttttgcctagtcagaagaaaaagaaaaaacgactcctattgagtcgtttttttatgattaatttactgacagaatttttgtcagtaaattagagatatttttgagcagcagctgtatctccaatataaggttgacgttttccgtcttttaattggaacatatcagttccttttccggcgataatcacagcatcgtcagtacttttagttttactgacagctttttttattgccaattcacggtcaagttcaaaatcaagtgtgcgactgacaaaagaagcaatctcgtcagcaattattttagggtcttctcgatttgaatcatcagtagttaaaatgacatcaagtcgcggatgtttttcaatcacttgtccgaaatctttccggcgactttcgcctttatttccggttgaaccaaggactagaacaagctgaccagcatggtgttcttcaacaacttcaacaagattttctaatgacaggccgttgtgagcataatcaatatagatgtgagcgccatttttggcagtaagaagttccatgcgtcctggaacaacagcaagaactaaaccgtcatggatattttctaatgaagcacctaaagctttagttgctaatgctgtagctaaggcattttcttggttgaagcgtcctaataagcgaatgtcaaatgctccactgacagaaccgtcagtaacaaaatgaagtccttttgattcaataattttattttcagaatcagcaccatagaaagcatgtggaattttacgttccttaagttcctctttaatgatagcaaagtgattcatttcggaattagcaacaaaataacgtgaatttttgagaagttgacgtttgcagtaaaaataatcttcaagcgttggatgttcaactgggccaatgtggtcaggagaaatgtttaagaaaactccaacatcaaatgttaaaccgtaaacccgttctgttttgtaagcttggcttgaaacttccatgaccaaatgtgtcattccatttgtcagagcttttgccatcatttctagtaaatcaagactttcaggagttgtcaattctgatttaaaataattttttccatccaaagttgtttgggcagtagataaaagtgcagttttgccaccgttcattttgtcaagtattgctttagcaaaataagcagaagtggtttttccttttgtaccagtcaaagctaaggttttgagtttattttgtggaaaatcataaaagcttgcagcgattaaagccattgctcgtttaacatcagtgacaataattgctgggagagctacttcataatcaaattctgaaacataaaaagtagcttctaagtctgttaaatattcttttttaaaattcaaacccttggcaaagaaaagggtattttctgttgattttcgtgaatcataagagagttggtcaaagtttacttcctttggccagttgaaataatattcgccagcagaagaaatctcacggaaattattatctttttttagtatttctataacttgttcaagcctaatcatgtgaggaatgcctatttatcgctaaattcgcgatacctttctaaaacaaggaaactaagggaaaaatcccattaccctatattatagcacaagccaagagctggtgcatgtcccatttgtttatagatggtaatagatgacatcgtgaattaatgatctaaaaccattcttttattgtcaaaatacagaacttagggtaaaatggaacaatggaagattcagaaaaaataatgaatacaggtcagcagtcaccaaaaacggctgcaaaatcaaaagatcagatgctctctggtgctgcttggcggactggtgcggatatgattgggaaaatactaggggtaatttatattattccttggtatgcttggatggggcgttttggtaatgaggccaactccctctttagtatgggttataatatctatgctcttttcctattgatttcaacagtggggattccggcggcaattgcgcgtgaagtggctcgctataatacattagatgaccctaacatggcttaccggctcgttcggcaaatgctcggagtgatgctggttcttggaattgttgcgtcagggctcatgttctttcttgcaggtccactctcagcccttgttggcggtaaggatagcgcagatttaattccagtcatgaaaagtttagcattggctgtcttgattttcccttcaatgtcagttattcgaggatatttccaaggtctgaatcaggtgaaagcttatgctatgagtcagcttttggaacaaattgttcgggtcatttggatgctagcagcaacttttgctatcatgaagttaggttcgcataattggcaaaatgccgtgacacaatctaccttggctgcttttattgggatgttaggttcctacgctgtattattctattacttacagaaatcaggaaatcttaataaattaattaatcctggtcctgtaaaatctaaaattaatgctttagaaatttttagatcaacattacacacagccattccatttattgtcattggttcagctattcaaatttttaaaattattgataactcaacctttatgaatatgatgccttgggtaacaaactatagtcataatgaattgcttgttctgatgagttatttctcagcaaatactgataaattaacgatggtcttgttgggtgtcgcattgacgcttggttctgtttcagaccctctgattacagagcattatgttcaagggaatcggcgtgaacttgcaacgttagtgggttataatttccaattatacgttggttttatgcttcctgccgtgattggaatgtcattgttgactaaaccgatttatacaatcttctaccaaattccttctggattacaaagtagtttgtttgtctttgctattttacaaactttcttgttaggactttatatgattgtctatcctccactgacagtaatggaccataaacgtttggcaatgcgaatctttaccttgactcttgtcattaaattagttttgcaagttccaatgattcttattttccatacttatggacctttacttgcgaccactgtttcattcttagttggtgttttcttattcattagaaaactacatgagttaactcatttttcaattaagaatactgttcgcggaattcaaggggcaactttactgacaggatttatggctattgtggttattattattgaaatcattttaggttttattttcggtaagagcccaggtcgaattgcctcagtatttattgctgccattgccggtggtgcaggattttatacttatctttggtttgctgccaaactcggacttctagaaaaatggtttggtccaagaggtttgtcacttcgtcgaaaattacatatctaataaaaaaataagtctgtcagtaaaaaagttactgacagacttattaataagagttaaaaaggataataaatgacagaaattaccgaaaatacaaaaaagattttagaagttattctaaatttaaaagaggggcaggtcatgagttatcgagatgtgggagctttagctggattgccaaatggtgcacggcaggtttctagaattttgcattcgatgtctaaaaaatatgaactgccatggtggcgtgtagtgcgttctgacagaacaattggattgccagagcctgctaaaagtgagcaaatggaacttctaaaaaaagagggaatttcttttacagctcaagggaaaataattattgaagatgaactgctctaataaataaaaagtacttctatattttagaagtactttttgtattcaattaactattaccaaattttaagacgattttctggtgcacgatacatcttatctgtttctttaacatcaaaagtttcgtaaaattcttcgagatttgttggaggaatattggcacgaagtttagcgggtgcatgaacatccattgacaaaagcatttgttgacaattaataaggctggagaatctggacattcagttacgacctctgtgaaatggccagataattcattagctaaagcggcatttgtagcagataaaaccctagttacgattggtgaaaaagtaactttaatgaatcaatctaatttagcttccgtcaaatataaatgggaaattgacggtgcaagtcccgcaacttctacagaaaagagccctcaagtaagttttgataaagcaggtacctattccgtcaaattaacggccatcaatgaaaaaggacaagaagattcagtcactcaaactgaactgattactgtaattaatcaaccagtagaattaacaaattttgcattaaatcaatccgttcaagtagacagtttcactaatgaatctgaatcaggaccaaaagcagttgatggaaaattaaataccaaatggtgtgccgttggcacgggtaaacacaatattacaattgaccttgggaaatcagaaaaaatcaatcaagtcctgattgaccatgctcaaaaaggaggagaatcacctgacatgaatacttctgattacaccattgagatttcaaaggataatcaaaattggacagaagttgtcaacgttaagaaaaataaattgggggaaaccaaagattctttcaaacagacagaagcgcgttacgttagaatcacagccactaaaccaacacaaggagcagataccgctgttcgtttatatgaaatacaagtattaggacaaaaaaatagctgacaaagggctgtaaaaacttgccataaaagcaaagaaaaggctatcatgaaaaccctaacatttcattggaaaagtgttataatgaagtaataaaagttagaaagttatagaaaaatgattggaaaagcactagaagaattctttattcgaatttgggtcgttgttaaattgaccttgatattttggctcttagcgctcacagggctgtttgttttaggacttggtcctgcctttaaagtggtaacagagttgtatttggaacatggttttgactataagtcaatctcagtgaaacaggcttatcaaattttcaagcgagactttttaagagcaaatatcattttttggctctatacgtctttgagtcttttgctcgcttataatttatatctttcagtacaaatccaaggtttacttttcttggtgattgatttcattctattctttggtttaacttatcttatgaccgcttttgaatatacaatgatttttgatagtcaatttgaaattagttttggaaacttattaaaaatgagctttatttcaaattttattagttttaaaacctatctaaaacttttatttgggattgtccttatctttgttttgacttggcaatttaaaggtatgattctctttgggttgattggccttttacaagtttattctttaagtgtgacaaaaacttggcgtttgaaagtcgaagaacagttagcagagtaaaaaagaagagttactgagaggggtggaaaatggaattaaaattccaagaaaattttttgtggggagcagcaacgagtggcccacaaactgaaggacgttttaaaaagcagcatgacaatgtttttgattatgattttgaccattatcaagaacgtttttggggcggaattggacctgatacagccagtaattttttcaatgactttcgagaagatataaaattaatgaaggctgctggtctaaaatcaataaggacaagtattcaatggtcgcgtttgatagatgatttagaaaagaatacggtaaatgaaaaagcggttgatttctataacgctgtaattaatgaatttatagcgcaagggattcgtccgatgattaatttaaatcattttgatttaccagttgaacttttaaaaacatatggaggctgggaaagtcgtcatgttgttgatttatatgcaggttttgcagcaaaatgttttgctgaattcagcgaccgagtgagtgattggtttacttttaatgagcctatggttgtcgttgagtgtgcttatctattaggtttccattatcctgatattgttgatggaaaaaaagctgttcaagtggcttatcatttgcaactcgcctcatctcttgcgattgaacaataccgaaaaatcaataaaaatcctgaaggacgaattggaatcattttaaatttaactccgtcctatccagcaactgaaaaaatagaagatttaaaagcagcagaaatggcagacctttggcaaaatcgcctctttttagatgcatcaataaagggagaatttccagaaaaattagtcagccttttaaaagaagaaaatgtcttgtggcagtcggaagcagaagatttgaaacggattagggacaataaaattaatattttaggagttaattactaccatccgagtcgagtgcaagaacctgaatattctagtgatagtttggctcaagattggcgtcccgacaaatattacgcatcgttcaataaacgtggggtgcggatgaatgctgacagaggttgggagatacatccacaaaccatttatgaaattgccaagcgaattcaagaagattatggaaatattccttggtttatttctgaaaatgggatgggcgtagaaaatgaagaacgtttcaaaaatgctgatggacaaatccaagatgattatcgaatcatttttacaacagaacatcttttttggctccataaagcgattcaagaaggctcaaattgttttggttaccatgtttggacaccaattgattgctggagttggcgtaattcatacaaaaatcgttatggtttgattagtttgaatatccatacccaagtgaaaactttaaaaaaatcagcttattggtataaaaatttaacagactcatcacttttacaagttccagattcaattttagaaaaatacaatcaatgatttctgttaaaatataagaaaatttggaggagaaatatgtcattattaacaatagatattggtggaacaagcattaaatatgcaagatttgctgacggaaaattaggagaagaaggtgctttcggaactcctgataatctggatcaattttatcaatcactgacagcagtcgttgaacaatttaaggaaaattctgatgtttgtggtgtcgctattagttccccaggagcagtaaataaagtgactggcgtcattgaaggagcaagtgctctcccttatattcatgattttgatattcatgctgaattagaaaaacgatttggtttacctgtttctatcgaaaatgatgccaattgtgcggcgcttgccgaagtgaaatttggtgcggcaaaaggtttgtctgatgttttgctccttgtgcttggaacaggtgttggcggttctgttgttatgaatgagaaagttcatcatgggaaacatctttttggcggtgaatttggctttatgctcatggatgatgaacattcgttttcaacattaggaacaacgattagaatggctgagcgctataataagcgcacaggagaagctcttgatgccatcgaaatctttgaaaaagcctttaatggtgatgaaatagctaatgaagaaaaagatatttttctatacaatgtcgcaaaagggatttttaatctgacttattcttttgatccggaattagtgattattggcggaggagtttcccaagctgaatggttaattccagaattgcaaaaacaacttcaaaaaatcatggaaattattgaagtagcgacttttatgccagaaattgtaacttgtgaattcagaaattctgccaacttaattggtgcagcggtagacttttcacaaacttacgcaaataagactgacaaataagctagaagttttctgtcagtaatattttttactgacagaaaattccttcactcatactatacgaaataaaacacaaaaagtaacaaattataggaaaaaattatgacaaatcattatggctcaatcgaagcaggcggaacaaaatttgtacttgcgattggtgatgagcagtttaacattttaaaaacaaatcaaatcccaacgactagtcctgaagaaacaattactagaaccattgaattttttaaagagaatcctgttaaatcattggcagttggttcttttggtcctattgacatcaagcctgaaagtgcaacttatggctatataacaaccacgccaaaagctggttgggcaaatgttgatttattaggaaaactcaaagccgcacttgatattccgatggttttcactaccgatgtcaatagctcggcttacggtgaaatgattgtgactggcggaaaatcattggtttacttcacaattggaacaggaattggtggaggagccgtacaagatgggaaatttattggaggattttctcatgcagaaatgggtcatcaatatgtgaagcgtcatccagacgatcttaattttgcaggcgtttgtccatttcatggtgattgtctagaaggagtggcagccagtccttcccttgaagcccgcttaggaattcgtggagaagatattccagctgacagtaaagtttgggatattcaagctttctacattgcacaaatcgccgttaatacaaccttggcacttgcacctgagaaaattgtttttggtggtggcgttatgacccaaacgcacatgattgagcgcgtgcgcaaagaattcacaaaattaatggcaggttatgtccacgttccctatttactgacagattatattatgactccgtcagtcgcaaataatggttcggcaacgattggaaattttgctttggcaaaagatttagatgaaaaaaattactgacagctttgtcagtagtttttcattttcgtcagtaaaaataaatgtaatcactatcatacgatttttctaaaatttattttatttattcacaaatatctctgcaaaaaacaataaattatgatagaataaatctaataaaataattgaacaaaagttcgaactttccaacaggaattcggacttttgcaccttattagaggagggtcccttgtccgacactacacttgaaaaaatcattgtactcgactatggttcacaatacaatcaacttattgcgcgtcgtatccgagaaatcggtgttttctcagaactcatgagtcacaaagttacagccaaagaaattcgtgagattaatccaatcggtattattctttcaggcggtccaaattcagtttatgatgaaggttcattcgatattgatcctgaaatctttgaacttggtttgccagttcttggtatttgctacggaatgcaattgatgagctacaagctcggcggtatggtagaagcagcaggcgaacgcgaatacggtgttgccccacttcaacttactgaaaaatcagcattgtttgcaggaactcccgaagttcaagatgttttgatgagccatggtgaccgtgtaacggctattcctgaaggtttccacgttgtcggaacttcaccaaacagtccatttgctgctgttgaaaatacagaacgcaacttgtacggtatccaattccacccagaagttcgtcattcagttcatgggacagagatgctcagaaactttgcgcttaacatttgtggagcaaaagggaactggtcaatggaaaacttcattgatatgcaaatcaaagatattcgtgaaaaagttggcgataaaaaagttcttcttggactttcaggtggtgttgattcatcagttgtaggtgtacttttacaacgtgccatcggtgaccaattgacatcaatctttgttgaccacggtttccttcgtaaaggcgaagctgaccaagtcatggaaacattgggcgggaaattcggtcttaatattatcaaagtagatgctcaaaaacgtttcatggacaaacttgttggcctttcagacccagaaacaaaacgtaaaattatcggtaacgaatttgtttatgtttttgatgatgaagcaaacaaattagaaggtgttgacttccttgcccaaggaacactctacaccgacgtcattgaatcaggaacagatacagctcaaacaatcaaatcacaccataacgttggtggacttcctgaagatatgcaattccaattgattgaaccattgaacacactctttaaagatgaagttcgtgcgcttggaacacaacttggaatgcctgatgaaatcgtttggcgtcaaccttttcctggaccaggactttccattcgtgtccttggtgatttaacagaagaaaaactagaaactgttcgtgaatcagatgcaattcttcgtgaagaaattgctgctgcaggccttgaacgtgatgtttggcaatatttcacagtaaatacagatgtgaaatcagtcggtgtcatgggagaccaacgaacatatgactatacactagctattcgtgccatcacatcaattgatggaatgacagctgactttgcccaacttccttgggatcttctccaaaaaatctcaaaacgtattgttaatgaggtggaccacgtcaaccgtatcgtctacgatattacgagcaaaccaccagcaactgttgagtggcaatagaataaaaaactgataacagtatctgttatcagtttttttattttaataataaattttaaaactagcactcattgttcaatagcattatttcctaaaagattacgtaatattaatcaattttatcgctttgaaagcgttatacttgatttgcttgaaattaattaggtgtaactatgttttgcaatatttaagagtaaaaagtctttaatttgcaacctaatataattgtaactttttactttcaagaaatatatttaaatttggagaaggttatggttgacaatgaaaaaataaatttttttagggaattttttagtttcaaaacaaacaaagcagaaggagtaattgggtttcatcgagctttaggaattggttcatgggatatgtttaatggaggaactggtggccttattggttcgtggctcttatattttatgacctcttttggtggggttaatcctggattagctgcacttttaatttcagctcgactcgttatagatatgttctgggctcctgccgttgctgttatttcagataatttttatcactttgcactcggccgaaaatatgggcgtagacgcttctttttgatttttgcaattccaacttcgattgcttttgcagcgatgtggattccaatggcaggtggcctttcttggctttattatcttgtgtcatttatactttttgacttttgtttggatttagttctcattccttgggaagctatccctgcagaaattacctctacctatacacaacgtaataaaatggggtcaatcagaatgtgggcttcaggtttagctcaacccttaatcgcttttgtcccgactctctttatgaaacttttacctgctgaacatggaatgcaaacttccgcctgggccttatttgcaacagcttgtgtttggggtgtgattgggattatatttacactctttgtttacttttcttcttgggaccctattctgatttctaaagaaaagacagaacttatgttgcgacatttagatgaagaaagaaaacgagctaaaactcctgctaggttattcttggaaaatattgctaatttacttttaaccttaaggattaaaacttttcgtaaacatctagttctttatttctctacttttgggattattgattcttttacagttatttttgttatctttgcgacgatttcgtttttgccaactctaacacttgatccagcgcaagcagctcttattttagcgacacccttattgattatgacaattgcatatacaccatttggagcatggctttttaatcaccccaaaattggaccacgcctgctttacctaattggttttggcattggtattttatcatgtatcacttatggtattgtttatttcacaagaggaagtttatcagaagctcagatcacgggactcatcatttttacaacttgtgttttcactgtgggtcgtaacatcattgggggccttccttgggtcgtctttcctttaattcctgatattgatatgatcattcataaagaacagcgggcaggagtttttgctggagctatgacttttgtacgtaaattcactaatattgtctttaatgttgtcattggagcggttatgggagctgctggataagaacatcagattcaaagtgctggctttggaattgctatgctgatgacgtttttagttggaggcttgatgctgattgctttatggaatgcttttacttttaaacttaattcaaaaacacatgctattttggttgaagaaatttcacgtctacaaaaggctgattcgattgggggagaagtggcagtaaaaaatgccaaagagtcagctgacctcaaaacaaaacaaacaattgaagctttatcaggcttaaattatgataaatccgtctggactggaaaataatatataaaaaaacgaggtcttaaatttcctcgtttttaatatattattcagcaacggctaattcagtttgattttccataagtttacccttgtttaattttaataaataagggataagcatgatgagacctgctacaaaggcaattccttctgttagggtcattgaccagatgaggccagttaatccgtaaaaatgatgtaagataatgacgattgggatataaagaatcccttggatagtagacattaccccagtttgcgcacctagaccagaagcttcaaaaattccagtaaataagccagaaaaaccattgaagacagatgaaactagttgtgcggctagtacgattaagcccactttgattactgcactatcatcagtaaagagttgcatgacaggaactctaaaaagatagacaattaaagcaaagagaatagaaattccgccaatccaaagagttaactctttaagtgcttcttttaatcgttgagtattatttgaagcaaaactataggcaaagagtggaatggcccctaaaaagagtcccatagtcaaaaattcaggcagctgagtgattataagggcaatcccaaagctagcaagaacattatcaccatattgaacagaaaaatgatttaacaaaagtgttgtgacaatcataaatactgatttgaaaacttctgcaatcccaattttatagatttcaaattggtcttttaaactgattttaaaatgttttaaaaatcctttaagcgattcacttttattttctaaaaaccagatataataagctgtagaagctagatttgcaatcaccattgaaagtccagccccaatgacatgaagatttaaaactaggataaagagggcatctaagacaatactagtcgcaaccccaacaaacattccatacattgattcttttgaggcaccttctgcacgaactaattgttccagtccatagtttaaaatcatactaaaaccaccacctaataaaactccagcatattctttagtataagtaagagttgcggcgtctgctcctaaaatatgagcgattggacttaaaaagaaaagagaaacaagcccaataagtaaaccaatgattaaactcatatagaaagaataaccagcgattttctttcctttttctttatcgccagaacctagcaggcgagtgataaaggttccacctccaacaccaaaaaggtttccgatggccataaaaacaatggttattgttaaacctagagtgattgttgacatcatatttgtgtcatggacaaggccgataaagtaggcattgattaagttatagattgttgttgcggaaattccaatcatcatgggaattgataagtgagcaattgcttttctgatgggtgcttccttaagataataagagttggattttttactcatttttattgttcttctttctgaatcgaaatgatagatattctaatagttagatatctaactattagaatatcataatacttattttttgttttgtcaacccaaaactatcgtttagaaaaataatcttttttgacgaagaagagagtcagtaaaactgacaagaaaagggctagtaaacaaatgatttcccaagatatttttgggagattagtcaagggcagaggaacattcataccataaaaactaaaaatgatggtaggaatagtcagaataattgaataagaggtcaaaaatttcatgacactatttgtattattattaatgattgaatcataagaatcagtcatctcattcaaaatcctatttgaaatattagacatatcaaaagcttggtcaacttcaatcattaaatcatcaagaagttccttttcataatcataaagttttaaatatttaccacttttaattttagaaatgactaaagaatttgatttcaaggacataatgaaataaattaaacttcgctcaattttcatcaaattaatcaagtcttcatttttcggtgccttacccaaagtttgttcaattaatattcttttacgattgagaattctaattttatcgacataaattttggcaatagctagcatgaaatgaaggacaaaagaagtcttatgttttggatttaactgatgaagcagttttgaattttttaaaattgttgccatctttttatccgctacatttgtgatgatgacctcttttgttacaataaaactcataggccccgatgaataataagccacatctgtttgatcttcaaatggcatatcaaaaataatgagtagacttttagtttcatcgtcaatctctattcgagcactctcgtctttatctgttgcataagataagaactcttccggaatgtgatatgtttttgagagataacttttatcaaacagtttttggtctgagaaattaatccattctcttgttaaattttcagacatttgattctccttttttaaaaaatagttagagttctaactaacaagaattatcataaatcaaataaatgaaaatgtcaagaactaactgttagatatctaattgttataaattgacaaatgaataaaagaccattatactaagaaataagaaacagcaaatcaaataagaggagtcctccaaatggctaatacaatctattcaaatttatttcgttctatttcacaaaaatcaatgatgacctctagtcaaatgatgaaagatttagaagtgaatcatcaacaagctagagtaatcgcatatattgcagaaaatcaagataaaggtctcatccaaaaagatttagcagaagtatttaatagacgaggagcaagtattacaagtatgctccaaggtttggaaaaaaaaggatatatcgaaagacgaattcctaaagagaatgaacgtcaaaaaaatatctatattttgcccaaagggctaaaaattattaatcagattaatcaaatatttgaagcatctgaaaagaaattgattgaacccttgaccgagaaagaacaagctgaattcttgagactcttagaaaaaatagatgacaatttataagataataggaaaaagactaataattacgttagtctttttttatttcagtccaatgcgtttctcaaaataatattatagactttctttaaaaaagatgacagatttcttgacaagtaaaatataaaaaagtataatttctttatcgtttacaaacgtaaacgttaatgttatattagcttattaaaaaatgaccttattaaacttaaataatattaaattttactcgcagctttataatctaaatagaactaggaagaaaaaattatgacagtattagacaaagtaaatgaccccaaagacatcaagaatcttacagcgctagaactagaagagctcgctacaaatgtacgtgatgcaattcttaatcgtgtcagtcaatatccagggggccatctcggaccaaatcttggtgtggtagaaatgactgttgctttacataaagtctttaactcacctgttgataaattaatttgggacgttagtcatcaaagctatccgcataaagttttaacaggacgtaaagaattttttactgacaaagacaaattttctggaacaacaggctatacagaccctgaagaaaatgaacatgactttatacgagtaggtcatacatctacatctattgcaacagctatgggatacgccttggctcgagatatgcaaggaaaaaaagaaaatattgtagccatcattggtgatggcgcgctctcaggaggacttgcatttgagggacttgatggcgcaggtacacttaatgggaatcttattattattgtaaatgataatgaaatggccatcaccgaaaatcatggaggaatctatcaacatcttgcagatctgcgagcaagtaaaggaacctcagcaaataatctttttaaatcatttgggctggattaccgttaccttgaggagggaaatgatatccaaagtttggttactctttttgaatcagtaaaagatatcaatcggccaattgttcttcatattcacacagagaaaggacatggctataaaccagcagttgaaaataaagaaggaatgcaccaagtctttgcaccctttgatattgctacaggtcaaccagtcaatagctcaaccaatatcgttcgcagctataataatatatttcttgactttatggaagaaaagttagccaaaggtgacaatcttatcgccattaatgccgcaattccaatgttctttggcctgtcacaatttgctaagaatcatccaaaaaattatgttgatggaggaattgctgaacaatatacagtgacacttggtggagcaatcgcagcagcaggaactcgagctattattttccaaaatgcaactttcttacaacgtgcctatgaccaacttaaccatgatttggcattgaataaagaaccagcaattgttattatcagtaatagtcaaattggcggaacaaacgatactcaccaaggaagttttgtttatagtcaaacatcaaatattcccaatgtaattgaccttgcagcaacaagtgaagaagacctttttgcaatgcttaattgggcatataatcaacatgaacatccagtatttatacacttgccagagcatactttggaaaatcgcccaacaaaaattactgattttagcaaacctcagtatgaggtcgttaagtctggcgaaaaagttgtaatcttagggcttggtgcaatgcttgaaaaagctgaaaatgtggcagaagaacttgaaaaattaggatttaatccaacggttgtaaatccattctttgcaaatcttttggatgtagctgctttagacaaattatctgaaactcatggactctttgttacgattgaagatggcactaaagatgggggatttggtcaaaaagtggcgacctatttggcaagtaaagggataaaaacacttgtatttggtgcagatactgagtttattgatgctgttccaaaagaagaactttacaatcgttatcacataagaccagaacttatggcaaatgatattattgaagcaaccaaagaatctaaaggacctaatttttttaagaaaatattttctaaataataatttttgaagacagagcttatttgctagataaaatatgaataaatgctaaaaaagatactagcgattaactagtatcttttttatctatgatattaaatattaagcattttgattggttgcagcaatatcaatttctctgatgttaaccgtttgaggcatatcataaatgaatttcacagtttgagcaactctttcaggagcaagtgttgcaccacccattgattctttccaaagattataatcatttagggcactttcgtcagtaacatgtgtcaataattctgtttcagcagcaccaggtgcaacaagtgaaattcgaacatttttaccagaaacttcctctctgacagtttcacttaaaccatgaacaccaaattttgaagcgacataagcggcgtggttggtaaaagtttttttaccagcaagagaagacatgttaattactgttcctccttggcgttcaaccatttgtggaagaacaatttgcattccattaaggacacccaaaacattagtatccatcatttgtttccattctgctggattttgattaagaacatttcctaataacatgacacctgcattattgactagaagatcagttttgccatatttttcctcagctttagtaattgcattttcaaatgatgttttgtccgtgacctctacagattccacaagaacattcgtaaaatcaagaggcaaggctttgattttatctgtacgacggcctaaaagcaacattgggaatccatcagcattaaataattttgcaatttcagcatcaaatcctgaacttgctcctgttataacaataagtggtttagacattttatttctccttaagagtatttttttgatatactgattatacaacatggagttaactccatgtcaaggagaaagaatgacaaaatatacaattggcgatatttcacgtaaattaaacgtttctaacgatgctgtacgttattatgataaggaaggtttgctcccttttgctaaaagaaataaagctggtcgaagagaatttacagatgacgatcttggctatattgaagtcattgattgtttaaaaaaatcaggcatacccataaaagatattgctcaatttattgattggtgtatggagggcgactcaacacttgatgaacgtttagattttatgaaaacacacgaagagcaattagaagaaaaaattaaagttttagaaatgaatttggcctttttaagatggaaaatttggtactatcaaacagcagcagaagcaggcactgaaagtatccactttattccgggaacaacacaagttaaaccagagataagagatattttcaaataatattaaaaaaaacaaaacgtattttttacgttttgtttttttattttttcttagttggaaaatttatgagaaatagcgacagaaagacgacaaaaatacctaactgttggaatcctaaaaatgaaacgcctaggaataaagtggaaattaaaatagcggtgacaggttcaagcattccaagcataccaacaatatgaggttctgtatattttagactattgatataaagagagtaagctaagagcgttccaacaacaacgatgaggctgactaaaagtaaatcagtctgatcaaaatttttaggtaaatttgtgactggatgtaagaaattagaaatgacaccaccaattaataaggcccaagcaacaaggcttaaaggagagtgttctttgataagtggacatggaataagagtgtaagcacaaacaccaagggcggataaaagcccccaaacaagagcagaagctgaaaaactaagttctccgatatttccattagtcacaagcagaaagacaccaattaaagaaagaaaaatggcaataatatcaagacgacgtggaattgctttacttttgatagctaaaataataataatgatggagggacctagggattgtaaaatagtttcaatagctgcatttccgtaataaacagataatagaaaagaagattgtgcaaaaagtactccgaaaatcccaaaagctacaattcttagacttgattttacagaagaccagacactaaagatgttgtgcttagtaattgctaaccaagcaagtaacaacaagcctgaaaagagcatgcgcgtggtaactagccaacctggcgcaatagaacaacgattaaagaggagtccagcaataatactactaatcccaaaaaaggcggctcccaaagaagcgtaaataattcctttaaatttagtcatgattagaccaacacttgatactttttatttttgtcattttatcctcgatttctaagtactttatatacttcgtattattaatagtttaacatagatgatttatgtttatcaaagatttaccgaaagtttgaatagtctcgagtcattaatccttttaaatgaaaaaagttcctaattggcttaggaactttttttataatttatctagagcctttttggggattgcagtttttttaacttcttcccagtttgtcactcctttttgcttattataagttaatttcaaataggcttcatggcgcaagttatgcgtggcagtaaagtctagtgttttttcttgtcctgcattgttgtaggctttttctttataaccatagccatgccaaaccgaaccgctttgcgttttttcctcaagtttttttccgtcattatggatttggacataataatttgttcctccataatttatctgtaccaagcgaaagcggaaccaccaataataaaaactaaggccacaagtccaattaatatttttttcataaaatcctattcctttcctgttaaacaaatctattttatcagtatttttcaaaaaataaacttactatattgtaagattaaaattacttaattaataaaatagaacaaaaaaacactaatgattatcattagtatttttgataaatttaatcttcaactccataaatttcaactttgtaaccagtaatattaagaccgctagcttttcgagcagcctctatcagtggacgaaaatcaaaattatctacattcataatctcacctgtcgttttattgacaacatgataatgaggctctccgtagtagtcatatcttcttttactaccgtcatttatagcaatcactagctcactatcaaccaatttatcaagggtattatagaccgttgctaagctaatattttccaaatcttcgtgaatttgctctgccgttgggtgagttttatgttttatcaggtattctaagacaatgagacgctgtggcgtggcttttaaaccatgtgattgtaatagttcttttaagtcttgttccaaaatcagcactcctatctttattatttattttattatatcatcaacagaaaatcatttcaatgacttgacatttgtttagaatcattctaaaatatagtttagaatgattctaaaagggtgagataatgaaagaaaaaaataacttaattcaaagaaataatattgtcagggcaagtattatgggagcaaatgacgggattatttcgattgcagggattgtcattggtgtctctggcgcaacctctcatattgggacaattttactggcaggttttgccggaactttagcaggaacggtcagtatggcaatgggagaatatgtttcggtcagttcgcaacgtgatgctcaggaaaaaattatccaagaacaaaaagaagcacttgctactaattatcaaaatgaatttgattttgtttatcaaaaatatagagcagatgggatttctaatgaactagctcataaagcaacggatgagatgatgaaaaaggatgctttagcaacaacggttcgtgaaagacacggttttacaattggacaagaattgagtgctaaaggagcggcaattgcctcaatgctctcatttccaactggagcgcttttgcctatgctagccatttctttaattcctaaaagttggagtgctttggcaacatttatttccgtactaatcgctctaggatttacaggttatgccgccgcttatttaaatggtgctgataaaaaacatgcaacttttagaaatattattgctgggattctaacgatgcttgttacttatgtagtgggtttgctctttaaacaaggaggtttgtgatgaaaaaacaaacaatgacaatagatgaaaaattaaatagtgtccgtgcgggagtcttgggttcaaatgatggaattcttacagttgttggtgtgctcttttcggtttccgcagcttctggaagtagctttgctttactgattgctagtttggcaaatttaatttctggtgctttttcaatggcttctggtgagtatgcaagtgtcagttctcaatctgatagtgagaaagttgtggttcaagaagaaaaaatattattgaaaaaagattttaaaaatcaaaaagcagcagtgaaagatttttatattgaaaaaggaatcagtccggaaacttcagcagaaattgctaatgaattacttgctcgaaaacctttggaaactgttctgtcagtaaaatatgatattgctttaggacattatatgaatccttggcaagcagcaggttcatcattaatttcatttacgattggtggactttttcctttactaaccatgattttagttaagggtgcttggcaatttccagcaacaatttttgcaacaatgcttgcaatggccttaactggaatgattagtgctaagctttctgatggcttggtaattaaagcaattcttagaaatattattattggtctactgacaatttttattcattattttattggtcggattttaggttaatgaatttaggcttagttaaaagcttttgttataattatagataggactgataattattgagaaagaggctgacaaatggatgataatactaaagaattagaacaatattgggatgagttttctcaagaatatgaagaaattcaaaatgaaagcttggttgatattggtcagcaattaaaggaatttttggtggctgaaaaacttttaccaacaagtcaatttttagatttagctggtgggacaggcaaatatattccacacttttcaaattttactgacagctatcatcttgttgatctgtcagcaaaaatgttagaatttgccaagaataagtcagctgattcaaataaaatcacttttacgcatcaagaacaaaatagatttttaaagaatacaaaagaaaatacttatgattttgtattttcagccatgaatcctgcattggagtcaaaagaagccttagtagaattaaatcggattgccaatggaaatgttggaattttacgtttgatttttgatgaggataatctctttagtcaggtcgaacaattgtatttgcctaatcaagaacagaataaagaagcgcagatgttgctttataaggtatggttaaaggaattaggctgggaatttaaaagtaagaaatttagattctttttatcagaaaaagtaagttcacagtttttctctgattatttctctgatgagctttcaaatgcagaattagcggctttgacgcaattattttttagtgaaacagaaattcgagaaatggaaagattagtgatatttgagttattatattgggaaaaatgctaggttgaatcctagttttttatttctcaattcttttagttgtaatttatttattttaatactataattgactaatcaatgattgaccaatcaattaagaaaggagaaataaattatgaagcttgaaaaagtcagccagttactctatcagctcaaaattgtaaatcaagaaatgacggcaaaatttgagaagtcaacgggttatagtattactcgttatcaactgatgatgattttaaaatgtaaaggtcgttgctctcaaagtcaattacaaaatgaattaaaaattgatagtgctgctgtaacaagacatttaaaattacttgaagaaaaaaatcttgtcaaaagagagcgcaataaagagaataatcgagaagtatttgtcgaaattaccgataaagctaaaaatgatttagcactttgtgcaaaaaaacatgatgattttctagaggaaagtcaacaaatattaaatattgggctcagcgatttagaagaagaacaacttttagaactactcacaaaattaacaaaatgaaagaagaaaagatgaataagaactttaaaaataacgatttctcagatattacttttggtagaaaatctgtcagactttatgatgaaaactacaaaatttctcacgaagaaatgcttgagatgattcaagaagcaacagccgcaccttcatcagtaaatatgcaaccttggcgttttgttattgtggaaagtgaagaatcaaaagcaaaattgaaacccttaattcgctttaatacacgtcaaaatgatacctcatcagcgatgattttgatttttggagacttgaagaattatgaatttggtgaagaaatctatgaccaagcagttgctgaaggaaaaatgcctcaggaagttagagatcaacaaattgaagcgattattcctcattacaagagcttctctaaacaagaaatgaatgatgttgtcaaaattgactcaagtttggccgcaatgcaattgatgttggtggcaagagctcacggttatgaaacaaatccaattggtggttttgaaaaagaccaattagcagaagcttttgatttagacaaagaacgttttgtacccgttatgattttatccattggtaaagccgttgaagaaggttatgaatctgtccgcatgaatgctgataaaatcactacttttaaataaaaaggagaagtaatttgaccattttaacaattattctgtcgcttttggttgctttggaatttttctacattatgtatttagaaacctttgctacaagctcaaaaacaaccagtcgtgtatttaatatgggaaaagaggagctagaacgtttttcagttcaaacgctttttaaaaatcaagggatttataacggtttggttggtttaggattaatttatgcaatattcttttcgtcagctccacttgaaattgttagattactacttatttatattattttagtggctttatatggctctttgacaagtaataaaaagattattctcacccaaggtggtttagccattttagctctaatttcttcatttttttaaaaaaatatttttaaatccttgacaagtctcataaaaagttttacaattattttcaacatcagaaaagtaactctatatcagaattttttcaggaagtctgcggttgtgcgagcagataaattcatcagagcgaatgggctgatttgaaagtcgagaacgatttttttttcgcaatttgatttgaaacaataaaaatcacggatgctcccgataccaagcaacttgttgttagacgaggaaaagaagagtttttctagtatttttgtaatacttttagggactcttaaattacggtggcaccgcgtgacatacgcccgtagagtatttgatactctacgggcttttttgtatttttttgaaaggatttctaaaatgaaccaacgatggcgaagcttaaattttaactaatcagtatcaatggaaacgacttcctcaaacctatagatagagagaaaatatgagaaaaattaaagagatttcagcagacaccatgaccccgatttcggtttatcttcgcctgaaagggaaaaataaagtgattttagaatccattcccagagaaaatgaccaatcacgtttttcaattattgcgttaaatcctgtgaagcacatcaaatttactgacggaattttaagcgtaaatgacgaaatcattagcgatgaaaatccaatggaatttctggaaaaattagtttgtcagccagaaagtagtgacgaaaatttagacttgccttttacaagtggagcgattggatatgctggatttgatacctatggtatttttgaaggcattcaacctgaactgaaagattcgattggaacaccagatatgtattttatgctatacgaatcagcccaaatttttgaccacaaacgtgaaaaactgatttttattgaagacaatacttacagtcaacgttcagaaaaagagttacaaaacgcgctgtcagcaaatattgagtcattatctttactgacagaagcagaaaatgaactgacagaattaagtaaactgaatttcgttagcaatatgtctcaagaactttttgaagaaaaagtttctaaagcaaaggaacttatcagaaatggtgacatgttccaaattgttttatcacaacgtttaacagccgattttactgacaacccctttaattattacagaaagcttcgggttgaaaatccatcatcgtatatgtactttatggaattcgataattttcatgtcattggcagctcaccagagcgtttggttgctgttcatggaaatcaagtttcaaccaatccaattgccggaacaagaaaacgcgggcaaactgaatttgaagaccaagctcttattgaagatttagaaagtgatcccaaagaagtcgctgaacacaaaatgcttgttgatttaggacgaaatgatattggtaaaatttccaaatatggttcaatcgaagttcctgttttcatgaaagttgagaaatatcgctacgtcatgcatattacaagtgaagtgaccggcgagcttcgtcctgaatttacagctatggatgccttacgcgccacattgccagcggggacgctatcaggagcaccgaaacatcgagcctaccaaagaatttatgaatttgaaacgcaaaaacgaggaatttatggaggagctatcggttatctaacgaaaaatggaaattgcgattttgcaattgccattcggacaatggtcttgaaagacaagaaagcacatgttcaagcaggagccggaattgtttacgattcagtatccgaacatgaatatcaagaaaccttaaacaaagcccaaggcttattgaaagttggtcaataaatagacccaaaaagatgtagagataaaaaatttaacatcatcagataattttgtcagtaattttttactgacagaaaataaaaaattactgacaggccttgtcgttaaaaataggagacaaaattgattttaataatagataattacgatagtttcacttacaacttagtgcagtatgtaggtgctttgactgatgtagcagttgtgaaaaatgacgatgattctttggaaaatatggcagaaaaagcagacgccttaatattctcaccaggccctggttggcctgcggatgctggaaaaatggaaacacttattcagcaatttgcaggtcaaaaaccaattttaggaatatgtctaggttttcaagctatcgttgaagtttttggtggcaaacttcgattggcacatcaagtcatgcatggcaagaattcacaagtccgtcagacctcaggaaatttacttttcaatcatcttccctcaaaatttctagtcatgcgctatcattcaattgtcatggatgaggcagtcgctttaccagattttgcaatcacagcagtcgcgacagatgatggtgaaattatggctattgaaaatgaaaaagaacagatttatggattacaatttcacccagaatccattggcacattggatggtatgaccatgattgaaaattttgtcaaccaagtaaatgaaaacaaggagtcatcaaatgaaaaatgaacttgaaaaagtgatgtcaggccgtgacatgaccgaaaatgaaatgaacatgcttgctaattcaattatccaaggtgaattaagcgaggtccaaattgccagctttttagtagcattaaaaatgaaaggtgaagcagcaagcgaattgactggtttggctcgagctttacaaaaagcagcgatttctatcccaacaaatttgacaaatgcgatggacaattgtggaacaggaggcgaccgctcattcagttttaatatttcaaccacagccgcttttgttttagcagctggtggagtcaatatggcaaaacacggaaatcgctccattaccagtaaatctggctcggcagacgttcttgaggccttaggaatcaatctttatttaccagcagaaaagttagctcaagtttttgacaaagttggtttagttttcctttttgctcaaaatctccacccagcgatgaaatacttcacgccagtccgcagacaactcgaaattccaacaattatgaatttgactgggccgctaatcaatccaattccacttgatacgcaacttcttggtacctcacgtccagatttacttgaattaacagcgaatgttttgaaaggcttgggccgtaagcgagcattagtcatcacaggtgaaggcggaatggacgaagcaactccctttggacttaatcattacgcacttttagaaaatgacaaagtgactttgcatgaatttagagcctcagacgttggtatttcagaagttcaactcaatgatattcgtggaggtgaagccccagaaaatgctgaaattttaaaaaatgtccttgaaaatcaaccgtcagcctttttagaaacgaccgttttaaatgccggacttggattttatgccaacggaaaagttgattccatcaaatccggagttgaccttgcaagagaagtaattagtacaggagcagctcttaccaagttgcatgaattacaagcagaacaaattggttaaaaatcttgatggcaaattttgaaatagcagaaaatgagagaaaaatatgaacataaaaaaaggaaaatttctagaaacaatcctagcagaaaaaagacttgaaattgctaaaatgccagaagaacaagtaggaaaagttcgtcaaacatacaagttttatgattacttaaaagaacattccgaccagcttcaagtgattgccgaaatcaaaaaagcttcgcccagtctaggtgatattaatttagaagtggatatcgttgaccaagccaaaaattacgaacaagccggtgccgctatgatttccgtcttaactgaccctgtattttttaaaggaaatattgaatatctctgtgaaatttcagaaaatgtccaaatccccaccttgaacaaggattttatcatcgataaaaaacaaatcaatcgggcagtaaatgcgggagcaacagttattttactcattgtcgcagtttttgaaaatcaataccccaaactccaaaacctctacaactacgcactttcactaggacttgaagttcttgttgaaacacataataaagcagaacttgagattgctcatcagcttggggctaaaattattggagttaataatcgtaatttaaaaacctttgaagtgagcttgcaaaattcagtagatttgactccctactttaaagaagacaatatctacatttccgaatcaggcatttttagcgcaaacgaagcccaaaaagtttccgatgctttcaatggaatattggttggaacagcactcatgcaatcagaaaatctagaaaaatctttgaaagatttaaaagtcaagaggaaaacgaatgaaaattaaaatctgtggtttatctacaaaagaagctgttgatacagccgtagaatctggtgccacacatctcggttttattcttagtccctcaaaacgtcaagttgcaccagaaaaaatttttcaaatcacaaacgatgtcccaaaaacagtcaaaaaagtaggagtttttgttgatgaacctattaattttgtaaaaaaagctattcaagttgctcaacttgatctggttcagcttcacggaaatgaagatatgaattacattaatcaactagatatttcggttattaaagcaataaggccagaccaagaatttaaagaatacgaagatgtaattttattatttgatagtccacaagctggaagtggtcaagcatttgattgggaatctttggtgaccagcggtctgaaaaataaatttttcatcgctggtggacttaatccagaaaatgtagcagctgctattcaacattttccaaatgcctacggtgtggatgtttcttctggagtagaaactgacggaattaaaaaccttacaaaaataaaaaactttgttcaaaatgcaagccttgcctcatcaaagcaattatttatagaatttttaagaatcacaaaaaagctaaatgaaaataagattatcccttatttaatgggaagtttagcagttgagcaaataatcaattttccaacaaatcctgatgacattgatattcaactcaaaaagcctgattttgaaaattttgagcaattaacaagtttaatggaagaattaggttatcagctcattgacttacatgagcataaatttgaaaaagctagcattcatgttggctttgcaagtgtggagacccttaaaaactatgccggggttgacgataatgatattcccaaaatcaatttcaaatctgagttacatcaagaatttttcctccctactttaaagcaaaatattcaaatttaccaagcggcagtgacagatagctggcgagctaaaaaaactaaagataagaagattttaaagaaattactttttgaagaaaatgacgcgaacattaaatgagatttaccatgaaacttacaaaaaaggagcaacaacatgacctacaaccaacctaacaacaaaggattttacggccaattcgggggccaattcgtacctgagacactaatgacagcagtaaaacaattagaagaagcctacgtagatagtaaaaaagaccctctctttcaagcagaacttaaagaattacttaaagactatgttggacgagaaaacccactctattatgcaaaacgcttaacagaatatgcgggcggagcaaaaatttatcttaaaagagaagacctaaaccatacaggagcacacaaaattaacaatgccctcggacaagtcctccttgccaaaaaaatgggaaaaaataaagtcattgctgaaacaggggcaggccaacacggtgtcgcaaccgcaaccgctgctgccctctttggcatggaatgtacgatttatatgggtgaagaagacgttaaaagacaatctctcaatgtctttcgcatggaattactcggggcaaaagttcattcagtaactgatggttcacgcgtacttaaagatgcggttaatgcagcacttagagcatgggttgctcaagttgaagatacgcattatgtaatgggctcagttcttggaccacatccatttccacaaattgtgcgtgattatcaagctgttattggacaagaagcgcgtgcccaatttttagaaaaagaaaataaacttccagatgctttagtagcttgtgtcggtggaggttcaaattcgatgggacttttttatcccttcgttaatgataaatcagttgccatgtatggtgttgaagctgctggtcttggaattgatacgccacatcatgcggcaacaattactaaagggcgccccggtgttcttcacggaacactcatggatgtccttcaagatgaaaatggtcaaatcttagaagcctttagtatttcagccggtttagactatccaggaatcggaccagaacactcttatttcaatgctgttggacgagcaaaatatgttgatattacagatgaagaagcacttgaaggttttaaaatcttatctagaactgaaggaattattccagcactagaaagctctcatgctatcgcctatgcagtcaaactagctaaagaattaggagcagataaatcaatgattgtttgtctttcaggacgtggggataaggatgtggttcaagttaaagaacgacttgaagcagaaaaagaggtgaaaaaatgaaaactttacaaatgactttaagcaataaaaaaaataattttattccttatatcatggctggcgaccatgaaaaaggcttagaaggtcttaaagaaaccattcaactgcttgaacaagccgggagctccgctattgaaattggcgttccattttcagatccggttgctgatggtccagtcatcgaacaagcaggtttgcgtgctttagcaagaaatgtatcactttcaagtattcttgaaaccttaaaaacaattgatacaaaagttcctctagtaattatgacctatttcaatcccgtttatcagtttggaattgaaaagtttgttgcagctcttgaagaaacaccagttaaaggccttatcattccagatttacctaaagagcatgagaactatatcaaaccctttatcaatgataaagatatctgtttagttcctctggtctcattaaccacgccactttctcggcaaaaagaacttgtagccgaggctgaaggatttatctatgccgttgcaatcaatggagtaactgggaaagaaaatgcttatagtaaccagcttgaccaacatttaaaagcgttgttttcattaacggatgttcctgttttgacaggatttggaatttctacattatctgatgtagaccgttttaataaagtgtcctcaggagttattgttggttcaaaaattgttcgtgatttacatgaaggtaaagaaaacgaagttattaaatttattgaaaacgcaatcaatttttaagataattgaaaaattaataaaaccatatatccttgacagtccactttacaaatggtatactttttattaaataaaacggttacaaaaaattggatagtgattattaagttaagctagaccttatcaaacctatagtcatagggggataaggtctatttttgtgaaatggagaagaatgtgaaaatcaaaaaagttctgaacaataatgtagtcattgctcaaaatgataatgaagaaaccattcttatgggtttaggcttaggatttgggaaaaaagcaggtgaagttgttgaagacaaaaaaattgaaaaaatttttgcattaaaagtaacttctgagcaacagaatttttcagaattactttcggaaattccaagtggaatcgtagaactttcgattttaactttagcaaaagcaaaaacaaaatttgataaaacaatttctgataccgtattggttgctttcgctgaccatttaaatgcagcaattattcgtgaaaaagacaatataactattaaaaattttcttttgtgggatattaagagattttttccagaagaatttgcactttgtcttgaaacacttcaaaaagttcaagaaaaacttaatatctcacttccagaagatgaagcaggttttctggccatgcacattgttaatggaaccctgggaagtggtcatgaatatgcaacggaattaacaaaattaatggaagaaatattaacaactctaaagtatactttacaagtaaactttaatgagcaagatatttattttcaaaggttcattactcaccttaaatttttcaccgaaagaatactttctaatacaaaaagtgatgaaagcaccgatgaagacttattccttctaataaccagaaaatacccaagagcatacataggaacaaaaaaagtcagtgagtttcttaaacagacaaggtcgtacgaagtttctcaaaatgaacaaatatatatgaccgttcatctagcacgtattttagaaaaaatacaagattaatttttaagatgactttagtcatcatcaactatggtaacaattggatcgtgacattaagttggcgaaacctctaaaaaatatattattttggaggtttgtaatgggcaaatatgaagctcttgcaaaagacattgtagcaaatgtaggtggcaaagaaaatgtcatctcagtgattaactgtattacacggttacgttttaaactcagagatgagaaaaaagcaaataccgatgtcctgaaaaatatggatggtgtagttacagtaatgcaatctggcggccaataccaagtcgttattgggaatcatgtaccagaagtgcgtgcagatgtagatgctgtccttggggtacttgatacctcaccagcagactctgcacaaaaaggaaaccttttcgatcaatttgtggaattgatctcaggaattttccaaccaatattagctccattagcagcagcgggtatgattaaaggggttaatgcaattttatcctttgccttgggacaaagttttcaagcatctgcaacctatgctgtttttaatgcaatgggtgatggtttatttctcttcctaccaattttcattggatatacttcaatgaaaaaatttaatggttcaccatttgttggaatgatgattgccgcagcacttgtttacccaggtttcgtagacggaacagttgcaaaaacatttgcagaaagtggtggattaagcctctttggaattcctttttcagtaccaactgctggctacgggtcttctgtaatgccaattattgccattacagcatttgcagcatttttagaacaccagttaaagaaaattattcctgatgtagtaaagcttttcttgacaccattctttacggcaatcatctcaattcctctaggcttcctagttattggaccagtaatgaatcttgcttcagatgctttaggtaaaggtttactagcattacaaggatttaatcctattatctttggtttagtgctaggatttgcttggcaagtcttagtcatgtttggactacattgggcaattgttccatttgcaattatcgcattagcaaaaggagaaccaaccgcgcttttaattgccgcaagtgttgcatcgtttgcgcaaactggagctgttggagcagtgatgttaaaaacaaaagacaaacgacttcgtgaattagcaataccagcctttatttctggttggtttggtgttacagaaccagcaatttacggaattaccctccctaagaaacgtccattttgggtttcatgtatcgtaagtggaattttatcagctgttgccatggccttgggaattaaagcctatacaatgggagctttgggaatcttcagttttacatctaatattacccttacaggtgaagtttcaggcgcgattaaaatgatgattgtatcagctgtagcagttatagcaggctttgtagtaacctatcttgtggggtttgaagatgatgttattgaaaatccaatccctgacaaaaaatttaataaacaaaaaacgaataaagaaataattggaagctctcttgaaggaaaagttattccactatcacaagttaaagatgcagccttttctgcaggtgtaatgggcaaaggagcagcgattgaaccaacactaggtgaggttcgtgctccatttgatggaatggttatgattttgttcccaactaaacatgcagtaggtttaatttcaaatgagggaactgaacttctcattcatatcggaatagatactgtccaacttgaagggaaatactttgaaacttttgtaaaacaaggacagagtgtaaaaaaaggtgacttactcctcaagtttgatattgagcgtattcaaaatgcgggatacagtactcaagttccaatcattgtaacaaatactcaggattatatggacattctagttacaaatcaatcgacgattcatcaaaatgaagtgttactaactgcagttaatgcacaaacaactgaattagtggcaaatccagtttaaaatagcattgatgaaaaactttaaaaattagataggaaaattataaaatgacatttaaaacagactttttatggggtggagcaacggcagcaaaacaattagaaggtgcttatgatatagatggtaaagggctctcagtagcagatgcaatgccaggaggtaaagaaagattggcaattcttgcaagtccggaatttgattggacgattgacactgaacatttcacttatccaaatcatgatggaattgatcattatcatcagtttaaagaagacattgcattatttgcagaaatgggatttaaagcttaccgtttttcggtagcttggtcaagaatttttccaatgggagatgaaacaactccaaatgaaaaaggtttgcttttttatgatcaactaattgatgagtgtttgaaatatggaattgaaccagtggttacaatttcccactatgaaatgccacttaatttagctaaaacatatggaggatggaaaaatcgcgaactaatcgaattttatgtccgttttgcaaaagttttgttagaacgttatcaagacaaagtgaaatattggatgacttttaatgaaatcaattcagcaacattcttttcaggtttaagtcaaggacttgttccatctaatggtggagatgacaaaactaatgttttcaaagcttggcataatcaatttgttgcaagtgctcaagctgtaaaatttgggcatgacttgaataagagtttacaaattggttgtatgagtatttattcaacaacttattcgttcgatgcaaacccagtaaatcaattagcaacacaagaaagtattcaagagtttaattatttctgtaatgatgtacaagttcgaggagcctatcccgcatttacgaatcgacttcaccgtaaacacggagtaaatgtagatgcacttgaaatttccgaagaagatctaaagataataaaagaaggaacagttgattatataggatttagttattatatgtcgactgtagaatcaaaaacaggggaaggcgttcaagcttcaggaaatatggttcttggaggagttaaaaatccctttttaaaagaaagcgaatggggttgggcagttgaccctgacggacttcgttacgcccttaatgatttatacggtcgctatcaagtcccgctcttcattgtcgaaaatggcttaggtgcaattgataaagtagaagaagacggaacgatacaagatgattatcgtattgattatctcaaaaaacacattcaatcaatgaatgaagcagttgaagatggtgtcgacctaatgggttacacaccttggggctgtattgatttagtttcagcatctacaggagaaatgagtaagcgttatggattcatctacgttgacttagatgacgaaggaaatggaacaaaaaaacgttctaagaaaaaatcatttgattggtataaagaagtaattgcttcaaacggtactaacatgtaaaagatagaaacctcatcaatatgatgaggtttttttaattgttaactcaaaagataattaaatgaaaggtaaaatcaaaatgtattctatgaaatactatgtttatttaaaataaaaacaaaaaatctaaaagaaatatattgaaataaaagaaagaaagttgtataatttatcaaaaggaatttgtacatattcctgataaggtttttattctttcataaaggctgaaaatacatcattttacatttattcatggaaataatcattgaactaagtcaaaagaaaagaggcgtgaagatgagaataagtaatgttactattaggggcttccctgtttattgaaagaagtcacaatgacttttagtagttttagttgaaacttatcatatgttaaattattggaatattcactagtcataataaaaatatttactctaaaaaatattatgacgaacaaaggagaactgatgaaaaacaatcaattcaaaattcctgaaaatgcgcaagttcatgaaaattttagaacttggaaatcaggaaaacaatggctctatgtctcgtctatccttgctttagtagtttcaggtggagcaattgcttcctcttcccatggcgtttttgctgaccaagttctttcaacttcaacaggtaaaacaactggagcagaaaacactgcaactggtggacttggatcaaatgctacagctggggctgataatgcttctgtagcaaattcagctaatacagtggcaaaatcttcagcaaatccgagtagttatactgatgcacaagtaaattcttcaagtgctgtacttaagcaagataataattctggaaatccaattggcgcaccagaaacgagtaactcacaaaacacaaacggtactggcggagcaacaacaattggtatcaatagttcatctactgcttcaagtggaggaacgattaatacaacctcttcgacaaacttgaattcaaatggagcagtaacagctggttctggagcagcttcacaaacaacagttgatattaaagcaactcagtcaatttcaaattcaggttctacgctttctgatggttcttattcatggagtgtttcgccatcgactgaccaaacacaagcaggttattctgtagctgctgtaacaattacaactcctggtacggattctggtcagtcctctgcaggaggagcgacagctcaacttgctggtgggacatacacaaaacttacaagcggtcagccatcttccggaggttttacagcaacttcaacagcaaatacaattacagcttcttcagtagcagcaaataattcaatgattgatgcacttcgtaaatcaaatgcttctatcgaatctgcatattactcagaaacagcagtcttaatttctgatggtgccactacagtattatcttctttagctagtaatgtttcatcagcttttgcgctggtttcagctgtagcgacatctgataatttattaacctacagctctgcttattctctactgagtgcaaccctgacatctatccaagccagctatacagcaagttcactgcttgcattacaaaatatgtcatctgcaggttcttatgcgatagctgcatcaaatgctacaacaacgatttcttctgcaagttcagtagtttcatcagcaacctcaacagcatcagtagcttcttcaaatgccatttcgaattcatctgaaatgaataaacaatctgctttttcagtagcagcaattggggctaactctgctggcttatcaagctatacttcatcagctactagcacttttacttctcaagtagccgcaggtcaatcggcagcaaatcttgcaacaacaagtaattatatttgggaaagtttggcttcaagctatacatcaagcgtagcttcatcatacgcccaaagtgcctatgattccgcttataaagcagcaggggggaccattgttgctggtgtatatcttcctccgattacagacatcggtggagcaaaaacctctacagctgcccaatcagctgctgattctgatcctaacaatatttcatatgcctcacttgcaagttcttatggtttgatagctaattcatatagtacagccgcggttaatgcctctggagcctatgtacaagcttcaaatgcatattcttcagcgaatgccacaatgaaaactatgagttctatagtttcatctgcaacttcagtagcaacttcggcaacttcactattgaattcagcttcggcagcacaatcggcttttaatagtattgctaactcttatattactgttattcattcagagtcagttttacttgatggagcacagtctgattacatctcaatcgctacttcaattacagattccattgcaactaataattcaggtacagcaattgcgtcatctgtagcggcatataatgatttacaaaaatcacaagcagatgattttgctaacgcttctacatttgcatctaatgcgtctactgcaaatactacttttgatgaacagagtgagatactttcctcagcttcggttgtagcagcttctgcaagtgctggaattgcaatgcaaaattctttagcaacttcttattcaataattgcatcctcatatcaagcacaatcgaatacaagcttagcttcatcatatgctaatattgctaactcttatagtacaattgcttcaagtttggccacagttcaacaaactgcgcaatcattatatgatatggcatcaacagcggcagctaccgcgtcaactgcagttttcactaataacacgaatttagcaagtctttcagctttaattactgctcaaacagggtcaacccttgaatttcttgaattagggaatattcttgcgctatcctcagctgtagttgcaaacaatcaaacaattgcttcgcttggttctaacaatgctttgacaacaacttatggaaattatcaaacgacccaagattcgcaagccttagtttctgttcagtttacaggtaattcatcagcaacatcacttgtgaatacagcctttagttcaggagttgcttcttatgctgccgcagcagtagcagttgactctttagcgacggcaacgaattcgacattacttagccttgcattacagctttatacagctcaacaagcagaaaataacatacttaaaatggttggagcatcaaatctattaattgatacaaccaatactcaacaacttataactcaattgagtgcttcccaagcaaataaattgatgaattccgcagcagttgttgcagcatctcaagcaaccacagctttgattggaacgccaacatattcactattaggagcagtaaataatgcaaccacatttaatattgatattaatggaaatgtaacgccagtagctggaggaacaggaacgactcaaattactgtttataataatggtgcattatataatatctattcagaagatttgcaaacctatcaacttaatgctttgatggattatgttgtgaacgttggaatcccaattacaggtcctacttttggctcttttaaaatttccgatatcctaggactaaataactatcaagatattactcaagcgacaacagcagtgcttggaaattcgatagctcaagcagcaactcaagcacagcaacccttatctgctttaattaacgcattactttcttatcaacaaacagtaaatgcagcacaaacgactttggatggtttagcaacaaatgctaaagctgtagttaagggaacaaatggtatttatacacaatctattttggcgcctgtaacaatgaatactgatggtacattaacgattaatgccgatgggatttcatatacaacagcggttagtcaaaatatttcaaatatcatggctaacttaattagtcgggcgacattggcagccaataccgtatctacacttcctatcgctgtttctacagcacaagcaagccaagcatcaacaaaagtatccgcagcagccttatcttcatccaatattgctggattaatgccaatcaatctttctgcagcagtttctaatgcaattgcagcaggtgatttgcaatctaaccttggattaaatcttgcctatgcaaaatatcttgcattatcaggcgccctcgcaatttacggtctatcaacgaatacagcttctgttgcaggtagttatattgcaacagctcaaggaaatattaatacgattttccaaaatatgttgaatactgcaaataatgcaacgggttcagtagcagctgacacgtccgccatgaatgtagttactcaatctaatggtattttatcaggagcttctagtgcaatgtctgttgcaatgtctacagctgttcaacaaattttaacaagttcaggttattcagcaactggacttgcgacagttgcagttggtttgacatttaacgatccaacagaacaaattttagagaatttaaaaacagataattattattatgaaggtcaatctgcagctataactgatagacaattagataacacttttgttccggaaacaacagtaattactgcagacgctttaggagcagtacaaggagtatcagcagcgccaggccaaacccaatatacttcaattgtttatcaagtaaatacagatgatattcaaggggtcatcaatgctgtaacctctgatggtacatcaatcggttcatatacctatgacaagtatgatggagaaacagtttcagcacctacaatttcaggatattcacttgtagctggaactccaagttcagcaacggttgatgcagctggaagcccaatcacattcacctacgaatcaaatgatccatcaactggtcaagagttcacaggttcttatggatatacacttgcctatgaacaaggagaaattcttccagcaggtacaaatcaaacagtttatgctgttcttgatgtctggggtgcggatatgccaaactctactcaagatggaactgctactttgtacgcagatggtaaagcaattgccactatcaatgtgtctatcaaagttggagctgatggcgtatctaaagaaaatatctttaaattctctggacttgatttgagtcaatatgcaaatgcattcttgacttctgacttttctgttggggatcctttgactggtaattcaggaaatggtctttatgtctcacctctttgggatgaaacacaaagtacagcttcatctgcagtaagtattgcatctgaagtttcaaatgaagcctcatctggatcctcaacagcaagttctcttgcaagtcaatatccagatgatactaacgtccaaagctttgcctcagatgcctcaacatcagcaagcacagcaagctcattagcgagtcaagcaagcgatcatgcaagtcaagcgcaatcacttgttgataaagcaagctcagaagcaaatcaagctggatctgcagctattagtagtgatcctgactttgattcttatcggtcagaagttatggcagactcaatagcagcatcaagtcttgcttcacaagcattaagtgaagctgaagccgcatcatatgctgcaagtcaagctgaatcagatgcttcagcagcttcaagctatgttgcttcttcaaatgctaattcggatagttcaggcggaacaacaaactagtctttttttacttgcttttttttcttctcttatcaaaaaactccctatttttactaaaatagggaattcctcttcactcttcgtcttctgaaaataaaatggcctttattttttcacgaaggcgataccgttccatgcgagttagttcttctcctcgcatttgtcgaagtagtaagtcttgataatgtgcgctcaaaccttcatatacttctgccagcaaatgattgaagaccacttcattttctggactagtatcacctgaatttatccagtctgagcattcataaacatctaaacctataaaatggtcatggcttcgtttctttgcataactccgtcttagctcatcaattaatctttgatgatactttaccttaaatttcgtatgcagcttttgaccatcgctctgctcttctaatagaagatgtaaaataatcatcccctcttgaagataatcctctattttccatgttctaatgcgaatttgtttcattaatttcataactataggtttcatttctgaaaacagattttcaaaatcctcttcttccaagtaatatgtcattggaaagttctccttttatattatattatattatctttatttgatttattagtaagaagataggggtggagaatgtatatctaataaacagtcagggagcatcttattataatgagctattttcatatctatccttccaagacatttttatggcttttattacattataataatttctacgtgttttacctaacgatattatgcgaatattcagaatttataacccaataaataaaagcaaggctatttaccttgcttttttattttataagtaatcaggagtaggtttatttttaaaataaactcctgaaattctagaagctgcacctggttctacaagttctagcgtttttgaaatttcatcaaatgaaccatcatagtcacggctgttttcaaataattgaagcgctcttgagatcccttgtgctacttgttcatttgcagctttataccgattagcatattgaatcaattgttcagctaataccgcatggtcagtcaaattagtcgttgcttcttttaaaacatgcatatcttcagtgcttacgtcgacaagatgattaattgtatcaatgttgattctaactcgtcctaattctttgaaaagattttgtactcgatctcctgttgtgaagaacaagtcgagataatctttaggaagaccagggagattacatttttcaacataacgttttattgtacggagttcagaatcaaagcgttccgcaatttcttgagctgctctttcttcatctctgagtcctgtaagggtatcactaatcttaatttggttcttctcaatatcttcaagcgcattgactactgaatttactctacgagaaaggattgagtaaggcattgttttagcttgaatatttcctagaatttcatcaacatctgagtcaagagattctaaatgttcttgataacctctaacatatcctttttcgtttccagaaaggatataggcttgtgtaacatggtcaatttcaaggagaagatttttattatttgctctaatatgttcaatatattctttgagaactgatgaacgtttttcaacatttcgacgtgcgctatattctctttcaaaaatagcataaagttcttcaactttttcttgaattaaaccaagttcagcttccactcgatctagttcaaattgttctaataatgaactactttcaacgagatgatcatgtaaatcatccattctttctttaatgttgacattatcgggaagaatgtattcttctgcaacgaatttatcactcgcttcttgcaattcttcaagtcgtttaggaacatctttttcaattgttttaataaatgatggaatttgctctgtaattgcacgtaaagcaatcgtatgttcttcagcagtctccaaaacttcagccgcttcaatcggatcacctgttgagtttagcgttacaaactgagaaaattctgtttcgatattggctaaatgtttttcaagttcagtaataactgttccatacaaatctgcattgtcagcaatatcgctacgtaagttatcatataaatcaagggattcttgaattttatttgaattacgcttttcttgttcaacaagttgagcaacaccttgacgaattccttcgacatcaccttccattaattcaatttgtgcctcactatccgctacagattcacgagcacggaaaaaatggaatgagtcgtttaattgttcagcttcaaaaatatgttcttccaaatcagcaaaagagtttgatgataagtcaagccatttttggttccattcacggaaaattgtttgcgattgtccgacgagatgcatttttttaacagaatcaatttcttcttgaacaggtaaatcgaaaagcgattcctttcgctcttctaaggctaggatacggtcttctgttttctttcgcattaatattgcaaaagcataaaaggctacgaggataactaataagacaacaatgaggataatgacagtacttgacatgctttactccataaaatgatttaattacttaaaaatagtttaattacttaggttagatagattttaaatagatagaaaatctcaaatataattatagcatattgcgtcaaagaaatacactattttcttagttttctaaccgaaaagtcgttttttattttcaaaataaaaaaagcaacctctagaggctgctttttaattaaattaaagtcctgcttttgctgcttcaacttctgctgcaaagtctgtttcagctttttcaattccttcaccaacttcaaaacgtgtgaatgcaattgctttagctccttttgattcaaggaaagcttcgactgttttgctgtcatccatgatgtaaagttgtgcaagaagagcaaattgttggtcaacttttgtattgtcaacgatgaatttagccattttacctggaagaattttgtcccagattttttctggttttccttcagctttaagttcttcttcaaatgaagctttcgctgctgcaagaacttcttctgttaattggctcttagaaccaaattcatggtgtggaagttctggtttgttaacaagtacacggctagcgttgtcttcatcaattttgtggttcatttgtgctaattcagctttaacaaattctgaatcaagttcatcagctgaaagaacagtagggttcattgcagcgatatgcattgatagttgtttagcaagtgtttcatctgcaccttcaacgacagaaacaaccccaattttaccaccgttatgttggtaagctccaaagtgttgagcatcagttttttcaattactgcaaaacgacggaaagtaattttttctccgattgtagcagtcgcttgaacaagttctgcttcaagagtaatacctgaagctgtttcaagtgccaatgcttcttcgttagttgctggttttttagacgcaataagttctgctgtttctttaaccaaggcaacaaattgatcatttttagctacgaagtctgtttctgagttcaattcaacaatcgctgcaacatttccgtttacagcaattcctgtaagtccttcagcggctacacgatcagcttttttagctgcttttgcaatccctttttcacgaagaagttctgctgccgcttccatatttccgtcagtttcaacaagagcgcgtttagcgtccatgattcctgcaccagttttttcacgtaattcttttacttgagctgctgttactgccattttgtaaatctcctatgtgtttttttctgtcagtattgacagtagttttatttaaaaaaacaggcgaggcgtaaggcctcgcctgttgtagttacttaattagtataagttgaagttaaaattatttaccttcaacgatttcagcaagttcttcaagtgattcttctgaagctgcttcttctgctacgaaatcttccgctgcatcttcaccttgacgtccttcaatgatagcgtctgccattttagctgtaatcaatttaacagcacggatagcatcatcatttgcaggaataactacatcgattggttctggatctgcgtttgtgtcaaccattgctacaactgggattcccaaagttttagcttctttaactgcgatttgttcagcatgtgggtcaacgatgtacataacatctggaatacgaggcatatcagcgataccaccgatgaatttttcaaggcgttcgcgttctttgttaagaagaactacttctttcttaggtaaaacttcgaaagttccttcttcttccattttgttgatttctttaaggcgtgtcacacgtgtttggatagtgttccagttagtgagcataccacccaaccaacggtggtttacgtagtattgaccagcgcggagagcttcttctttaactgcttctgcagcttgttttttagtaccaacaaaaagaactactgcaccttcttgtgaagcgttttttacatagttgtaagcatcgtcaacaagttttacagttttttgaaggtcgataacgtggataccattacgttctgtgaagatgtatggtttcatttttgggttccaacgacgagtttggtgaccgaagtgaacaccagcttcaagaagttgtttcattgaaataactgacatgttaatgtctccttttaaaatagtttttcctctttcatctgtcatccgcagccgcaatacttgcgtacactacgactttgtcgagacgaaatgcgagatggttgcataacaactctatcattatacattgtttgacctatttttgcaagtatctattcatgcttctattgttcagtaaatctatttttctagccactcctattgtctgacaaatttaattgttaatttaggctctataatcactaaaagagtaagttttcaaatttttttctaagaaaaaaattaatatttttgctgaaaccgctttttttgtgataaaataattatagtaaataaattagtttgtgaggagagaaatatgaaagaaaaaatccttttaggcggctatacaaaacgtgtatctaaaggcgtatacagtgttcttttggacactaaagctgctgaattatcatcattaaatgaagtcgctgcggttcaaaaccctacttatatcactctcgatgaaaagggacacctctatacttgtgcagcagatagtaatggtggaggaatcgccgcctttgattttgatggcgaaactgccactcatctcggaaatgtcacaaccacgggagctccactctgctatgttgccgtggacgaagcgcgccaattagtttacggagcgaactatcatcttggagaagttcgtgtttataagattcaagctaatggctcactccgattaacggatacagttaaacatactggttctggaccacgtcctgaacaagctagctcacacgttcattattctgatttgactcctgacggacgacttgtcacctgtgatttgggaacagatgaagtcactgtttatgatgtcattggtgaaggtaaactcaatattgctacaatttatcgggcagaaaaaggaatgggtgctcgtcatattactttccatccaaatggtaaaatcgcttatttggttggagagttaaattcaacaattgaagttttaagttacaatgaagaaaaaggacgctttgctcgtcttcaaacaattagcaccctacctgaagactatcatggagcaaatggtgttgctgccatccgtatttcatctgacggtaaattcctctatacttctaatcgtggacatgattctttaacaacttacaaagtaagtcctcttggtacaaaacttgaaactattggttggacaaatactgaaggtcatatccctcgcgattttaatttcaacaaaactgaagattatatcattgtcgctcatcaagaatctgataatttatctcttttcttgcgagataaaaaaaccggtactttaactttggaacaaaaagatttttacgctcctgaaatcacttgcgttttaccactataaaaatttattttttcacaaagtttgactgataaactaaaaaagattgctaattcctatcaaagaattagtaatctttttttcttcagtaaagcttgttataaaccgttttctaaacttttgatgagtgtttttgtaaaaatcatcacaatattgcttgacatctataaaaaactttgttaaactattcacgtaaaagaaagtgaatgaaatcacaaaggagaacctacaaatatggcaactaaaaaagccgctccagctgcaaagaaagttttaagcgctgaagaaaaagccgcaaaattccaagaagctgttgcttatactgacaaattagtcaaaaaagcacaagctgctgttcttaaatttgaaggatatacacaaactcaagtcgatactattgtcgctgcaatggctcttgcagcaagcaaacattctctagaactcgctcatgaagccgttaacgaaactggtcgtggtgttgtcgaagacaaagatacaaaaaaccactttgcttctgaatctgtttataacgcaattaaaaatgacaaaactgttggtgtcatttctgaaaacaaggttgctggatctgttgaaatcgcaagccctctcggtgtacttgctggtatcgttccaacaactaatccaacatcaacagcaatctttaaatctttattgactgcaaaaacacgtaatgctattgttttcgctttccaccctcaagctcaaaaatgttcaagccatgcagcaaaaattgtttacgatgctgcaattgaagctggtgcaccggaagactttattcaatggattgaagtaccaagccttgacatgactaccgccttgattcaaaaccgtggacttgcaacaatccttgcaactggtggcccaggaatggtaaacgccgcactcaaatctggtaacccttcactcggtgttggagctggtaatggtgctgtttatgtcgatgctactgcaaatatcgaacgtgctgttgaagatcttttgctttcaaaacgttttgataatgggatgatttgtgccactgaaaattcagctgttattgatgcttcagtttatgatgaatttattgctaaaatgcaagaacaaggcgcttatatggttcctaaaaaagactacaaagctattgaaagtttcgtttttgttgaacgtgctggtgaaggttttggagtaactggtcctgttgccggtcgttctggtcaatggattgctgaacaagctggcgtcaaagttcctaaagataaagatgtccttctttttgaacttgataagaaaaatattggtgaagcactttcttctgaaaaactttctcctttgctttcaatctacaaagctgaaacacgtgaagaaggaattgagattgtacgtagcttacttgcttatcaaggtgctggacataatactgcaattcaaatcggtgcaatggatgatccattcgttaaagaatatggcgaaaaagttgaagcttctcgtatcctcgttaaccaaccagattctattggtggggtcggagatatctatactgatgcaatgcgtccatcacttacacttggaactggttcatgggggaaaaattcactttcacacaatttgagtacatacgatctattgaatgttaaaacagtggctaaacgtcgtaatcgcccacaatgggttcgtttgccaaaagaaatttactacgaaaaaaatgcaatttcttacttacaagaattgccacacgtccacaaagctttcattgttgctgaccctggtatggttaaatttggtttcgttgataaagttttggaacaacttgctatccgcccaactcaagttgaaacaagcatttatggctctgttcaacctgacccaactttgagcgaagcaattgcaatcgctcgtcaaatgaaacaatttgaacctgacactgtcatctgtcttggtggtggttctgctctagatgctggtaagattggtcgtttgatttatgaatatgatgctcgtggtgaagctgacctttctgatgatgcaagtttgaaagaacttttccaagaattagctcaaaaatttgtcgatattcgtaaacgtattattaaattctaccatccacataaagcacaaatggttgcaattcctactacttctggtactggttctgaagtgactccatttgcagttatcactgacgatgaaactcatgttaagtacccacttgctgactatcaattaacaccacaagttgccattgttgaccctgagtttgttatgactgtaccaaaacgtactgtttcttggtctggtattgatgcgatgtcacacgcgcttgaatcttacgtttctgttatgtcttctgactatacaaaaccaatttcacttcaagctatcaaacttatctttgaaaacttgactgagtcttatcattatgacccagcgcatccaactaaagaaggacaaaaagcccgcgaaaacatgcacaatgctgcaacactcgctggtatggccttcgctaatgctttccttggaattaaccactcacttgctcataaaattggtggtgaatttggacttcctcatggtcttgccattgccatcgctatgccacatgtcattaaatttaacgctgtaacaggaaacgttaaacgtaccccttacccacgttatgaaacatatcgtgctcaagaggactatgccgaaatttcacgctttatgggatttgctggtaaagatgattcagatgaaaaagctgttcaagctctggttgctgaacttaagaaattgactgatagcattgatattaatatcactctttcaggaaatggtgtcgataaagctcaccttgaacgtgaacttgataaattggctgaccttgtttatgatgatcaatgtactcctgctaatcctcgtcaaccacgtattgaagagattaaacagctcttgttagaccaatattaatatattgattatagtatttggaaccgaacgatatccatgctcgctaacctgctaaagcaggaagtcgcaacggtacgtcaacctcgtattgatgtgattaaacagttgttgttagaccaatactaataatctattgattaaaataattaaaacgctctgatgaattcgtcagagcgtttttatagcttatacaactatcaaaaggtataaatcaatttcgatataggctcttttcactccactgatttatatttctataaaaatcaataattaattagcgatagaagtcgagttcatgcatgctaataatgaaattgttttaaattctggtttttctttatgttctttgcgaacatctttcacagtttctttgttcatgaaaatccctccttattatggtactattttgagcccaaatagttatataagaatcctaaacttcggatatcttatcaaagattaattaataataaaataaattaggggttcttctattcccaacagagcatcattatctacgaagcctaatggacaaccgtatatctctttttctgaaagtagtagttgaaaattttgcagaaaagcaccacattcgattgaagcataccttatcccacaattaccatatttaccaaaatatttatcgtaatcatatgttacagcaataagaattgaacttgaagaaaaatatttatcatcataaaaacaagtttttttaatttgatttatctcgaatttctctgtacttatctcccctttagagttaaatatttttttattgttcttataaaaaagtaaaactttcaaaccatatatagctccggcagaaggaacgctatgtttctcaaaattatagtaggatttttttactacttctattacactttcaacatttacaccaatattatgaaatttatttgattttcttagttgaataagctcttcaagattcttcaacgattttctccttgattaactctttcagaaattcatcttcatcatctgtccactctctatcactttcttgttcaagaactgccaataaaatatcaaaacctgtatcgttgaattgtgttaattccgcccttgagaaattgaagactgctttatctgtttttctgagcgtaaataatgggtttaatttatacttcatttatttgttctccatttttctaatatatattttttatattctacagctggttcagaagtggaaatatttccaataacatctcctgtttcttcaattgctaaatccccgtttgcatatattgtcagggagggatattccgatacataatttaatgtttcttgaacaggcgagtagcgtacataaatcccatcagtattatattgtcttacaaagatttttaactcttctttttgaatttctgttaatttatatacttgattttctccatcataagttgaaagtttcaacagttcggctcctgtttctttagcataactcgcaattttactaagctctccaatattttttcgagtgacacaagttgcaaaaccatataatatccccaattcttttaaatatttcacagttttttcaacttttctaagatgcccgttttctttgtaattatccaattttgaatatcgcaaactatcaatgcctatctgtaaatatcgaattcctgctgattttaactgatataaatactcataggatacgtcaactgcattagtcgctatagttggataattgttatgttctgatagtaattggacaaaatcaataagttttgggtggagaattggatctcccccacaaatagcaactaatggtactttatatttttctaaataataagctattttttctaaatcttcttttgagatctcctttgtatttaacatcttcatttctttaaggaagcagtaatcacattcgtaatgacaatgattagttaaatatatatacaccttaattggtaaaaaaagttcgtcatctctaaacatattttttcccctttccaaagatacctaaagccataataattaggacaaaaattgcactaatatataaataggtcatcaaatagttatcaactcccccttgaacaacacccatcaggaagaaagaagcagatagtaaaagctgggccattgtagaataaagagaaaaaatagttgttttatcgtctctatccttaatcgcggtgttgataaaataagaggagagtccttctgaaaatagtctgataatctgcatacttgaaaatattattgctacaatcaaaaaacgaaaagatttcctggtataaaatgttcaattaccaatactccttgaaaagtaagaaccacaaaagaaacaaggagtaatgttgaaagtttgaacagcgatactttctttttcaaaactctcaaaagaacgaatatcgacaggttcactatcataataagtaggccataataataaagaggaatacctaatgaagtcataactggttggtataaagaaaatgtcccccttgaaatacaaaacaaaagggcaagcgagaacaagagaaataacaatttatgatttaaggactttactttcatttttatttttgtcatttctttatgtctcgcttcagaacacatgaaaatagcagataataatttgatgatttttatcgataaatccaatataagtggcaaaatcactagataggaaaatagaaccgtggaaacaaatccagaaattgctgctataatcgctcctatggaaaaatatgaggcggatttctccataaaatctttttcagtttttccttctctcttaaacatattaaatattaacacttcaaaattaccactcgctaaagccaacatgcctgttcttataatttctataattaaaactggaataaataaagagccttttatcaaactaggaagaaaaagtaaagttataagacacacaatttccgcaccatttcctaatactaacattaatttcctatcgaacttatcggataagtaacctgttggaatctgaactaacaacgaaattaacaaacataagcccataatacttgaaaaatctgaaaaagaaagctttaaatacacactgaaaaatataacctctacaaccgttataaatgcatcatcaaaaagtattctatttatgaataaaattttctgaccattgaaaaattgagtcattggtaacccccacattcctcaaatagcggacataagttacacgaggttgattttcgatattttcccgctctccatatattaaaaatcgaacttgttccccatatgtaatcaaaacttgaaccatcgttacctaatttttcgatagatttttggttttgagatactacaggacaggctgaaagtgtcaagtcactatttataacgcaggcagctgttccagcaccacaacctaaagtttcagcagtgttttcttcttttagatatgttgtgacaattagattatctggtatttttaaatctgagcatgctcgaactaaagcttcataatccatgaataggcgttctttttctaataatcccgttcctatgggcataaatggcattaatcgcaattctctacatcctaacgtggcacacatatcaatcatttgttgaatggtagaattattttcttttgtcacgaccatagcgagccgtgtaggaacattctcttttactaatagtgctacactttttattgcacgttcaaatgttcctttccccctgactgcgtcattgattaacttttggggagactctaaagaaatttgaacctcttttaaatactgagatttagaaagtattctaattaactcttcatttctaaatagtttttgaccattagttgaaaatgagtatgaaattctcaatttttctagttgaataataatatgttcaaagtactcacattctgtcggttcaccgcccaatagagaaacatgggtaaattctttatcttgtataatatctaggacctgatttatttcatcaagctccaactcttttccttgataatcttccaaataacaaaatttacaccttaaattacatttgttggtaagcatccaagtcaggaacagtggattttttaggtaattaatcatcttacttctccaatctataaaaaaatacagataatttttattatctgtatcttaacatataaaattgggtggaaattttcttttggaatatatgccaaagccctataatttttcaatttcttcaaaaagtacctttgcttctagtgggaaaccataatctgcaagagtttgcgcgtgttttttcatttcttctatcgctccgttttgtttttgcaataccttataatgagctttgtgatattcaaagagaattttttcatagaaaaaattgatacttattcctatttcttttaaatggttgatatatttaaaagcttgtattaagttttctcgacgtaaccaagtatcaatgagatttaaaaatgttcttattacgatctgttgattgagatgaattgaatgataataatttgattttcctaaaatttgcattccgtaatactttagtgcattatcatcaaaatgtcgaagacaattgccaaaaacccacagttcatagcgtccccattcgctgacagattcaaggtagttcatcaaaagatcagtatcttttttgatatcctctgcattttgaaccattactaagttggttttaactactgtttcattaattttatagtatttattttcaggattttgttgagatttttctttccaaaaattatgaatttctatgattttctcgatgtttttttgcgcataagcaaccgccaacttgtgacgaaagttgtattcatctgattgttcatagtcgttataaagattttgaaattcgtctaaatagacatttgaattttctaggacggtaaatagtttacccaccgtaatctctgtttctcctttttcaaattttgcgagctgagattctgaaaaagaaccaccagtcatttcttttaattttagatgcttcgtttctttgataaaagcaatgatttttccgatttttaaatttttttccatttcattttccctttgtcatatattccaaatttattaaattatttgaaattattatacaactttgcttttagcttgtaaactagatgaaaaaactactgacagaaaagctgtcagtagtttttatttttctaaataatctaaagcgtcctgaatagttttgacgggaacgattttcatcttcgtttttagttttttagctgcggctttggctccaaggtaattgttgctactttcctttttggtgcctgagtcaggcactaagaagacctttgccccttctttgctcgctgtggctacttttttatcaacaccgccgatttggccaatgcttccgtcatgttcaatcgttccagttccagcaatttcgcgaccgtttcgcaaatcttttcctgtcaactgactgtaaatttctagtgtaaacatcatccccgcagagggaccaccgattgaacccgcgttgacagtaacttttggagtcgtcacgacttcagtatggtcaactaggctgatcccaattcctgtttttccattagcaattttgatgtatttgccagttgacttgtgctttgtgccgtcaattctcgtgtattcaatcgttactgtatcaccgactttttgtttggaaacataagcaatcatgtcggcacttgatgtaaactgttgaccattgactgctgtaatcgtatctgcaagttctagcttatttttaaaggtcgaatttttggcaatatcaaggacataaacgccttcatatttaagttcataaggtttattagctaatttaaaagcttgataaatcgctgtattctgtgccgtttccatgtaaaactggttgacacggttgaactgtgcgtcgttaagtccaccagtcatttcttgctcactgtaaatgcttgtaaaactattaaaatggctgtaaatcattgtagcaagatttgctcgtgcaatttggacagtcgtcaggaaaaaatcacctttatgttcatcttttttgccttcaactttgaccatttttcctaaaggctcggttgttccgggcatttccacatagtaacttgttggataaaataaagctaaaagggcaacaacaattagaccaatcgagattccccattttaatttgggattaatttttttattttttttcatctaatttccttaattcacgactcacattttctggaacccaagcactgacatcttggccaaaggcatgtaattctcgcatccgtgtggaatttaatggttcaagttctggttttgctaagaaaaagatggtttcaatgcctgtcatctccatattaaaatagaacatatttttttcatattctaaatcttggctattacgcaaagaacgaaccagagctgtcacgccaagtttttttgcgatattcactgtcaaatcacgttcatgtttgatgactttgactttatgagttactgacagacttgtcagtgcttcttctagcatttccactcgtttatcagttggaaaaagtggatttttttggtcatttttaaaaattccaacataaagttgatcaaaatgttgactggcacgtttgataacgtctaaatgaccatttgtcagtgggtcaaaagttcctgtaaagagtccaattttttctgtcattacttttttctttcttaatttactgacagaatttctgtcagtaaaagtcaaaattcataaattgaaattttagaaattccgtaagttttttgtctggtcagctctaatttcccaatttggtcagggagttcaacttccttgtctgtttcacagacgacaattacattttctgtcagtcgttttttctcttgcaaaagttctaagttttcaacaatttgttctttagcataaggtgggtctaagaggactaaatcaaaagtctctgacaagtttgataagactcgttctgctgacatttttaataattgaaatttttcaggctctttggtcatcttgatattttccaaaatgacttgttgagctgctctgtctttttcgacaagaagggcatgatccattcctcttgaaatggcttcaattgccaaactgcctgagcctgcaaataaatcaagaacacgtcccccttcaaaataagggccaatcatattaaaaatggctcctttaactttatctgtggttggtcttgttgtttttcctgccaatgttttcagcggtcttccgccataatttcctgatactactctcatgaaaataattatatcacaaaatttcaaatggagagccgaatctccctgtaagccttggtctaaaggttctgtcagtaaaaattttcttattattttactgacaaaaaaataagtttctcaaatcagaatttcattctaacttttgaaacttatttttacctatatttaactcatgaatgactttcatgcatccgaattgctcgtagtgagggcagcacacctaatacaataatgaaaaatatgaagatggtcattccaatatttccataaagacttgagagagagacaaggattcctgacaagaccgaagcgataggctgagtcactgaaaaagctcctgtataagttcccacttggtctccatccattaaatcggctcgcagagcctgtgaaaatggaaccaaaatcatttcaccgattgttgctaccaatgctgcaatcagttcccaagttaaatcatgaccaagaaatgcaatcatgaagcccaaaccttgcaaaataattccaatggctattccactacttcgtgaccaatttttggttagtttgttgactctccccataaataatacgatgactaaggtattgaccattaggaaaattgtcagcatccgttgtccataaacttcaattccaaaaatccttgctgttctaaaactatcactcaaatggactggaagataataatcaatttgattaaaaatcatcgcaataaagaccgaagcaaataaataatacatgaaaatacggtctttagcaactgtgaaataggctttaataatgtttgattcttgcttatgctgctgagtatctggattgaaggattcatcaatccaaaaaattacaaccaaacaactaacgatttcttcaattgtgatagctaaaagtaaccaaaccaaataatctcggaaaaaccaacctgaaagtcctgaaccaatcatgattgcaaaattgataatccaatattgaatactataaacaactcgccgattttcacttgttgtcaaatctacaatcatcgcttgacttgcggtgttaaaaaagccaaaaccaaaattaataataagaaatcctaaaaaagtaacccaaggattgaagtaaaaagatgagtttgcaaatgttgctaaagctccaccaaaaccagtaatggcagttgagaaaatcatcacaggtcttcgtccctgaacgtcggacaaatgaccagcataaagcccaaccaagaaaaccatgactgaactaatgactaaaagtaatcccgtgattcccgctcccatatatttattgtagtaaattgtcattgagccacccactgtactaaagcaaagcgtcccaaaaaaattcataattaaacgaattttaagtgtaggatgtaatccaaaaaaatctttcattttatttctttctgtttttttcaataaaaaatctatcttgactccttttcaagataaattcctgtttttagaagtcattttttaattaatttttgttttctggtgtctgtttacagcaataagcactaaaataatcgctagaacttcagtcaatgctaagactaaagaaactcctgttgctttaatcattggtgaaatcgaaacaagtaaaccggcaagaatggaggcaatcggcatcttaattgcggcaacgccattgtaagaaccaattttttctggattcatcaaatctgcacctaaagtttgaacacttggtgtataaacaatttcacctaaagtataaacaataccggcaatgaaaataggagtaaacgtcgttgtcaaaaatgaaaaaatcatcccaattgccataaataaacttccccaaataaatcctttttggtgtgaccagtccttggtcaatcgatttagggtggttattaataggaccactaatacacaagctaaaatcaaataaatcgtaagcatccgttgtccatagatttcaaaaccaaaaaaagtgattgttttaaaactatttgataaatgaacaggcaaaaaattatcaaattgcatgataataaaagtggtcgcaatattagcacccataaaaatcatgtaagttttatcttgtagtactgtcttataggcctgaaaaatattttctgcttcctctttggcctttacaatcggtctaaaagtctcagtcatgacaaaagtggttaagaaaaatgagactaagacagttaaaagtaatatcactaaaagtgcttcaaatgctggcctaaaaagccaagcacctaatgctgctcctaaaataactgacaagttttgcgcccaataatccaacataaaaacaactttacgattttcagcatttgatgcatcaataatcatggcattgcctgcagtaatcacaagattataaccaaaactaatcagcaaaaaagcaataaaagttgaccaaggattcacgtgacctggtaagtttgaagcaatagctaaaagagctcccaaaagttgaatcactgtcccaaaaaccatcactggttttcgaccatttcggtcagcaaaaaaacctgcaagaattcctgcaacaaaagtggctactgcagataaggcaagcaaaatccctgtaattgcacttcccaaatgttgattataataaatggtcattgaagaaaaaacggtgccatatgaaaaggcacctaaaaaaacaattcctaaacggagttgcaaatttttgtctaaattccaaaactctttcatattattccttaaattttccgatttttttaatttatctataattgtagcacaaataataaacaaaaactagatggattttttaaaagttgttaataaaatacagagattgaaaatataacttatgaaaatatacaaaaaatcactgacagaaatcttgtcagtgatttttatgacacttttaatcaaagattaaaggcggtcattcaattctttgctgagttcttcaaatcctggtttaccaagaagagcgaacatatttttcttgtaagcttcaacacctggttggttgaatgggttaattccgttcaagtaaccagaaacaccgatagcaagttcaaagaagtaaattgcatatccaagtgtgaattcgtcttgttcaggcaatgtcacgatcatgtttggaacatttccgtcagtgtgagcaagaagcacgccgtcagctgcttttttgttaacgaagtcaacatctttaccttgcaagtatccaagtccatcaaggtcagcgtcaagttctggaatgttgatgtttttacgtggtttttcaatacggattgctgtttcaaaaacagtacgtgttccttcttgaatccattgtcctaatgagtgaaggtctgttgagaagttagctgaagttgggtaaattcctttttggtctttcccttctgattcaccagccaattgtttccaccattctgagaaatattgaaggcttggttcgtaattgatcaagatttctgagaatttacctttacggtaaaggatattgcgaagtgcagcataggcgtaagcatcattttcatgaacatttgtagaagtgtattctttacgcgcagcgttagcaccttccatcaaagctgtgatatcagcacctgaagctgcaattggcaaaagtccaacagctgtcaatactgagaagcgtccaccaactgaatctggaacaacaaaagtttcccagttgtttgcgtcagcattaacttttacagcacctttttctttgtcagtagttgcgtaaatccgtttgtttgcttcttcacgaccgtattttttaactaacatttcttcgaagacacggaaagcaatcgctggttctgttgttgtacctgatttagagattacatttacagagaaatctttgtcagcaacgtaatctacaaggtcagccaagtatgatgaagaaattgagttaccagcataaagaatacgtggtgctttacgttcttcggcagtttgcaagttaacaaagctgttgctcaaaaagtcaattgctgcacgtgcaccgaggtatgaaccaccgataccgataacaataagaacttctgaatcagattgaatttttttagctgctttttgaatacgagcaaattcttctttgtcgtaatcttcaggaaggtcaagccatccgatataatcgctcccagcaccttttccttcgtggagcaatttagctgccccgtcgatttgccattggatttcgtctaattcattttcagctacaaatggagtgagttttgaatagtcaaatttaatatgagccattttaattcctttcaatttctcgcttttacgagaatttagctattgaagaacgacaacttttgcattgttttatcttcgaattttctagttcattttatcactttttcggctttttaacaatactaaaggttatgtaagcgcttatttgtttagctttctatctgtgaaacttttccagctttgggacagctttttttataaaaatttagtttaagatttcaatgaatatttattgttatcaaaagatttactgataagctaactcctaacacttttaagggtgtcaaatctctttgacgactgacaaatcagtctttcatttaaatttttgctaaaatattaatgatgaaatatacatttgaaattgaccttgaccgttataaaaatctagcccaacaaaaacaaaagacacataagaaatttttagctggacttgccaaaaaaccaccaaagcaattagataaaatcgttaaagaagttcatgaagaggtttttttagaaattgattgcaccaaatgtgctaattgttgcaaaaccttaggccctctttggacagaggccgatattgaacgcgtcgccaaacatttaaaaatgaaagtgagtgactttgaagccacatatctccgaactgacgaagatggtgacaaagtttttcaaaccatgccttgtcagtttcttggttctgacaatctctgtagcatttacgaagttcgtcctaaagcttgtcgcgaatttccccatactgaccgtaaaaagatttatcaaatcaataatttaacgataaaaaatacactttactgtccagctgcttatgaatttgttgagaaattatcttatagactcaaataaaaattactgacaggtctgtcagtaatttttttattaggccaaaagctctttcaaagcttcttttgtatccgtcagtgaatgtcctaaggctttttcaaaatctttagattccacatctaaatcttttgcttcaatatctttttggaagccgaggaaaagttccgctacaaaatctggaagtccagtttcaactaaatgactgacaaaagttttgtcatcagcgataatcacttcaaaatccttatcagaaactgatttgaggacttgagcaagttcggcgtaagtcaatctttttcctgaaagctccaaaacttctggaaaatttactccagcaagtgcttttgctccaacttctgcatattcacgtttcaaagcccagcccactttacctgttggtgcattgtaaacaaattttccagttgaaagtgcagcagcaataattggcatttcattttcaaagtaccaattattacgtaaaaatgtgtgggcaattcctgatttttcaatcgccttttcagtatagatgtggtcagcagctaagtcacttgttgccctttctgcttgaggaaaacttgtataagcaatataagaaataccagcacttttggctgcatcaaccacattttgatgctcagcttgccgatttcccggcgctcctgaaacaaaaagcaaacggtcaattcctgtaaatgcttgttctaaagcagttaaatctgaataatctgccaaacgtacatcgaaacctgccgctttgagtggggctgctttttcttctgtgcgagccaaaaccgcaatatcagaaattggaaccaattctttcaaaaatccgagtgcataagtaccgtatccacctgtcgcacctgttactaaatatttcatgttaaatcctccatttatttattattttttatattttaaagtagcttgcttttttgactacctaagtgtataatatcattgtactaccactatgtaaagtaagcactttaaagttagatactccccatttagatactattgtataataccaacgattagaggtaataaaaaaatgaaaaaaatttctgaacttccagattgtcctgttgaaacagcacttgttttgatgggcgaccgctggaaaatgctcattgtccgtgatttattagagcgaaccatgcgctttggcgaacttcaacgttcagttggacatatctcacaaaaagttttgactcaacatttacgtgccctcgaagaaagcgggctggttcatcgtgaagtctatgcagaagtaccccctcgtgttgaatattcactgacagaacttggaagaaccctcaagcccatccatgatacgatggcagcttggggaaatctttataaaaaagaaatcagcaaagcttaaagataaaaattactgacaggaaattctgtcagtaatttttgtttaattatttataaatttctgcgcactttttctaatttttcaaaaatacggtgaacaatcggtcagtaaaacagctgatttctggatttttctactatttattttaggtcaaagtatcaatctacataaaaaacaagtagaaaatttgctatctttcttatttttttgattttattctaaaaaaaaccagtagctcaaaagctactggcttttatttatgattagttttctttcaattctgcgatacgagctttcacagtatcaaatttttcttgataatcggctaatttatctttttctttttggacaacttctgctttagcattcgctacaaaacgttcattacccaattttttattcactaaatctaactctttttgccatttggcaagttctttttcaagtcgagcaatttcttcttcgatgttaatcaaaccagccaatggtaagtataattctgctccagtaatgaccgctgacatcgcttgttctggaaccgccaagtctttagcaattgttaattctgaaggattagtgaaacggctgatgtaaggagaaacagcattcaagaaatctgcatgttcagatttaatcaacattgggacagctttagacaatggagtattaacctcagcacgaatattacgaacggctgtaattaattcgattaacatcgccacaccttcgcttgccttgtcgtcattaaattctggacgtacttttggatattcggcaacaacaattgaaccagaagtgtttggtaatttttcaaagatttcttcagtgaagaaaggcataattgggtgtaatagacgtaaaacttgatctaaaacatggagcaatactgcacgtgtaatgtctttttcagcttcatcctcaccaaacataacttcttttgttaattccaaataccagtttgcaaactcatcccaaatgaaattgtaaagaatatgaccagcgacaccaaattcaaatttatccatttgttcagtcacgcgctcaactgtatcattcaaacgtgtcaaaatccaacggtcagtgacattaccagcagtttgatttgcaacttttgtcaaagccgaagagacagcatcagcgctgacatcttctgcattcatcaatatataacgtgaaacattccaaattttattgatgaaattccaagcagcatccattttatcataagagaaacgcacatcttgtcctggtgcagaaccatttgataagaaccaacggagtgcatcagctccatacttttcaatcacgtccattgggtcaattccgttaccgagtgatttagacattttacgtccttcttcgtcacgaatcaaaccatgaatcaagacattgttaaatggtgctttgcctgtgaattctaaagattggaaaatcatgcgtgaaacccagaagaagataatatcataacctgttacaagggtacttgttgggaaataacgtttgaagtctgctgagttttcatctggccaacccattgttgaaaatggccacaaagctgaactaaaccaagtatcgagcacatcttcatcttgtgtccaaccttctccctcaggtgcttcttcaccaacatacatttcacccgcttcgttataccaagctggaatttgatgtccccaccaaagttgacgtgaaataacccaatcatgaacattttccatccattgcatgaacgtatcattgaaacgtggcggataaaattctacggcatcttctgtcgcttgattagcaatggcattcttagctaattcgtccattttgacaaaccattgtgttgataaacgtggttcaacaaccactcctgttcgctctgagtgcccaacttcatggcggactggtttgacatcaaccaactgccccaattccttgaggtcagcaacaatttgtttgcgggcttcaaaacggtcaagtccttcatattttccaccattttcattgatggttccgtcgttgttcatcatgttaatcattggcaaatcatggcgcatcgcaacttcaaagtcattaggatcatgagcaggtgtaatttttacaaccccagttcctttttccatatcagcatggtcgtctgtcaaaatcggaatgacacgattaatgattgggaggataacatttttgcccactaaatgtttatagcgttcatctttttcattgacgataacagctgtatcaccaaggaaagtttctggacgtgttgtggcgatttcaacaaactcatcacttccttcaatttggtaagtgatgtggtaaaaagccccgtcaatttctttgtgaatgacctcaatgtctgacaaagcagtcatcgcttttggatcccagttgatgagtttttcaccacggtaaatccaacctttattgtaaagctgaacaaaaactttacgaactgcttgcgaaaggccttcatcaagagtgaaacgttcacgagaataatctactgaaatccccattttaccccattgttccttgattgttgtggcatattcatctttccactcccaaactttatcaaggaatttttcacgtccaaggtcttgtggtaaaataccatcttcagcaaggcgggcagcaacttttgcttgagtggcaatccccgcatggtccattcctggcaaccaaagcgtatcaaaaccttgcatccgtttttgacggatgatgatgtcttgcaaagttgtatcccaagcatgacccaagtggagttttcctgtcacatttggtggtggaataacgatgctataaggctctgcatcgggatttccagaaggtttgaaaacatcagcttcaagccatttttcgtagcgtcctgcttcaacctctgtcgggttgaattttggggttagttcgtttgtcataatttattttccttttctagttctcttaataatatattttcttcaatttctatttgtttactgaaagattcatagctttcacaattttgtggaatggcaagagaaattttaaaaatttctccaccataccctttcaacatcccttctgtttcatatttcgttttattaccgggataaagtaatccagctcttgttgcatttcgataatgtaaataactaataatctgaaatctatccatacgtttaataccagagtcaacttttttatacttcgtatcaataatacacctagctttatcgttgtaaaaatcaggtcttaccaagccagagtgaccttgaaggtataaactttcattactttttggatgttgataatcccttaaaatagtagcaagatattcttcccaaagccacgaagcatcaatcaaaattcctttaacaaaatttttattttccccaattccttgcttttctcgtcgtagaattattttacaaatttgtacgagctgtatatattcatgaaaataaggattttttatcgaaatttttttactaagcatctttgataaatctgacttcttaaagcttagggtcacttctcttactttttgaaaatctgcattattccaaggctgttttagttttataaattcaatggtatgtctaataatttgattaacagcattgtcatatgaaaattcgtgtgtttgatatgctacctttccaagaaatggaatatttttcttaatatgtcttgcaatatctaatgaaccttttatactaaaatcattatattcaaaccgttgatattccttatatattccttttttcaaagcctggtgtagatagtaaggaaagagatagattaataaatcataaaattgttcgtctgaagcaccaagattaaagtttatcacgttgattttcaaaactttttgaagcatataatttaggaaaaaatcagacttttcatcatcaaatcgtgaatgaatcgttattttatcatcaccttctgctagccagccaatcaaatttgttgtacgataatctccatttttatattcaagcaaaaattgttcgtctaaatcctcggattcatttagattaggtggaaaaattataaaaccttgcttttgaagcgccctaatatcaaggtttgctaaattcaaaaaccatgctggaagtgccgaaactaacgagttatctttaattctcatcataaatctttttcaactcgtcaagaattttaacattttcgtagttaccaacaagataagacattagcaatggctctaaatagtcactccaaagctcaacatcactatcaggaacttctttaaagtaagctccaccaatctgataatctttacccaatccctcaatctctgaaattttatcatttaaaacttttgctttgtttgctcgttcagagctaatagcattgtcttcaagcattcgattaatggaatcttcggcagtcacttcaataaatctaaaacgtctacgcatagcaaaatcaaaactttcaaccgagcggtcaatatcgttcatcgtaccaatgatatagacattttcaggaatatagaacttttcatctgtctcattcatgttactatactgagtagaaatcgaaccttttttcccacgataactggggtccaaagagaagaaaagttctccaaaaatttttgaaacttcaccacgattaatctcgtcgataataaagacataggatttgttattctcaactaaattatcaacgttaattttatcggaaagatattcatcaaaaataggttgtttatatgtcgaatggtagtttttgcttccccatcgtttatgctctaaaaaataaacaacattatctaatgtcaagctggcagaacttcctccgggaacattgtaggtaatattacctttaccattaacatgaaatttataattattaatttgaacttcatcatctccgatgctagagataaattcatcccatacttcagcaactgattttgttgattccacttcgattttagctttggctcgttcacaaaaaagtttaaaaatccctttttgcaattcaaaattcaattgaccatcatcactttttacaggtcttaaaccttcaataaaatcagtatagtcatagctaggatgaaactgtacaaattcaagttgtccattttcttgcgttgaccccaattcctcagcaatctttttagcaagataggtttttcccgttcccggagctccatgtaagataatatttttagatattgaaagttgttttcctaagacacttacctgttccatagacttaccttctttattttcaattaaactatttaatacttggatttcttttaatttattcgtccaatttaccagtgtatactgactaaaattaattttttttgctgaccatgccccaacttttaaaaactcaacttttctaacatggtgattattgtcagcatctctcccttgtttgttatattgataatcagatgttacttttgcctttgccaatagtgttttattttcacctattatgtaaacaatatcaccaatcttcatatctttataaaatctaatcaacgttccaccatggttgggagtatcaattttttcttttatttcttgatcattagccagagataagtcaaaatcggcaccagcaaaatcaagataaatttcattattatcctgaaatcctttccaatactttcctttctctcccgctcgcaatagccaagtattcatccattctctctctcatctatcttgcacaaaaaataccgcccccaagcttcctaaaaataggacgctcacgcgcggtaccacctaaattcctgacagatttactgacagacactcattttatgtcataattactgacaggacttttgtcagcaattatttcttgaaatgacgcaaccttcataaagtttgactgaacactttcaccaaccgtgttctctctataagtcttgctttattactcctcgtcaacttgtttttattttagcagaattcttgtttttttacaagatacttctaaatttttatttttctttaatgatttctaaaaaatgctccaagccttctttggcttgaatttgctgattacattgttcagaatctaagcaaatataggtgccatttttagtataagtgccgtcagcacctctttttgttgtcgctagaaattgagtgacaatacttgttttttggcaaatggcacagatatttttcatactgccagagatactgccagagaaaccacgcccgtcagcggtcaaaagatattttcggccgcttgaaacttcattccaagcaaagtaagtgacatcacgtaaatcccattgacttgtcgctggaatttttaactttttaacttttttgaaagcttttttcatttgagcttcgctcggtaaatgaaaagcttcgactaaggttttaagttctgtcagtaatttttcagcttgttctcttgataatttaggattatcaatggctgataagtattcttgaatagcaacttttactgacagattattttcgctgacaaggctgtcagcattttcagcgatttgcaaaatttctgtggcgacttgggcgtaaactgcctcaactgtcgatttatcattgacagagtgatagacattgacgaggtcaaaggtcaggtatttaattcgattatattcatatggttttaacattttcttattccttaagatgtgaacccgactgctttgaagttatgaaaattgagaaaatgcggttctgtgcaaggcacaagttccattttctctatccatgccactatgtggcctatgctgtccattcgctctaagcaactaaagttgcaaggcgaatcgcattttcactcaacttcaaggagggtgaactcaatttgttcttatccgcaaagaaataagactttgcggtaatctaagcgagagctcttactcgcacttgattaccaaccatcttcttaaaattcatttgaatctccttaagatgtgagcccgactgatttgaagttatgaaaattaggaaaatgcggttctgtgcaaagcacaggttccattttctctattttcactcacttcaaggagggcgaactcaattattaattaaaatgtttttgttccaaaatctggaacgtcatggaaatctttaccatttttgtagttttcaaattttccttgcaaaaattggtatgcgtctaaacgactttcataacgaatagcagcttctttcgcttcttttttaccgtcttctgtggcaattttttcagctgctttcatggcaagttcagaaatttgaacttgttggtccacccattcttgaaaatcttttaaaaaattttgttcgtaagtcattttttctcctattaaaattcagagctgtcggctcatcattatcttttgggtttgattaaatcatagctttgctcaaccattttgcaaacttgctcatcaacaacatctccaccaagtaaaacatcgttccaatgcgttttattcatgtgaaatgctggattaatatccacaaagaaatctcgcaattcgattgcgatttctggcttctgcttgattgcgatattgactcggccttctcgctcagaaatataagcaaatgattttttattctttaaatgtcgcatcactaccgttggctgacccttctccattttggcaaagggagtatctgcaaaagtcggcccaagagacaagcaaaaatcaataagttcttttttattcatctatttattaagctccaattgataagcaaaacggtcaccttcaaattgaacaagtcctcgttttacaaagccttcacgttcaaagacatgttgcatcaatttattgactgggtgggtatctaggcgaaaatcagagtatcctttagataacatcaaggtaaaaatatttgaaaatagatatcttgtcaaagattgtccacgaaattcgttagacaaagcaattcgatgaatggtcacataatcaaaattttgatttgaccaagcgccgtcagtaatttgagtataagctggttcttcacctgtaataattgcacaataaccggctattttatcatcaactagtaagacataggcctgttctttcgcaaaatcctcttcaatattaaaaactgctggataagcattttgccattggtcactcccggaatcagccaaaaaagttcttgcttcttcaataattttcataattgaaagcaaatctttcgggcctgcttttctcatataaatcatataaaacctcggattttttccattttatcataaaaataattaatgacagaaccgtcagatttactgacggctcttttttattgacagtatcatcaactttcctatcaaatctcttatttgtcagtaaatctgatttctttagatgtcacaaaacgctagtctaaagaaatttctggattttctttagtgactaggagtacctgtgctgttcctcctaaatatttttcactcaattcagctaatttttgtgttgcagcatctagaacttcaccgcgttcagggtcaacagattcaataatcaaaaaagcatttttggtttgttctgtcagcatcgttctttgaccatcacgccaattccatgagcgacaaactgccccttcatcatcaagatagcagatttcaccaggcaaagcattatcagcttcatcatcacccaaagccaagaaatgttcgccaccaacagcttttgtcaaacgtagatttcctgcaaaagtatcaatatcctcaccaccagcaggtagcccataattcaagctaatactattgtaaatatcaaccaaaggattaatcgaacccacagctttacctttatctactcgtttaagcagattttcaatcgaacttctagcccctttttttgttttaaattgttgataagccttgcgccaaacagagactacagaattttcactaaaaacagccgcttctaaaaattgccctgcattttcattcgcctcatcaagattttttttgatttcagcacttgattccatactattatcaatatttttagctaaaacaattccgatttttgtctcaggaaaaagttcccaaaattcaggttcaacaataaattttttcataattttttcttacttttctaattttaactataaaatttactgacgaaaatcttgtcagtaaaatacgactgaataaggagtattttatctgtagataaaagaatgaccagcaaagctgagcattctatccatcgtcagcgagtgaacaacgggcaggtaaaacgtaattaaaagaatgaacaactaaaatatccattttgtcagtaaattttcacttaaactttagctactagcaactaataattctgtcagcaaaatttctcaatatttaccatatttttgcggacgacgtccacgttttttacccttagcaaaagcttcagctttacgttcttcttccaaatgttcaaatttaacaattttcaaaggttcatcacgttttgtcaatttaacaactgcttcagttcttgctgtatgtgggaacatgtccactgattggatgtattctactttgtaataattggccaaaacgactaaatcttttgccaaagttgaaacgttacagctgacataaaccattttttccggtgggaatttagtaattgtttcaagcaatgcatcatcaagccccgtacgtggtgggtcaacaatcattgcagttgctctatgaccagatttgttccaatttggaataattcgctcagctttaccaatttcatagtggcaatttttaagccccaaacgtttggcattttcacgcgcatcaaaaattgattctggtgtaatatccattccatgaaccgattttacttttttagccaccgcaaaaccaatcgtacctacaccacaatatgcatcaatgacacggtcatcttttttaggattcaaagccttaactgcttcaccataaagtacattggcttgctcagagttcaattggtagaaagcacgaggacttaattcaaattcataatccaaaacgccttcggtaattgtttctttttcattgaataaaatttgtgtgcgttcgccatagatttcactggtttttcttgggtggaaattgaccgcaaccgtcacgatttcttcaaattcttctgtcagtgctgacaacattttatcaaatttaacaaaagaatttttttgacgttttgaaggttcttcacgtaattcaggccaaacttgtccgtccaaaataattggtgttgaagtcacaaaaataatttgtacttcacctgttttttgtgagcgacgaaccatgaccgtacgaattccgccgattttacgttcatcatatacaggtaaatcaaatttttcaatcaaacggcaaatgtgattgataatttcttgggttttgggatcttgaaccaaacagttatctaggttaaccaagtgatgcgttccttcttgataaagtcccgcaatcactgttccgtcattcaaacgacgcacttggaactgcaatttgttacgataaccaagtgtattttccattcccaaagttgcacgcaattcataattacgccaacctgctggtttatatttttctaaggcctgacgcataacatcacgcttaaattccaattgcattggataagaaagatgcatgatgtgagattgactcatttcatgataagctctatcctgtggtttcacacggtttggtgatttttcaataatcttaaccaattttgcacgactaaaatttctagcattttcagtaatttcaactaaaacttcttcacctggaagtgcataaggaataaaaacaagtcgtcctgaaatgacgccaattccttccccatttattcccattcgctcgatttcgagttgaagtttctgtcctatttttaaatttatcattctttaattattttccctctagttcgtcaattaaatgaccattttcaatccattataaaaaatcactaataaaggattgtgtgatacactattataacatttcacaatttctttttgtagtctttttctacttgaatcctaaaagatttgaacttattttttcatctatgaatattactctccaaataaaaagcctgacactgtcagaccttttatttttctttaattattgttttttacgtctaagtaaaagagtaagtggcgaaataatcactgccataattcccagcagagtcaaaacaatttgtgatttttgactatcaccagtacttgggagaacatctgttggcttactatcttttacagccttagccgtaggtgtttttgattgattattagacggttgacttggtttatctgggtgaactggaggaacgataattcctgcaagcaccttatgataaacgacaattctttcaatgtccgctgtatctaccgtaattcctgtcatttcatcaatcttaagttgacttgcgatgtaatctttaatgattggcgaaagaactgcagcaaatcttccaccattatcagctgtccagtcactataagttttctcatccgtcactttgtcagtagtgattgtccgactaaagacaattgttgccttatagttgtcagcagccttatccccattatcataaacataatgaatgtcttcattaactgatttattttccgtctcaactactgtgccatgttttaatctcacaatataatgttgagggtcatcagcaaatttagttccatcttttggataatcatttgaaactaactcgtaacctttatctgtataagatttaatcgtgtcagccgttgcatagtcagctgggtcgcccgttccaccagataaatcttttgtagtcaaaatttttccagttgtttcatcgatataaataacatcaatggttccttgatttcgagtgtaagttactgtcacagaaatatcttctgtatctaccgtaatccctgtcatttcagaaactttaagttgatcagctgtatagccatcaattactggagaagttactgacgcaaaactatcaccgttatcagctgtccaatcactataagttttctcacccgtcactttgtcagtagtgattgtctgactaaagacaaccgtagcattgtggtcagtagctgcttctcccccaccttcataaacataatgaatcacttgattgaccgttttattctcagtcacttctgttaacccgtgttttaatctcacaatataatgttgagggtcatcagcaaatttagttccatcttctggataatcatttgaaactaattcgtagcctttatctgtataagatttaatcatgtcagccgttgtataacctgaatcatctccagttccaccagacaaatcttttttacttaaagtctgtcccgttgtttcatcaatataagtaatatcaatagttccttgatttcgagtataagttactgtcacagaaatgtcttctgtatcagcagtaatccctgtcatttcagaaactttaagttgatcagctgtataaccgtcaattactggagaagttactgacgcaaaactatcaccgttatcagcagtccaatcaccgtatgtcttatcattcgttactctgtcagtagtaattgtccggctaaagtcaaccgtagcattgtggtcagtagctgcttcacctccaccttcataaacataatgaatcacttgattgacagcttttttatcagttgattctgttaagccgtgttttaattttactacatagtgttgtggctcatccgtaaagactgtccccccacttgggtaatcatcagaaactaattcatagcctttagctgtatatgacttgatatcagcagcagttgtataatttgacggatcatccgttccaccagataaatcttttttagtcaaaacttgaccagttgtttcatcaatgtaagtaacatcaatggttccttggttacgtttataaacgacctttttctgaatatctgctgaattggctgtaattccacttattgcatcaatttttaattggtcagctgtctctcctttaattgttggcgaaactacttctccaaaactatcaccattttgtgcttgccagtccccataagtcttttcaccagttacttgattggttgtcacacttcttgtaaaattcaatggtggagcattataatcatctgctgccttgcttccatcttcataaacatattgaattgtttcattgacttgtttttgctcagaacttacaactaatttttgtttcaaattaacaacatagtgttgagctgtatccgtaaagactgtaccaccacttggataattatccgaaaccaattcataacctgcatctgtataagatttaatggtgtcagttgttgtgtaattagaagaatcacctgttccaccagataaatcttttttacttaaagtctgtcccgttgtttggtcaatataagtaacatcgatggttccttgatttcgagtataaacatagtttacagtttggtcattggcagcatagttccccgaagttgctgctccgtttgatgccttaaaggcataacctggaatagtcttttgacttgtcacatatggagtatcaatatctccacttgttgtttctgacggagcaatcgtctttccttgttcatccacataattagcaataacagtaccttgagctaccgtataagtaaaattaacattacgcagttgttgcaaattcatttgggcaccagttgaggccgcaattgagaaagacatcgcctgatttgttccaacaaaagaagaaacatcttgcgtccaagtttgaccaccataagtaactgacattaccttcgtcgcaccattataactcattgtaaagtcaacaaaattattatttgatggttgaggaatacctttagcactagcacttattgttttagcctgtccattcaaaccatcaacaaaggctccaaaaggcttaccagagaaagtagatgggtcgggtgtaaagcttgtttctcctacgccattatagtaagtatccagcttaaaaccaaatgctccattaacaccaccaataccagcagctccacccggtgctcctactacacttgtatcaccaggatgaaaaaggaaaccaacaccatcagctccaccattttgctgtgatttattccctaagttgatttgtccagtaaaagtaaagttttgcgacatatcaacttttgttttcagagttacatttcccgcttgatttccaaggtcaggtgttagagtttgagtataggtagttaaatcataatcaaatccagcagcagaaccatttctctgaaaataatttagaaaatcttttggatagactgttatatccctggaagtagcagcataaactctctgtattttaaaagagtcggggaggtttgttaaaacaaccccgccacctgccagaagcgttaaagttcccatagttaaaagagcactcgattttttattcatttcttcatctccgtcatatttgtagattgtttgttataattttactacaaaaagtggaagatatcggatattttgtcttgtaaatattacatcatttaaatcctattatttttaaaaataatgaaaactgtataataccaacgtttaaacggtattttttaataagtttacagaaataaccatcttttacaaacaggtttataaactacactttcatttcacgtaattgttttactacacgattcataagtgacaatttttaattattttcgtatataatatatacatgggaaaaatcactgcaataaaaaaattaaaacgactttaccgcgtcgatttatctggatttgatgaagaaaaaatatatctttctgaggatacaattgttcacttttttctaaatgttgataaagagctcgatgatgcagatttagaagagattcaatcttatgaccaatttgctcaaggaaaatcactagcactctactacatttcctttaaaatgaggacaagttcggaagtaagaaaatatcttagtgaacacgaaattgacaatactgaccaaattgacgaggtcataaatgctcttacaaaaaacaatctaattaatgataaagcctacgctgaaaattttattgaaggaaaaatttcaatgggaagtgctggcccctatcaaattaaacagaaattaataacaaagggtattgatcccctaatcattgaccatgcactttctaacatttatgatgaggaaaaacaaatagatgttgcctacaaacttgccgaaaaaacagacagaacttatggccaaagattgaccctaaaacagctgaaagataaaattattcaaaacctaatgaataaaggttttacgtattctatctcttcaattgctttagaatcacttgaattagaaacagatgaagaaaatgagacccaacttctctacacagcactagaaaaagtttccaaacgctacagtaaaaactatgaggggtacgagcgaaagcaaaaagttacgcaggctttggctagaaaaggtttttcatatgatgatattagtagcgcattgcgtgattatacatttccagaataacttctgacatgctcaacacaggactgtcagctgaagtggcagttttcaaaatttgtggactatgcgctttataaattttaaagtctccactcgaaagattcgtaaatttttcatcagttccttgagaaactatctgaaaccaactggcatttccagtattttccactggagctactggttgagagagttcttttgagctttttgttgttgattgctgagatgaataaccattaggttcactcgttcttttaactaactgtcctgttgtgttcgtattaacagaagaaatatcagttcccttatcataaaaatattttccgaaaccaaatagtactataagtagaataaagattaacgacataatcattattttctttgatacacttttcttaatcatgtctacctctttcttgctcaaaataagatttttccaaaaactgaactaagcctttcatagtatatcaccctaaaattaggatatgtagaaaaacttaaaatattatgtaaaaacgcattaccttacaagcgataattttattattcgttatttttttaaggtttttttactacacatgaattttaagtttcgtttatttatcaattgtattattagtttcatttattgtcaagaaaaataacgcaaagtaactttctttgcgctatttatatttacttaactttaatgtaataaaaagacctcaaataattttgaagtctttttattatttattcagtaattccaagaagttgcttaatttgttttacttgcattttagcatattctgttggatttgatttttgaagtgcagcaagttgagccgctttttgtgggtcagctttaagttgagcttccatttgtttttgcattgctggagcttcttgactcaattttttaacttgatcttgagtcaaaactaaccatgtatctttaggtactgaaacaactgaattttgtttaactaattcattttgttcaccacctacactaaatagtaatttataaaagtcagatgaccaaacgcgtcttgtcgttttagttgtaactgttgctttagtattatccactaatttataagtcgctgattttttaacagcttctgaaatgtgtttttcatcaggtttaaaattagtgtcggctttttccgatttttcattatttcggtaaacaaagacataattatcagtgtttttaccgatttctgctttaatcatcattccataaggagctgatttatctccagcagtataaatttggtgagtagttgaagttgttacttctttcattccccagttatctctgatatgcatagttagcatggtcacagaaccagctaataagagaaaggaaattccaccaactaaccaatgagcgattgtgttttttataaacatgaaaccaaagaaagttccaatcataaacactaccaataataatataattagcattatttattttctcctttcaagtcttgttcttcaacagggacaccagcaatcattcgaccactcttcaagaatagagcaactccgataccaataatggcaaagacgaatccaattgcgaatgaagcgtggtaaccttgtaacattgcttcgattgctttatttgcaaattgcaatggatttgttgattttaatgatgaagcaggcatattgttagtaattacattttgagcgactgaagaaaggagagcaacaacaactgatgacgcgacttgacgcgctgtattgtttgaagctgttgcttgagcaacttcattaactggaactgcattcatggcactagttgttaatggcatcattaccataccaacaccaaccatacgtaatccataaagaagagtaacaaagtggtcaggagttgtagctgtaaagaacataaatggtacagttcccagtgccaaaacgaggaaaccaatcaccgcaagacgttttgaaccaattcggtcataaactccaccagcaagtggggcaacaacagccatcattaatgacccgggtaagagaaccaaacctgaattaaaggcagaaagtccatggacatcttgaaggtaaagaggaagcatcatttcaacacccatcattgccattgtacttaaagcaagtgcaagagttaccaaagtaaactgtctaattttaaagacgcgaatatcaaggaatggatcgtccattttaagttgacgtaaaccaaagaggaagataataatcaaacctccaacaattggggcgataactgtattaaatttaccccatccgtcagttgcaacattagtgaatccccaaaggaaagcaccaaaaccaacaactgaaagtaaaactgacaagaagtctaatttcattggacggttcggaataacatcacgcattgcaaagattgaaataaggaaaacaactccgacgacaatcattggaataaggaaaattgttctccaacttgctgcaaatgtccaaaagataaggttaaatttatgagtaattaaccaacctgcaaatgttggacctaaggctggcgcaaggacaagaacaactccggcaacacccatgattgctcccatttgtttagctggaaacatgttaacaagggcaacttgcatcaaaggcattgtaatcccaactgcaatagcttgcagaatccgacctgctaggaaaacccaccagcttgatgttggagccgagtaagcaacaaacattccgataaataaaattgcgtatgctgtaacgtaaagccaacgtgtagggaattttgttgctaaatatgctgaaataggaaccataatcccattggctaataaaaaccatgttgttgcttgttgtgctgttgacatggagatgttgaagtcattcatcaatgttggaattgctgtcccgagcgatgtttgcatcaacatggctccaaatgtaccaaccagaatcaaaataagcattccgattcggctataatgtttaccatgtatatctaaatggtaatctttttcgtatgtatcaggcatttttttcctcctctttttctttgtcttctttagctagcttcattccaatttctaaaaataatttgaaattttcaatgaaactttctgttcgttcttcacccatttcttcaaaaacgcgtgctaaatttgagcaagcttctactcgaatttcttccgcaacatgacgtcctttatcagtaatggctactaaaatttttcgacggtctgttcttgaaatctcacgggtaactaaatttttactctcaagattattcaagattgtcgcaattcttgcagtacttgtatgcgtaaattttgcaatcttacttggaacaatttgcttaccagcttccttataaagatagcccaataccaaatgctccccttgggagtaggtattaaagcggtgcatcatctctgcttttcctcttttgataacagttgtgaggaaaacctccgctgccttattgtaatccattttcactcctccctaacggtgatatttactaacgacgttaactattataatccgttcactatcttttgtcaagaataaaaattttagtttttatttttttgttaaaataaaaaaacctattccaaaataggcttttttatttttaaaattatccaacaattcgtgcgaaggcattttttaattcattattctctgtttcttttagatataaataattatttgtatttccttgattttgtgcggtataaagcaccatgggatttcctgatttaataacaaagagataaacatgattaacaccagagtttttctcattcatatctgaataaacatcaactaattgatatcctcctgaatcttctcccgtttctgaccattttaattcaataggctgattatttattgctgctttccaagttgaattattatctataactgaccaaggaatagagagaccatataaattaagattgtgattaggatcatactgactgtaagattgtcccatttctatcccccacgctgacataaactctgcaagacgttgttttttctctgggttccattttcttatttgtgtagaagttgagggggaaattgatttttctattgatgaagaggactctttaataatacttgatgactgggtagtactcgaagtgctctgagttattgaagagcttcgtgagctttggctacttttagaactttcttttgttgtttgagaattttgttttgaactacaggctgacattccaagtgttgctactaaaaaaattgcaacaagatatatttttttcatcttttcttctcctaactacaattttacttcaaaagtaattaaaaaactactaatatcattaaaagaactaaataaaaaataagagtcccatactttattcaaataggaactcttattatagttactttatgactatgattttttatttcttacagaaataagcaacatcattggacgtctcatctcatttttcatttcttcaagctctctcatttctataggaggtttgggttcaattaaattagtaagttcaaaaccagagcttaacaaagaacttacatagcttgttaatgtccgatgatacttaataattggctcacctaagaaattgacttcacgttttccttcataataataattatcaactggaaaatgaagaattttaccttctgcatcataacaccaatcttgtttccctgatgaggtatagagaggatgttcaacagagaaaataaattcaccattctttttaagacaatttgaaattttgcagaccaggtcttcaaaatttgaaatgtagtgaaaagctaatgaactaaacacaacatcaaaagtatctgcaggaaagttaatatcctctattgcggattgttgataggtaatttttttatcattattaatatcaagagcaacttcaagcatcttgtgtgaaaggtctattcctactacttctttagccccatgattgactgcatatttacagtgccatccatatccacaacctaaatccaaaacttttttatcctgaaaatttgggagtagtttttctaattcagaccattcaccagcggccttcaatcccttttgggaccttgacattgatgcataatttttgaaaaaacgttcattatcatatttattttgtttcattttttattctccatgtaaatatagttcatcattttataaatgtttacatggaaactacaattttttgagcaataattcctttgttcatctatcttctttcataattcgattagttattttttgtgtattttatagtcacattctatcataagtcatttaaaatgtcattcggtttgaaggaataaataataataaagaaaagtagaaaatctacttttctttactctcaacttctttaagtgcttttgaagcttcactaaatagctcctcagctttacttgtggtcttttcaaaggtatcttgaattcctgtttgcgtaccaactgttgcatttcggagtgcttcgtcttcaagttccttcatttgctcattgcttaatttggggtttatttcaggcataatccacctccttcttgacttcattatattacacttttcgataaagcgctaacattacgttcaataaaaaacaactcaaacaaaaatgagttgtttttactatattatgcatcaattgtcgagtactgagcattattttcgataaattcacgacgaggttcaactctgtctcccatgagcatatcaaagattttgtcagcttctgctgcgtcttcaacagatacacgtgccattaaacggtgttcaggatccattgttgtatcccaaagttgatggtcatccatttcccctaaacctttataacgttgtacagtaggctttgttcttccttgtgcccaacgtgctaaagcttcttgtaaatctttttcttgattttcacctggttgaatgtattcttttgtttctgaaccaactttgataccgtaaattggtggctgagcaatataaacatatcctgcttcaacaactgggcgcatataacggtagaagagtgttaatagaagagtacggatgtgtgctccatcgacatcggcatcggtcatgataacaagtttgtgataacgtgcttttgacaaatcgtaatctgctccaaaaccagttcccattgcagtgaatagagaacgaatttcttcattggccaaaattttatccatcgttgctttttccacattcaaaatcttaccacgaataggtaaaattgcttggaattcacgattacgtcctgatttagccgaacctccggccgaatctccttcgacgatgaataattctgtttgttctggattatttgatgaacagtcagccaatttaccgggaaggttggaaatttcaagccctgattttttacgtgtcacttcacgcgcacgttttgctgcaatccttgctttacttgccaaaatccctttttcaacaattttacgagcaacttgtggattttctaacataaatgttgtcaaagcttccgcaaagagtttgttaacaattcctgttacttctgagtttccaagttttgttttggtttgcccttcaaattgtggattaggatgcttaaccgaaataactgctgtcaatccttcgcggacatcatccccagttaaattatcttcgttttctttaagaattttattttgttttgcgtaattattaataacacgagtaagggctgttctaaaaccttgctcatgtgttccaccttcgtgagtgttgatgttgttagcaaaggacattactactgaatgataagtatcagtatattgcattgctacttcaacagcaattccatccatttcaccttcagtaaaaattgctggttcaaaaatgactgtcttattttcatttaaatattcaacataagactgaattccaccttcataatggaaatgaacttcatttttttcatttccttcacgcttatctgttaaggaaatacgaagaccgcgattcaaaaaggctaactcacgaacacgtgttgcaagcttatcaaaatcaaattcaacagtttctgtaaaaatttctgggtctggtacaaagtgaacagttgtccctctacggtcagtttcaccaataatttttaaatcatctccaacgagaccacgatgatattcttgataatatttttgaccatctttatgaacagtaacatctagtactgttgataaagcattaacaacagacgaaccaacaccgtgcaatccaccagaaactttatagccgcctccgccaaatttacctccagcatgcaacactgtgaagactgtttccacggctggacgacccgttttttcttgaatatcaaccggaattccacgtccatcatcaacaacagtaattgaattatcaggctcaataaaaacctcaatatggcttgcaaatcctgcaagtgcttcatcaattgaattgtcaacaatttcccagactaaatggtgcaaaccttcttttgaggttgaaccaatatacatccctggacgcatacgtacagcttcaagaccttcaagtacttgaatttgactggcgtcatattcgtctgcaagcatttctaaatttttattttcttcgttcaaagttaactctcatttctatgaaaaacttactaccattataccataaatcagcgattttagctctagtgcatggtattttgtcactcaaacttgtaaaaaaaataagcaattttgactaaaaatctgcttatcattaattcatttttttaagattacaaaataatctctgtcagctgatgaataatgtgagttggcttgctattaagcgaaccatcacttacagtgttaatcgcttgtcctgacagagttgaatctgttgagctatcaaaataaattgttgatatcccagcagcatttcctgcttcaatatctaaaggacgatcgccaatcatcactgtcttctttggattgagtttatatttatttaacaaatagttaattgattctggtgctggttttcgtttgaagccattatcagacgtgacaacctctgtaaaatatgaatcaatttcagctgctgacagaattgtcagaacttgatgattgcgatgtgaaatcataaaattcttatttccttttactgataggtctgtcagtacttttttagcaccggaaaagagaattggtttttctaattcctctgcttctagctttttgtattcttccaaaaagcctggcaaatcactggcatatttttcaacagcgtaagccgttgaaacttttagcgcatcatatacatcagtgcgcaaaacaacacgctctgccattgaccaaagcgttgcagcaaatgcatgactagaactttcataattgtccaataaagttccgcctaaatcccagatataattttcgtagtccatgttaatattataacacactttggtagctaacattttgtcagaaatggatatttttagtttgctttcaaaattttaactggaaattttttacctttaaattgattctgagttagttccatctgtgctgttaaataattctttaaaagtggtttttttatactcgttaatgtaattttttgaagttgatttttcttaacatatctactgaaatcaaaggtttgtttccaccaagttggatgacttgcagctacaattgcaaaattttctcccgttaataattgatgatcataatattttctctcaatatcattgaaataatcctctgaatagtaactaagctctctcatagctctgtcagtaacaatactcgcttcttgttttttttcaaaagttgaagtttcaaaggcaaattgtacattatttgtttttgaatctacaacataataaacttgattatccactaaactgtaagtttctttaattttatctttgaatattaaacctcccagagcaataataaaaaatacagtataaagtagaatccttttccaaggatttaattttcttgctctagtggcctcatcaattttttcaaaaggattttctgtaaataaatccctttgttcaaaaccgctctgttttaaccacacttcttcacaaataatagaaagttcattaatatccatagatatgatagagccctgtatcgacaatacaatttttaaattgtgacctggttcaaaataattttggtaaaactttagccgtttataccaaattttcttttcaatatagacaggattaaatgaagtttgttcacaaatatataatacacctgaacgaacatacattcctcggatgtctctccactcaatcttaacttcacgaaataatagccgtaattgaattccttcttcgttgatgatgaccaactttcgtcgagaatgattgatgagaaatatcaaaaaatatataagtaatagtccaattaataaacttaaaataatatggcgcaaactttcagaattaatagattcctgaataaaaaaattctcgaaaaaagacaaaaatataaaaattgaccaaagaaatgctaacttccaaacgtccgttttaagttccaatggtaaataatactcttccataaaattctctcctaataaaaatattatatcagaattttctaataaaacagtttaaaaaaagaaacccctaggtttcttttaagcttgttctgatttcgatagaagaataacagacacgatgaccataacaatccctagtaattcgagtggggttaacttcaagccaaataatggaatacttaaaaaaacagaagtcaatggttcagtagctgttgcaacagaaacaacaagcggtgaaatcaattgaaaggctcttaaaagcaacaaaaaagccagtgctgttccaacaatagaaattgttaaaacataaaaaattgacaagggttcaattcgaaaatcaatacgccaaactggatagaagatattacaggcaatccccgcaagcatcattccccacccggtcatattgagtgcgccatatttatctaataatggccgagggatgattgagtaaataacaacagctacaccagcgagaagtcctgttacaagggctaggggactgattgataaatgtttgatatttccgtccgtaatcaacaaaaaaacacctaccattgctaaaatgacgaataagaccgatttgggttttggtacttgacgttgaaaaatgagtaaataaagcataataaaaacgggtgctgtatattgtaaaattgtcgccgtggcactgttagacaattgaatggcaacataataaaaatactgaacagagaaaactccaccaaaaacatacaaaaagagcgttggcatgttcttttttgatttccagacatcaaaaaaacgcttatggtctcgcgaataagacatgaccagtaaaataataccagcaatcgttaaacgtgttgatgtaatccaaagtgggctaccatgataatcacggaataaaagctgaccaaaaatgccagaaattccccacatacaaccggcaactactgcataaagtgtgcctttaaaaatttgtttttttacattcatttttatattataccatacatcaagagggttcattagggttcagtcatcattatgtttttatatattacgttctcgattattagtgagtttaagacataatggagttaaaagaatagcttaatattttatcaaacaaggagtgtgtatcttaaagattagcagaaaatttgttaaatctttacattattttactatcaatatggctccaaaattttatatttacttgaaccacttcaggcgagaggcgatatagtcccaactattttattttcttaatcagttaattttgttaaaaaaaaacattttatataaaatgtttttttggttattttaataaaagaatcggataagaattccaccgaagataaggacaattgcaccacagagtctattagccatctgtgcaaaagcaatcatttccattctatctgatgcagacaagacagcaatgttacctgttccacccatagaattattgatcatccctgcaccaatggcagtttcgactggataaaggccaaagaggcgagccaagaaccaactagcaagtcccattacaacaacacttgtcaagcaaagtacaacaaattgccatgtaaatgctgaagcaagagtattcaagtcaatcaaagcaagaccaatacctgccaaaacagcatgagtaaggtttgtcataatcacttggttaaacattacaacagattcttctaaatctttaggaacagtatttgttgctttcaagataaatacaataataatcataaatgcatattgatgaatattagggaagaatttgttcaagatgtcaccagccatcaaaagagcaaaggcaaagagcattcctgttccgatttgttgagcatctaattttattttaggtttagccaactcttctttagttgctgcaacaagagtcccatgtccattatatttagatttattgaatactttagcaatagataaggcaccaataatcgcaagaatattaccaaaagtaactgctggtgcaagttgagagaagatagctgcttggtttccatgagccaatccggctgcatagatttgagagagtggagtaataccggctcccataccacctgacatcattggcatagaaacatacattacagaatcagcaaatccattaccaataagcattcctacgagacctactgagaagaaaccaataaccatagtaattaaagcaatcggaataaatttcttggaagctttaaccaaaagatttctgttcattcctaaaatagatccacagataagtgcagctatataaaaatcaagaaatccaaatttccctcccataaaattggaaactgctccaataacatttgaaggaacaatgtggaagaaagataatagagtagcaccaattaaagtgaaaacagatcccccacctaagtatgaattcataatagggagtttttctcctatgaagtataataggtgacctaatgttacaagtaggagagttaaccctaccatatcaagtggaagttttcctaaaagtgttacaactatgatgacagctacgaaaaaggcatataagggaagactaattcccgatattttcgtttctttaagttttttcatttaagatattccccttagtactctggataccatttaagatcacgaactgctttagccatatcagtttctttagattcagtaagaccttgttcttgagctttcttagcaactgcttctgcaactttaattgatacatcagcaacaaattcaaatggaggaagaacaggagcacctggtttacctggatctactaaaccactcaatgaatgtgcagctgcaccgatcatttcatctgtcaaaagttttgcttcagatgccaacattcctaagcccaaacctgggtagataagtgagttgtttgcttgaccaatttgataatcaacacctttgtagttgattgttcctgaaggaacaccagtagcgacaaaagcttttccatcagaccactcaataacttgttcagctgtagcttccatttttttagttggatttgagatagggaagattactgggcgttctgtattagcacacattgcttcaacaacttcttttgtaaaagcacctggattagttgaagttcctactaaaatagttggttttactgtcttaacaacgttaagaaggtccgtcatatctccagcatctttataatcagcacgttttttagcaaatggtttttgagctggtgtaaggtcttccatatcatcaaaaagtaaaccttgttgatcaatcatgaagaaatgtttgtaagcttcttcttcagaaagaccttcactaaccatttcagcatgaacacgaccagcaatccctgcaccggctgaaccaccaccatagcaaaggtatacttgatcagttaatttttcacctgtaatgtcaagtgatccgaaaataccacctaaaacaacaataccagttccttgaatgtcatcattaaatgttgggatttttgttttgtagttatttaaaattgttgcagcatttgaacgtccgaaatcttcccagtgaaggtacaatttagggaaaattgattctgcagtttctacaaattgatcgacgaaactgtagtattggtcaccgtaaatacgttcttgatggtttcctagatacaaatgatcttctaaaagttcttttctatttgttcctgcatctataacaactggaagtacagacgctggatcaatacctgctgcggctgtataaatcattaatttaccaactgagatatcaacaccttgagttccccagtctccgataccaaggattccttcagcatcagttacaacaataagacgaatttctctgtcacctgctgcatttttcaatgtttcagtaatgttttcagggtggttaatatcaagataagcagcatattgtggatctacgaacaaatgactgtagtttttaattgtatcagcaattgttggatcataaacaactggattaaattctacaatatgtttgttaaataagtagtaaaacaaagtacggtttgtattaaaaatttccatcaagaaatgacgtttttctaaatcagatggttttgtcaaatattgttcgtaagtttgttcagcttgttcttcaattgtttgaacagttggtggaagaagaccaatcaaccccaattcttgacgttctttcatagtaaaagctgttcctttatttaaaaaaggattgtttaaaatttcatgtgcacgcatcgtacaacctccataaaaattataattaatgttattactttattactataaacttcttttatcgttatagtcaaatcccttggtgttgataaattttatttataacacataaataatgtcaatgtttatctaaaaggcttgatataaaaatagatgatattaatcaaagaaataatagtaataattagcttataactattaaacgatgaactgttcttctcctattactattcctaatttatcgggctttcaaacaatttaagattaagattttttgtcaatggtggttgtgtatctaaagtatccatttttttaaataaaaacaaaattgtgcgctttgctttattcatattttctattatatgaaagtattctaaaaaagtagagtaaaatcactctacttttattttttaaatttatgtatcttttaggttaataatttgattagaaattttttcaacaaatgcttgatcatgttcgaccagaagcattgttggatgataagtttctagaagttgaattatttgttcacgattaaacacgtcaagataattaagcggctcatcccagagataaagctctgcttcttgtgataaactacgagctaattcaacctttttttgttgtccttgactcatcgtttctatcttttgactaaattgcttgcgctccatccccagttttctgagattagctaaaaataattcataatctaattgatattcggtagcaaagtctttcaggtaaccacgattatcataaatctgacgaacaaatgatagccttatcccttgaggaaattgaacaaatccactgtgctcaccagaaaattccccagataaatatttaataatacttgatttcccttgaccatttggtccgacaattgctgcaatctctcccactttcaaagaaaaatcaatcggctggaaaagtaatttttcggtaaatccaagagaaaaattttcaaactgaatcagtcttttatgatgtgaaggttgaaaattaatgacaagaggttcagttttttcgatatttttgagtaatttctctttattctcaacttcctgtcccattcgtttttcaattgattttgctcgttgattctgttttttggcaacttttttatccacaaaggttgctccggcaacattttctcgttgattggaccaatctcttttttctaacgaagtctttttcagtcttgaaatatctttacgtaatttttcatcttcagcaagttcaaagtcatcacgcaactgtttctctcgttcataggttgagaaatttccctgatagagaactatttgctgacgttcaattgccaaggtgtggtcacagacttcgtcaagaaaatttcggtcatgtgatacaacgataaatcctgatttcttttgaagatagtcagcaactatttttctgctttccatatccaaatgatttgttggttcatcaattagtggaaaattgtcctcatctaaaaataaaattgccaagagacacttggtttgttccccacctgataaacttccaaaaggacgccaaagaatttctaaatcaactttcattaaagataattcacgttctaatttccattgttcaaattcggctaattcatttagcacataataagttaattgtgaatttctgtcagtaatttttactgacagactttctacagaatatttatcagcagtattttgttttttagatttatctttatcattaaaatcttcttctgtcagtaattggggaaagtaaacaaagtttttgtcagtaattatagagctgtcagcggttatttttccttgtagtaagtttaaaagggttgattttccacggccatttcgccctactaatcctaatttccaacggtcatcaatatttatttgggcatgattgaaaatcagattatccccgtagccaaaggtcaagtctttaaattcaatatttgacatttaattctcctctcatttgtgagaattaagaaatctaatttgagtagaaaaactcagagtgagttcctctgaatgttcataaatctcaaattcccgcttttcttggagcattaatttttgctccgtgttgattttgcttggttgcttttactgctgtcatcccattagtatttttcccagcaaattgcggtttattcttcttaatttgttctagtttagcttgcatttctttttgtttttgattcattattttctccttaaattaaaaaactcttttcacaacttaggtgaaaagagctttaaaagatacaaattctgacaaattgcccaatctgtaaacataataaaagtctattctctctaagttatgaagacaacaaaaacactcgatttttacgaatatttttaaagttcaaaacttagattttcaatagaccttacctcgttcatttatttaagacaattatagcacaaaataaaatgaaccgtcaagataaaaacttgacagttcatttttagattaatggaattgcattcctccatcaacaataattgtttgaccagtaatatagtttgaatcagggccagctaagaatgaaacaacatttgccacatcttcaggctcagataaacgtttcatggcaatatcttttgcgaaagtttgcattccccattcatcatctttaccagcatttttaccaacttgatgcgcaatatcaaacatcattggtgtttttacaatccctggtgcataagcattaactgtgattccttcttctgctaaatcacgagcagcaatttgagtcatcccacgaacagcaaattttgaagaagaatagagcattagatttggatttccaacaactccagcttgtgaggttgcgttgataattttacctccatgacctaattttctaaaaagtgctgttgctgtttgtgtcccccacaaaactccaccaacattaatattatagacctgatgaaattgttcaggtgtaattgtttcaattggtgttgttggggcaattccggcattattaactacaacatttaaatcaccaaatttgtcgacaacagcattcaaagctgaaataacttgttcacggtcggaaacatcagctttaaccgcaaatgagttttctccaagctcttttgctgctttttgagctgtttcttcgttgtaatcaataatagctactttaaaaccatcattatacagacgttttgcgattgcaaaaccgattccttgacctgctccagtaactgctgcaattttagacatcttatttctcctttatttatttattttatagacctttaccagtgggtgaaactaaaattttaacagctgtttcattatgatgaatcagcgtatcaaatcctttatcaatcaaatcatccaaaccgattttagctgtgatgaattggtccaattttattttacctgttgatactaaatcaattgtttttggatgagtgttattataagcaatcgttcctaaaaggttagcttctttgattactaattttgccatatcaacactagcaggcttgccccaaattgcaacaatgacaactgttccacaaattccacaccaagccacatcaatgccaacttggccagcttttattattggttcattaatttcatcaacgcggatatccccgcggtcgtaaaaacgtgctgcgcgcataaaaacgcctcctctatataggatggttgtcgtttcaggcaatcaattaaatttagtatttgagatttctctcacaaatttattctatcattaattctaataatttacaaaaatttaaagcgttttctcccttgatatatatagacttttaaatgttttatcgtaataaaaaagctactgaattttctgtcagtaacttttactttttgtattcttattaattgttaacgtctatttcttcgacgattttttcgactatcacctttaactgggatttgtctttgttccttgacaaattctggtaattgattatatttcattgataaaacaagccctaagccaatgatatttgccattaaggccgatcctccttgagaaatgaagggtaagggaatacctgttaaaggaacaacaccaatagctgctccaatattttcaaagacatggaagagaatcatcataataatacccgttgaaatataggtataaaactgattatttgatttgaaagttactcgaatcattcgataaatcagcataaagtaaaggaaaatcaaaaaggctgatccaacaaatccaaaatcttcagcaatgacagtgaaaatcatatctgattctcgaacgggaacattgacattagctacaccaactcctttaccccaaagaccaccaacaccaactgaaatcaatgagcgtgcttgttgaagactgaaagtttgagaatattcaaaaggatgtaaccatgcgataaaacgattgacctgatactgagcaaaactggtactttcaagaaatttttgtccctctggtgaagcaactagagcaacaattcctccagctactgctgctacgaaaagaaaagctggcgcaagtattttccaagaaataccagcaactaaaataattccagcaaagatagctgcaaagaccaagaaagttccgaagtctttttgaaagactgataaaatggcaactggaattgtttcaagtatcagaagtccgattaagcggaaatcatctttgagcactcgtttttttagattattttggaaggtaaccacaatcctagccgaaaataaaatataggaaagtttcataaactccgacggttgaaaaagatttcgtcctccaaaagcgagccagttttttgcacctgttgaagcataggttgctttatcgtagaaaaagatcggtagaaccattaatataagacctaataggtaaaaaaatggtgttaagttccataaaaaccttgaatccatatgcatgacaattaaagcaacaaagagtccgacaataacccaagttccttgttgaacaactagattcgttgcttgtgtggggtggtcatgacttactgcaacataaagtgcgtaaagaccaatcaatattaacataaaggctggtaaaattagcccataatcaattcgtgaatcaaatgtaaatctatttgctttcttgtttttcaaaactagctccagtcagtttaatcttgttttggcaattcatttggggcaatttgctatcacctagttctaacttttgcttcaaatttacaaaaacaattttattattgaggtgacttctgtttaaaatcataaatccattctattatacaatttttttggatgaattgggcattctttctcaaaaattccaataaaaaaacactgaaagcactttcagcattttataaaatgtgaccaagaagatctcctccaaaaatcaaaagataagaatagaggagaattggcaatggtttacataataagatactccaagtgaagaatttccaactcatttttgtttgacttgctattaaaacaagggcatcatctggggcaataggagataaaatgaggagcgcgaaaacaatattaaagcgtttttgccccttatccaaccaagccatgtatttattatatgttttttctttgacaaaagttttggctaatgaagaaccatattttttaccaaagtgaaaaagtaaaaaagagcccgcaacaattccaaagtaattataaataaaaccccaaactggtccaaaaatcatgacccctgctgccattgtaatcccacctggtatgattggaacaatgacttgcaaaatttgcatacaaaggaagattaatggtcctaaaaaacgatgtgccacaatcaattgttgtaagaccgcttgattttgaaatgcaccaaggcgccataaataaatgccaccaacaattgtcgcaacaaagccaagaatagtaattaaattaaaaactcgtttgatatatcttaatacgttatcattcaaagaaaatcctcactttgggcattttttttggctttaaggtaggcttcattttcttcaatccaacctggcaaataattagcaagggttttaaagccaattttatcccgagaatcagtaaaatgtttttttcggtaaatatggtgaacttgcggatttttttccagactgcgaattgacaggctaattttgccattatattcgtcaatatcaataatttgtgccatcactttgtggccaattttagcaatatcatgaatacttttgacataaccagattgaatttcagaaatatgaatcaatcctttttgttcaattttttctttattcgatgaattatccaggtaaaattttacaaatgcaccataatcttgcattccaataatttcaacctcaacaatatcaccgattttaggacttttcttttccatattatggctcgataatctcaactgattcaataacgacatcatcgactggtttatcttgcgcacctacatgaacagctgcaatttcatcgagtactttatagctttcttcatcaaccaattgaccaaagacagtgtgacggccatcaagatgaggagttccgccgccagtatatgtttcagctacttcttcaggccaccctccttggataagtgaatctttaggataaggcaagtttttattttgaacaatgaaaaattgacttccgtttgtattaggtccagcattggccattgacaaagctccccgaagattaaagaggtccattgagaactcatcttcaaatttttctccgtagattgaagaacctcccataccagttcctgttgggtctcctccttgaaccatgaaatctttgatgatacggtggaaaattactccatcataatacccctctttgctaagttcaataaagttttttacggtttttggagcaagactatcaaataattttacagtcatttttccatgatttgtattgataattgctgtagtacctttgtagttttcaagttcaagttgtgggtaagtcatattttttagttagtatttttatttctaaaaataccttcctttctttttataaattaataaatttctgtcagtaatttttactgacagtttttactgatagctttaatcaataatttttaaggcttgtaaggcttttagaattccatcattttcaacagaatcagtaatgtaatccgctttttctaaaatttcaggatgtgaaaccttcatagctactgacagaccggcaaaatcaaagagttcacggtcattaagtccatcaccaaagttcatcatgttctcagctttcagaccaagttcttgtaaaactttttgacagccgattgctttagaaccttccattggaacaatatctgaactgtttggatgccaacgaaccaaacgaattttatcggataaagcttctggtaattctaattggtcatcatggtcagaaattgtcaacatttgataaatttcatttgttttataataattgggattttcttccaattccgaataaactggaccaatagcatcactagcaactttatcccatttggaaatccgtaaactgtcggaaccaacgaaggtatatccgcttttctcagcttttaaccagctaatgatttcttcaaccaactccttagaaaatgtatttttatataatacctctcctgtttgtccattttcaacataggcaccattgattgctacatagaaatctggttttaatgctcgaacttctggaacaacaccgaaaagatttcttcccgttgcaattcctgtcataatccctttttcacgaagtttatgaaagacttcagtgattgattcaggcataaaagctgaatctttgaccctcaaagtatcatcaatatcaaaaaaaatgatttttatttttggggttttttctaatattttttccatctttttttcactttaattttatttgtacaaacttaattatatcatatttctaacttgtttttcctcaggtttaaactaagtgatgttgaatggcataaattgttgcttgagttcggtctgacacttcaagcttattaaaaatattagaaacatgagttttgactgtttttaaactgataaaaagttcgtcagcaatttcttgattagaaagtcccgtcgcaagtacttttaatacttctaattctctttttgataaatcatcatataattcatgttttcgatgtttttgttgagcaatcttttccttgacagcatcggaaaggacatcttctccattggcaacttttctgattgcagatgcgatatcagcagcttgtgatgttttaagaatataacctttagctccagcagctaaagccggaaaaactttttcgtcatcaataaagctcgttagaattaaaatttttcgttctggatttttggctaaaatcttttgcgttgctccaattccatcaagtcgatccatcactaaatccatgagaataacatcagggtcaagcatttcagtttttaaaaatcctgactcgccatcagcagcttcaccaaccacttcgatatcgggttgaatattcatgaaacttgataaacctagtcgcaccatctggtggtcatcaacaattaaaagtttaattttttccattttgttctttctaaatactcatcatttttaaaggctcggcttcgctttagggataatgatttcaacagttgtccccgcacctggtgccgaggttactttggcatctccaccaattaataaagcacgctctttgatattggctaaaccgtaactggccgtcttatcactagtagaaacatcaaaaccgactccatcatcagcaatttttaagaaaatatttccaagtgattctcttaaagaaacttcaatgtgttcggcttgcgaatgacgcaaagtattcgataaaatctcttgagccattcgaaataaattgtcctcaacattactcgttgcttcaatgtcagccaatttaaccgtaatatttgctgatattttcgcttgaagttcgtctgtcagtgctgacagcccttctgctagactcttaccatctaattctactggtctaagatgtagtaagagcgctcgcatttcattttgtgcagaatggagcacttttaaaaccaattgtgcctgtgtttcgatttgttctttagtcaaattttgtgtcgaaccagcaacagaagataaaatcattgtcgctgcaaaaagttcttgactgacagaatcatgaagttcccgtgaaattcttttacgctctaattcaataatttcagctttgtcagcagatttttgcttagataattcttggagttcagctgacatattcataattttatcatgaacagcttgtaattcaggagattcaggttgttgattttcttctaaaagtttaatatcatcttgaaatttttgttgaatagccatattttcaatatgattaaaaagggtaaaaatcagcgcaagtaatcctgcaactgatataaatatccataaaccatagaaattatctcgaagttccctaataatattagcggtatttagtccccctaaaggttgaccactattcatcattataaatagaagaagatacataataaggatgatactaaaaactgctaaaaaggttgtgaaaagtgattttttcatcctctaatcacctcaatatttcctgaatcaacacggatattaattttaattcgtttttccgcctgatctaaattttcactaaaataacgaacatttcccgcattaatttgtgctgcctcattgaaaatctttacaagcccagcatttgttgttaaatcaagcgaaactcctacgtcctcaggaacaataatttttgtattacctgtcatttttttaatagaaagactatttccagaaggtttaaaagtaacatcatcaagatcaatgatatcattttgattttcattcatgattgactcagattcatcttgagaaatatcttcgtaagaaaaatttcttactcctccttctcgtggattatttttccaaaaaacgatgcaagcaatcgtagggaagataattgctaaccagaaccatccaactgtgaagagaatcattaccgatattgcccaaaaaatgaaacttatgatacgtaatacacgcgcacgcgaacgagtcgccaagatagtaaagagaatagctaaagctagaactacccacatacgcggtgtactaatcacatgaaaaatcaatcctaatacaataaaaatttctataataaagattgctttcaattttttattcataaatctattgtaccaaaaaaaagcttactttttctcggacttaagacttaaattttacttaagcaaaatagagaaaaaatactccattcattaagatgaagtattctttaaattacttaataaaaaaatttttatcatatcccataagattgttcaaaaagatttctaccagcttgacttcttaactcctggaatcttaccttcatgcgccaattttctaaaattaactcgtgacataccaaattttcgcatgtaggctctgggtcttccgtcaattcgatctcgcattttcattcgattggggtgagaatctttaggcagttttctgagagcttcataatttttttccttcttaagtttctgtctaagctcttgatattgagcaactaatttttgttgctttttaaatttagcaatttttgatttcttcgccaaaatattatcctttcatttattaatttagttaaccagttaagtatatatcataaataaaacaatgtcaactggttaacattattttattttctctattttaattagcgactaaagctcctccttgacttgaaacatagtcttgggcattctccttatttatttttactagactccctttagtatccactccataagtttcacttttttcacctttgatagttaccgtcgcagaaggcatataatattggtcagtttgacttccaaaatagttttcataagtaatgacactttgatcaagcttatcagtgacagactcatcatttgcttgtctcattatattttgaatagccaaatccacattttttggtatgaattcataacttccaccatccaccatttgacttaccccttgatattgaacagaaactactttgttaagacaatctttataagccataagtgcggtcaaattagcaagatttattgaaatgttcgttttaaaatctgatgaaatatcatttaaaaatgattgatatttaaaaacactattaagactaagcatcttgttcattaattcagtcataacttctcgttgatgagcggcgcgtccataattcccattagctaacgtatctctatctcgggcaaaaactaaagcttgttctccgttgatgagctgcttaggatttcctgaaagataaggaacataagctttatattcaggttctgtatttgagatataaatcgctccactatctacaattttatctgaaccaggcaaagttattttacctgaatcagtcccttgatagacatctgagccattagtatcattaacaacttctactcctccaacgtcattcacaagatttactaaaccgtccatattaacaatcataaaattattaagattaagccctacttgactaccaatcgttttcatggcataagtgacagcagatgataacccaccattattaaatcctaaaggataagcagcattcattttttgagtagattgaatttttccagatgcatcttcaatattcgtcatcgtatctcgttccactgaaataatagtggttgcttttgtccgaggattcaatgttaaaataatttgagaatctgaatttccattccatgaatctgccccacctcgactattatcaccagtatccactcccataagcaatatagttagtggtttttttgcagatatactagaactttttatttttgtatttacatgagttttcgttaatgttttctctgcttgaacatagataaccgcactaactgccacgactaaaataacaaaaagggacataaaacgaacaaaatatacctttttagacctttttatttttttcttttgtctaatttcttttcttttcatatcaagaatacttctttcttttgttaaaaattataacttacttaaactctttaatttttcgtcagccgagctattcaaaaccagtcctactgccaaagttgaaattaaaaatgatgatccaccttgtgataaaaagggaaaggtgacacctgtttctggaaccaaaccaattgctccacctaaattgacaaaaacttgtatcagcaaaaaagatgaacaaccaattgaaatcattgaattaaatggatcttttgcccgcatccccaccaaaagcattcgggtaatcatgaaaaaaatgacagctaggattataattccaccaatgattcccaattcttctactattactgagaatataaaatctgtatgagcttcaggcaaaaatccttgtttttcaatcgaattccccagtcctcttccaaaccagccaccatctacaatcgcataatatgaattagcaagttgatgacccgaagaagccaaatcagtaaaaggattaacgaatgctttaaatcgagcattaatataagatcctggaatcaaatcgcctccactgataaaaagaaagagcaaaaaactaagactaatcgtaagcaacatcttcccataacctgaaaaccatcgccaagaaattccacttgcaccaatcattatcaaggctaagagcccaataattgctgtatttcctaaattaggcatactgagttccactatcattagtaagataatcggaaatcgccatccccctacaactttttttatgagattgttacccttaaaaattgcttgaatatcatttttctcaatctcttcttgtctgttagaaaagatagaagcaagaaaccaaactgtaaaaagttttgcaaattcaaccggctgaatagttccaatccctggtaagggaatccatccatgcgctccattcgctgatgtattaggacccacccttgaataaatcatcagcaagataataattagaaaaattatttttaaaatcttttcattttttataattcttaattttactcgataagtaataattaaagccacaaaacttataattataaagactccttgagaaattgccaatcgataaggagatagtcctcggttaatttgataggggacagttgctgaaaacaccatgagtaagccaacagctgaaagaatcaaataaggaatcaaaatagataaatctaaaaaactattttttgtaatttttttatccataaatgaatcccccttcgttaattttccaaatgaacgacaagagtatttctagttgcaaatcaatgaataactttttcttccttatttttttattttttattgttgtatgaattaatatttttgtcatcggcttgtacctcaatttctgatttatagtagattttgattgtacagctccaactcagagaactagattagattgaagtgataaaaatgcttgtccacttttatgctatctttcttcctatagctctcagggtctgagccactgttattctgtgcttccattttcaccacctacttttttataaaaaaattgcctacgtcggttgaacgtagacaaggtatgatttcaaaaagatacactatcaagtgaactaaagtacccagtatcgttcaagctttagctccgcagggcgatgttgttgcactatttcacgccttcttttttcgacgtgaactgttggccctctcatcgtgtctccacgactctgcggcagcaacccgtatccctgtggtagcctcacctaccgatggttagaaaatctctaaccaaaattgcttaaattaaattttcaaaatatttcctaagcaaaaaaattataacacgacctatacttttagtcaaataacaaatgcattacctaaattaaatgtttttttattggtttaaacctcttgttatgactaagtttttagaaattagaactaataaaaaaatattattttttaaaataaaataccaaagattaaaatatacagacaaaaattataattgaacaatgaatttcgttaataaataaaaaactccctagtcaatgctgactaaggagtcttttattatatttatcgaattcccaaagcaatacgggcataacgactcattttatcaactgtccatgctggataccaaaccaagttcaccttgatttcaccaacttctggcacttctttcaaagcatcatgaatttgttcagtcaaaaggtccgccaaagggcaacccattgttgtcaatgtcattttaatttctgtaaatccgttatcttcaaagctaatttcataaactaatccgaggttgataatatcaatcccaagctctgggtcaatgacgttttcaagggcagagagaattttgtccttgatttcattcacttgctcttctgtgtatttatctgccattttatctccttaggctgtcataaaaagcaaaactttaaaagttgaacgaatgtgctttctaggacaaatccaaattgtcaaattctttttacagctttattttaccaaatttattttaaaatttctagataaaaaattactgacagaaaaaatttattcataaaattttctgtcagtaatttattttatgcaaaacgcgagaatttcttgaagaaactcaacatgaaagtaaagagagcgataataaccacaaataggattgcttctggtaaaattgctccattcaaaccaatggtttcgcgtaacatttttaaaccataagtcattggtaaccaaggactgatgacttgatatattttaggcgcaagttgtaaggggtaagttcctgcactcgtcgccagttgtagaactaagactacaatcataaggaattcaccaatcttacctagagccgttaagaagaaagtattgattgccatgtaagcgaagctaattaaaagtactgacaacaacatttcccacaaatgatttggtctcaatccaagaagagcaactgctccccagacgatgattccttgtaaaagtgctaccaaaccatttgtaccaattttcgccaacataaattcgcgaccagatttccatttttcacctgagaaaccaattccaatcacaacatttgtcgcaagggcaccaataaagagagcaacattaatcatgtatggtgtcattcctgcaccattttctggtacattgtcatgatcagtatgtttaagtttcaacggtgcagctacttttttagcattttcattagaattattagttgctgagagagtatcatctgctttggttaacgctgttgacaagttattagcccctgtatttagcgttcccaaaccacttgttaaacttgaacctccatttgccaattgttgtgaaccagaggaaatttgttgagcgccccctgccaattgatttgaacctgaagttaaagttgaaccattcgcttgtaattgtgacaatccagaaactaattgcattgtcccgctttgtaaatcttttgatttacttgctaattgttgagcgccagcgtttgcttgattaactccgtcagcatattgggcaaaaccaggtgtgacttgatttgctagggcactatttacgtcagaaagccctgttgacaattgtgaaattatggcatttgcaccaggaagagcaacattagaattttgggcaagttctttggtttgattttgaattcccatcaattgattgcccacatcagttaaactatccgcaactgaagtcatacttgtttgaataggagataaagttgactgagcagagtttaaaatagctgcatttagttcgttttgttggtcagttttcaaactattataagcctttgtttgagccatcgctttgatttgattaggaacaatatcacttaatatcgtttgcgtatcttctaaactttttttcacagaagctaaatcatttttcacggaatctgctgaacccgtatctttagcaccattttggatagcattatttaaatcagtcaggccattttgaagctggctaatttgagcttgttgctctgctgacaaagctgttttttgtgtcaactctgttaaacctgctgacagctcttttgatttatcagccagcgtttgtgtacctgctgctaattgttgcgttccactgacaaattggtcagcaccagaagaaagttgttgtcccccattggcagcctgattcactcctgatacatatttatttaagcctgaattcaaattatttgcgccgtcagtaaaagttaaacttgatgaagataaagtattcaaattactacttaattcttttgaaccatccaatgctgaagaagttccatcagccaatttatttgaaccgtcagaagcttctttcattcctgacttcatatcaccaagcttagcaaaaatttctttggtgtaagtttctgtgatatttttagaaacctctgatttcagctgattcatcgcactttcgctcatttttgatgaaatatagttatgaccacgtgttgtttgataatctaactggaccgttttgggtttcttattcattaaagtcgttgcattttctgaaaagttttctggaaaagtgataaccatgtaataatcacctttttttatccctttagaagctttatcctctgaaacaaaatgataatctaaatcctttgattttttcatttcggcaatgacatcatcaccaagtttgaattttttaccgttcaattcagacgtcttgtctaaatttacaactgctaccggtaagtcattaagtttaccataagggtcccacatagaacctaagaaaatatagttataaattgctggtacaagtgcaatgcgataataacaataataaaaaatttgtgctttaaaatggcttgccattctttttttaacatcttttcccctttctttatggacaacacgtccaaaaactgttacaatacgtattataaactttttagaaaatttgacaattattatccattcagttttggacacatctttaaatttgtctaaataaagcacttacattctaaaaaggacggaggtccccctataatgtccaatgacagcagaaaagatcgtacaaaacttcaattacgagatgccatgattcaacttttaggcgagaaatcttttgaccaaatttcaacgactgaacttgtgaaattagctaaagttagtcgtagtagtttttatactcattatcaagataaatatgacatgattgaagcctatcaacgtcgactttttgagactattcaatatgtctttgaaaaaaataacggaaatattcatgcaacgatgcttgaaacttttgaatttctaaaaggaaatcaaatatatgccgctcttctttcggaaaatggtagcaaagaaatccaccagtttatgttgcaaaaactcaaagaacttattcaaagttcctttttccctcaatctaaacatcttaaattaggaaaattaggggaaatttatgcgacaacctactatgctaatgctatttttggaactactcaatcatggattcgccgaaaacaaaaggaaacacctactcaaattgctaatctattagttgagctcataaattaaaaaaaaacggttcttttagaagaatcgttttttatcattctatttggaaaataatagccattaacaggtgttaatcatgatgctgaacttccaaaatcatattgctcaatgtttcaatcaccatatcttcatcagatagttcttgtttcgtagccaattttaaagcttttccagctctaaataccggaatattttgttcgcctactaaaattttttctcttgaatgaacatcatgactgactctggctgcacgtttacgaacttcaaaagttccaaaatttgaaatatgcacgggagtcccttcagaaatatagtaagtgattgcctcgacaaaggcattgattgcctttgctgcattcacttttgaaagttctgtacggtctgctacataatcaattaactcctgtttcgacgccattaactcattcctcctattctctacattcccctatcatccttttcttcactaactctagtgaattcttttgtcatcatataaatcttcataaaaaatcctagcttacgccaagattttttggttattttacaaccataacattgcaaggcgcatgattaacaacataacttgtcgtcgaaccgactaacatcctgtctaataatcccttaccatttgaaccgactacaatcaaatccaattcaaattgctttgcaaaattaatgatttctttctttggatttcctgtaaaggcatggacttcaaattcaacttcatcattaatcagagcctcaacttcagcaataatttctttagattctgtttctaaatcatccaaattaattgccaaagcataaggagttccccgaagtcttgtttcatctttaacatgtaaaacaaataatgaagttttatttcttttggcaatggcgactgcttcgtgaattgcttctttcgattggtcagagccatcaactgcaactaaaattttcttgtattcatctctcattgtaaacgcctcctttactatattctatgataaaatatttaagaagtccaactaaacactcactatatttttagaagaaacttttatttttaagacttcttttccaattttacttagaagtaaaaatataattttatgaaaatattaaatcactttttttgatattctgatttctttatgctacaatttagttggaattttgttatgaaccaatttggttccctttcgtataataaataaagaaaggagaatgtactatgacattcactaacaaaaacaaatttttccaatatacagtaactctagatacttctcataatatctttagagcatcacttgtaaatgattcaaatatttatggtgctggagatactattgaagaagctgtacaaaacttagaacaattagtttaaggagaaaaaaatgggcgagtatcccaatcgataaaggcatctactttaattttgagagtaggtgcttttgttatactttaaataaaaaaaagttgctcaatgagcaactccctttttagtttctctcagttactacttctccacttgccttcttgtcattcttccaaatagaaaagaattttccatataaagaagtaaccaaatagaaagtaatagttagaagcattgctaaggaacttgcagaatagccatccataagtgctgttgcccataaaataatcatgaccacatcagataagagccaaagtgagtaactatccccataacctctaacaaccaagattgaagccgcagctccaataattaaagtaatagcatcccataaaggattggtgtctccaagttttgtataaatggttgtaatcggccaccaaagaaccaacatactgatgattgtcaaaatccatccttttgtcttcatgaatttgaccccattttcaattcgatgtccccaagttttccaagtgaaaatcaatggcaagtcaatcagcaaaacaaaaacaatttgatctaaaacagaggcatagtgaccagcagtccagttaatatagatataaccaaaagcactaatcagtcccaaaagaccattaattggttttccaatcatcatgtaaactgtacatgccgaccccattaaggtagcaatcaaagtgattactgataaaaccgtaattgttgacgttaaaaagaaagccaactgtactcctatgataaacgaaagcatgatacttccggctgtattaattgattttagctcatctttgagccatttgagataatttttcattctcatccccaatctaagaacgtcaaaaaacgtccactaaaaattatatcacgaataaaaaattgtcagacgcttccaaatatattctttagatttttttgagaccaaccattaccaattttgttccataaaaattttatttatctctaataaagttgcataaataaaaaaagccgaaattcgtcggccttttcgtttctatttatcccatctgtaatagtgaatcattttgatgaacccaacaattaaaaattcgattccaagaagtaaccacaaagttacccctccccaaagtggagaaaatactaaagtaaaaccagcaatgatactaattacacttaagaaaatcccccagaatttactattgaaattagtcaaaactgtaagagttacaattccatctacaatccaactaatccccacaaaaataccaataaggacaaaaagtgattctgcggctgcattcaaatctgaaaagacaaaaattcctgcaaataagtagataaatcccaacaagagatgggaaattctccagaaatttcctttttcttcacttcttttgactagatttgctccaatataaatgacacccataattacgagtgctacccctacaagagctgcgacaatagctgctgtttttgtaggtaagaataatatcaataaaccaataataattgaaattattccactaaatccgactccgcgtcgaagtttttcaaaatctgttaacataactttacctccaaaaaatattcttcaattctcatttaattataacataatgaatacagtatcttgtccttgatgattaaaaaattacgcttccttatctttaagcaagttattatttttattattagtcttcttaaaaaattaattcaaaaaaaggagtacttaaactcctcaaaaattttcaaatgataagatataaaatcaaatttttattgttagtaatttcaattatcttttttatttgtcacttttatccctttacgctccggacttttccatgttccagaccccaaacctagaatagtttttactgctggaacaaaagtcgttacaatggttaatgcattcattacccagtaaaaaagcatataaagtggagcaaataatagatattttacttttcttccacggtcatcaactattaatgaagcgactaattgaaaagtccccgaaatcatttcaaagcaaacaaagagaaaggccatcgttaacatgtgataaattcgttctaagtttccggtaatggtaaattgaaataaagaccagataaaaattgctgacgaaatccagaaaaagaatgaccagataatgctgaaactttggtcaataaacataattgttcggccaacattgtcaaaagggtgtaaaaatacttttttaaaattagtcagccaaacctctgttccacctttggcccaccgtttcctttgacgatagagcattttcagagattctggaacctccataaagaacataatacggggcgcgaacaatgataaccaaccgtccatttgatggtcccaagcaatactaatatcttctgtggctctatcttgtcgaaacaaacctacatcaattaaggcatcttttcgatacatcgtatttgcaccactataggcataaatactccctagcacaccaagttgagtccgtttaataattcctacaatactagaaaattcaactgtttgagatttcgcaattaattttgcacgattctgaacatccatgttagctgttactgctgagatgttagtagaatcttgtcgaataaaataattgatatagcgatttaaagagtcaggttctggaacagtatctgcatcgttgcttaaaactagttctccttttgcaaatcctaaaccaatattaaaggcatgcgcttttcctttatttttttcaattctaatcacgcgcaatttatcatatttttcttgtaattcttttaaaatttcgggggttcggtcagttgaaccatcatcagtaactagaacctcataattttcataattaatttttgtcattaaataagataattctcccaagtgggagtttttggataatacccggggtggcggaactggcagacgcacaggacttaaaatcctgcgaggggtaaccttcgtaccggttcgaaaccggtcctcgggatatgctaagattaatagttattaaactattaatctttttttatctttctttaaaaatggcttaataaagcggttactttgtatttttgtgagcttggactagaaaaatacttcacaaaatgctatactaggtaggtaataaaatattcggaggaattttgaaatggcaatcgtttcagcagaaaaattcgtacaagccgctcgtgataacggatacgctatcggtggtttcaacacaaacaaccttgaatggactcaagctatcttgcgtgcagcagaagctaaaaagactccagtattgatccaaacttctatgggtgcggctaaatacatgggtggttacaaaatgtgtaaactcctcattgaaactcttgtagaatcaatgggaatcacagttccagttgctattcaccttgaccacggtcattttgatgatgctttggaatgtatcgaagttggttactcatcattgatgtttgacggttcacatcttccaatcgaagaaaaccttaaacttgctgaagaagtaatcgctaaagctcatgctaaaggcatctcagttgaatgtgaagttggttcaattggtggtgaagaagacggtatcgttggtgaaggtgaacttgctcctatcgatgatgcagttgcaatggctaaacttggtgttgacttccttgcagcaggtatcggtaacattcacggtccttacccagaaaactggaaaggtcttcacatcgatcaccttgaaaaattgaacaaagcactcgttgaagctatgggacacaatgtgccaatcgtacttcacggtggttctggtatccctgatgatcaaatcagagaagctatcgctaatggtgtagctaaagttaacgttaatactgaatgccaacttgctttcgcagctgctactcgtaaattcgttaatgaatttgatgctaatgaagcagaatacatgaagaaaaaacttttcgacccacgtaaattcttgaaacctggtttcgatgcaattacagcgtctgttgaagaacgtatcgacgtattcggttcagcaaataaagcttaatcaactttttaaacatgattaaataaacgtttgtcatttatgatggacgtttttttatttttcaatttgctttgatatagcataaggttctatcttagtatataagtttaataagtattttcaattttatcgattatgtgctatttaaaaagtttatctggttgtcggaaatctatcattgcttacagaatgatgaaagaaaatttgactttaacaaattggcacattgaattcctgattgcgccagaagaatgcttgccttgcaattaaaaaattttatcgattcagataattataaggaagataatttatgaatatatataaatatcatacttttatgatattttttagcaaaattttgtctactttacgaagaatctggtataagctttattgattgaccaattatccagctaaagagtgtactctagtaattccttcattaattgttcttaggatatttgaaatttctacattagaaggcatttgagagggaataaaaaaataaatataagaatctattttatgcgaatgctacctttttaaaagattacctagctgaggctaagaagagttgtgaaatatgagcggacgatgtataagttttttgactgaatttaatttttctacattattaaatttgtaataaatatgttattttttagtaatttcacttagaaatgtaagataaagagaacagaatattttttagggacgatagtaatcatttgttttagagagagtattggttatttcaactaagtcataagcaacttattataaaatatgattaaatatggctttgtcacttatgatggacatttttttatatgattttgctactagctatatcgtataataattttttcaaaaaaaaatggaaatctgttcaataaataaaagtgattaatttgacttgcttgtgtttaaatgttacaattgtgtaaaagtagatgtcttgaaagaaatgatgttgaaattataatacataccatggaggattaactaaaattgactaataatgataaaactaagcgcttaaaaaaggaaaaatttattgcgggaacagcgctgattttaggaatgacggcttttggcgtgactggccatgctgatggagtaactgttggaagtagttcagatgcttcgtctgcaattacaaatagttcagatgcatcatcaagtacgggtagttcaagttcatcatcaggtacaggtggttcaagttcatcatcaagtacaggtagctcaagctcatcatcaaattcaaatggttcaagttcatcgtcaagtacaggtaattcaagttcatcatcaaaaccaagtacttcaggttcgacatcaaaaccaagtaatccaagttcatcaacaaataataattcaactagtaattcctctacgacaactcaagcaccatcaacttcagtttctaccacagctccttcagcatcaacttctacagctgcaccctctaattattcacaggataatgcctactatcagacatcaactgcagcacaaattcctaattcttcagcagattcagctccttctatttacgctggccctgttttgaaaacaattgaagcagctaagtcaattgataaaattgatacttctagtacagaaccctttattaaaagtattgcggaccgcgtgagaattttagccggtaagaataatttgtatgcatcaattatcttggcacaggcgattttagaatctggttctggtcaaagtaatatgagtcagcagtattttaatattttcaatattacaggtgcttatttaggaaaatcaatttcatttaagacggaagaattttcgggaaataatccttattatattgaacaaagttttagagtttatagtaactatgaccaagccttggatgattatattaatttaatgattaaagggacaacttggaactcagaaatttatgctggcgcatggaagtcacacgctaaggcttatcaagaagcagctcaagctttgcaaggtatttttgctactgacccgtcatatgctcaaaaattgattgaaattattcaagaatataacttaaatttttatgacaatgtagatagtacgacaaaagttgtagatgataaagttcctgaaagtccactggtggcatcaaaattagataattcagcttatccagattacaatggtgtggaatatccaggtgctgatagctatgcttttggtaattgtacacagtatgtttataaccgtatcattcaattaggtgggctcgttggaacacatatgggaaatggtggagaatggggaattaatgcccaagctcaaggttatttcacaacaacagttccaactgagggttatgctgttagcttcccaccaggagtagctggttcaagttcagaatatggtcacgtagcttttgttgaaaaggtttattcagataactctattctcgtttcagagatgaatgttaaaggtaataatattgtcagcgaacgccatatttctgctggtgtagctgctttggcaacttatattcaacctaaataattactgacaaaattaattagtggttctgtcagtaaaataggagtattgaatcttttatttagttaaaaaaagaagatgttaaaaatcagcccaaaggctgatttttatttggtaaaagtttgagataataaatgtacgagataaagataatctcaataaaaaaagtttttaagatattgaatgcttgaatgagcagagaaaggatctaaaaaaatggctaataaaaaagatagaattatggatttgatgcgtcgtggaattatcacggaagatgaagctttagaattacttgaaaaaaatggttcagtgaatggagaagcttctgatgataaaaccgagaacaaagaattcacatatacagataaagaaggatatgtgaatcacgatgtagattttcctgatgcaatgaaaaatgttgcagaaagtttgtttgctagaggtaaagaaattttccaaggggttgcaaaatctgttgatgataatattgatttttcaaaaggatttcctaaggttaaatcaatttctcacactgtagaaaaagatatcaacgaagatttcaaaaatgttaatcttaatcttaagagtggtaaagtaaatattttaccgggtgaaaatgcccatgtaaaagtagaatataaaatttacggggcagttgaagatggtaatgtagaagcttacattgctgaaaaaactaaacttgaagttgaagatgatgtgcttgaaattgaagcaaatggtcgaatttctgcgaatattgaactttacttaccagtaaaagaatatgaaaatattgagattaatacacctcatgcagaacttaaagttgaaaaaatttccagtcaaaaaatgaatattaatcttatgaacggaaatgctgaagtgcttgaagtaaacagcgatgagttgaagattaacaataagaatggtgaaatcaaagtaattgatggcacgaattcagatttagaattaactggagttaatggtaatatcagaattacaactgcttttgaatctggtgatgtctcactcgtaaacggaaatattttgctgaccgaaaaaacaggaacggctcacaaattaaatcttaaaaatgtgaatggcgatatcaaagtttctgtaccagaaagtttgggcttggttggtcatgttcgcacaatctttggcggatataagacacgtttaaatcttgatagtccttttgaagctggccgtaatggagcagcgattgtccgtcaaggtgctgagtcattaacctttgaatttgaaacaaaatcaggaacgatttggcttaaagatactgaaactactgacaaagaagaaactgaataaaattttactgacaggaattttataagagttctgtcagtaaatttgaaaagaaaggtgagaaatggctaagaaaactctgaaaagatcaagtagcaatcgagtcatcgcaggaaccgtcgggggacttggtgaatactttggcttgagccgtacagtaattaatgtaattcgggttctgattgtgcttggtactttcggaagttggggaacattactcattgtttatgtgattgcgagtctattgatgacaccgtcacaaggttaattcaacgattataaagaaaggataaattatgtctcaaagacaattaacaaaatcagtgacaaatcgtagagtcagtggtgtcattgcagggattgcagaatattttggtctgggtcgtgatgttgtgacgattctacgtatcctatttgttgttctggcttttggaagctggggcggattgattccattgtatttcgtagcaagttggattattccaagtgctagaccacgaaattactatgatgattcagaagatgattatcaagaaaaatggaatcgtaaagcgcaacattttgatgaaaaaatggaccgttggtcagaacgttattcagataaaatgaataattgggcacgtcgttatgaagataaaggacgtcaaaatcaacaagattcaaaccaatggggaaatccatgggatgaaccaaaaagtcgtaagactaaggaagcacaaccagttgaaaaagaaaaagaagatgactggtcagatttctaaaaaagttactgacagaaagttctgtcagtaaaataattctggtccaccatgacctaaaactggcctcctatataatataataataataactgaaaaaatggactgattaagtccatttttttagtgagatttcgccactggaaagtattttttgctgaccattatctaaatttacgataagctcacctttagaggttaaatctgtggctcttccggaaaaagtttgtccagattgaacaaattcaacttgtttgccaagaataaatgagtgagatttataaatttggaaaaatgaaccctctgataaacgatgaaattcagaccagatttcggcaattaattccgaacgactgatgcttgcttgttcattataaaataaagaagtggctctttcttcgatttcagttggaaattgggaaatagaaaaattaattccgacaccaatgataacttgagcttcttgagttggattaagtgatgtttcggcaagaataccaacaaattttttatcgtctagataaatatcgttaacccatttaatttgagggtttttgtcagttaatttttcgattgctgacacaatggcagctcctgtcagcagagtgaactctggaagtttttctagttcaactttgggcttgagtgacaaactcatataaattccgccagacggcgcagcaaaatactgacggccaaaacgaccataagttttattttgtctttcagttaaataaagacaattttcttgtccgtctaatttagcatctttttgagttgattcagattcagcgacaatttttacatcagtcagccaaggatttttttgtaaaataatagatttttcaagtttgtcgttcatttttttattataccatgtgaagtcgactgtaagcgagagagaaaattaggaaattacgtttctgcacttgcgcaagttcaaagttatctattttctagagtctaggaggctgacctcacttataggcaaaatctttagcaatttactgacaatgaaaattttcagaaaaatctaacgatagtaagtatttgactttcaataatctacggagtatagttttattagaacaatgttaggaaagggaagaataacttggtatttgaaaaaacagttttgaacaaagcacttgcagttgctttcgatatccccattgcagtaacttattgggatggaaaaacagaaaagtatggtgagggagaaacgcaagttcacattacttttaataaaaaattctcatttagtgaattgagctcaatgccaaccttagtattggctgaagcttacatgaatgaagaaattgaaattgaggggagcattcaagagcttgttacatcagcatatcgtaaggctggtagctttttaacagaccaatctggttttgggaaatcaatgataaaacttttgggaaatcattctcaaaaacaatctcgtgaagatattcatagtcattatgatattggtaatgacttttataacaaatggcttgacccaacgatgacttattcatgtgcttattttgaacatgaagatatgactttggaagaagcacaaattgctaaagttcatcatattttggacaaactcgatagtaaacctgggggacgtttgcttgatattggttgtggctggggaactttgatgtttaaggctgttcaagaatatggtctttcagcagtcggagtgacactctcagaagaacagtattattatgttcgcaaaaaagcggatgatttgggactttctgataaagtgaaagtttatttggttgattatcgtgacctcaaagaagaaccttttgattacattacatctgtcggaatgtttgaacatgttgggaaagaaaatttggaaatgtatttccaaaaagtttctgattatctcaaaccaaatggtcgtgcattgattcatggtattactggacaacatcgcggtgctggtgtggatccatttattgaaaaatacattttccctggaggttatattccaaatatcgctgaaaatgttgaacatattatgactgctggtttgcaaatggatgatcttgaacctcttcgtcgtcattatcaaaaaacgcttgaaatttggaatgaaaattatctcgaagtttttgatgaagtagaaaaagaaatgggtaaaccatttgcaaggatgtggacactttatcttcaagcctgcgctgcaagttttgaagctggaaatattgatgttgttcaatatcttttgactaaaggtgcttcaggtcaaggtttgccaatgacccgcgaatacatgtttaaaaaacattaagtttgacaattgataagttgaaaaacaagaccattcagcatttcgggtttgaattatcataaggacaacttatttaaaatttatcagtagatttattttagaatcatgtaaaggaaagagtgcattttttccgaaaaagaggtaaaataagagagttacgagtcccgaaaggatttgatttattttaaaaattactgatgaaaatactagcatatccgtaagcgctgaagcaccaatggttatcctatgaaggtttttcgtcagtaaatattagataagtttaaagacgccttgtaaccaaaatttagattgggggacatttttaatgtcagaaaaacatttatttacatcagaatcagtatcagaaggccatccagataaggttgcagaccaaatctcagatgccattcttgatgccattctcgcacaagacccacatgcacacgtcgcttgtgaaacggtcgtatatacagggacggtcaatgtctttggtgaaatttcaacatcagcttatgttgatattgctcatgtcgttcgtgaaacaatcaaaaaaattggctatacagatagcgaaaatggatttgattataaatcagtgggcgttcacgtctcacttgttgagcaatcaagcgatattgcacaaggggtaaatgaagccgaagaagttcgcgataaaaatggccaattagttgacccgcttgatttgattggtgctggtgaccaaggaatgatgttcggttttgctactaacgaaactgccgaatatatgccactcgccatctcactttcacataaattagttaaaaaattagctgatttacgtaaatcaggtgaaatttcatacttgcgtcctgatgcaaaatcacaagtaactgtagaatatgatgataatggcaaagcaaaacgcattgacacagtcgttatttctactcaacatgctgcgtcagcaacaaacgaagaaattcacgatgatgtgattaataaagtcatcaaggctgttattccagctgaacttttagatgatgaaactaaatacttcatcaatccaacaggacgttttgttattggtggtcctcaaggggattcaggcttgaccggacgtaaaattattgttgatacttatggtgggtatgctccccacggtggtggagctttctctggtaaggatgcaacaaaagttgaccgttcagcttcttacgcagcacgttatgtagccaaaaatattgtggcagctggacttgcagaaaaagcgcaaattcaactttcatacgccattggtgttgcgacaccaacatcaatcaatgttgatacttttggtacaggtaaagtctcagatgatgaacttttagcagcaattcgtaaagtatttgatcttcgcccagcaggaattattcaaatgcttgacttactccgtcctatttacggacaaacagcagcttacgggcacttcggccgtacagatgtagaattaccatgggaacaaacagataaagttgaagaacttaaatccgttttaggtaaataatcggcctcgccgaccttcgttcggtctacgtcgccattgtctcctccgctgtcctttctcgctaatgggctaaagcccaaagtcgaaaggcacttcggccgtacagatgtagaattaccatgggaacaaacagataaggttgaagagcttaaaacagctcttaaaaaataataaaaaaagcggatttccgctttttttattttcaacgagtagaattgctttaaatagaatacttaatcctgtaaaatagaagtaacaagaaaaaaggagcttttatgaaaaaaataatcactaaagattacgccacaatgagtgaacttgctgcagcgattgttcttgataagatgatgctttcaaaaagggtaaatctttcgcttacagcgggaaatacccctcttggaatgtatgaaattcttattgataaactccaaaaaatgaattttgatcgctcaaatatccattattacaattttgatgaagtaccacttgctggtgaacgctatggattaacaatgagtgctttaaagacagctttctatgatcgagtacatattgatgatggtaatcttcatgaattaaatgctcaaaataatcaagtttttgaccaaaaaatcttacaggacggtgggattgatttgattgttatggggataggagaagatggtcatttttgtgcaaatatgccaggacatacaagctttgagcgagaaatttttgctgttccatttgaagaaggggatgagatttatcagtcaatcaaaaatttgacagataaagaaccggcttctccttatgtcacttttggtccacgaacagttctagctagcaagcaacttttagtttttgctgacggaaaaaagaaagcagagattatgaaaaaagttcttgagggtccaatcacagaagaaattccagcttctattttacggacgcatccaaatattacttttattttggatgaagaagcagctgctttacttgaaaattagttgatgaagacagttagtaaaataactgtttttatttattcgtgaaggatgtcaatttatgatgacataattgactctaaattattctgaaagcgttacactatctttcattgaataatgagccttaaaatgatataataaatgagtgtttactatgtaaaatacattaatttataatcaaactgtgagtagaatttattggaattactactgactttagaggagactaatggacattatttctatcgttctcttggtcttattggttgtattagttgtcgcatttattttttacgctcaaaatataaagaaaaataagcaggatgctgaatctctttttaatgaagctgaaaataaagcaaatgaggtgatggcgaatgctaaacgtgaggcggagtctttgaaaatggaggctgaagccttcaaaaaagaagcccgttacacccttcgtgaagaagaacaaaagcaacgtcgtgaaatcgaagatgaatttaagcaagaacgtcaggagttaaaggagactgaaaagcgcctaaaacaacgtgaagaaatcttagaccgtaaggatgataccttaacgaaaaaagaagaaaacttagattctaaagagaagagcctcgttagaaaaactgatacgctcagtaagcgagaagaacaattagcgcatattgaagaaaagaaacgactagaattggagcgtatttcaaatttgagcacagatgatgctcgtgaaattattttgagtgaaactcgagatggtttgacaaaagaaatggctcaaattattcgtcaaagcgaagaaaaagctcaagttgaagcagataagcgagctaaaaatattatctcacttgctattcaacgcgtttcatctgattctgtagctgaacaaactgtttcggttgtcaatttaccagacgatggtatgaaaggtcggattatcggtcgtgaaggtcgtaatattcgtacttttgaagcgttgactgggattgatgtcatcattgatgatacgccagaagctgttgtactttcaggatttgacccaattcgtcgtgaaattgctcgtatgactcttgaacaattagttcaagacggtcgaattcatccagcgcgaattgaagagttggttgagaaaaaccgcaaagcacttgatcataaaatgcgtgaatatggtgaacaagcagcctttgaagttggggcgcataacttgcatcctgacttgatgaagattatgggacgtttgcatttccgtacttcatatggacaaaacgtacttgatcactcagtagaagttgctcatattgctggtaatttggctggtgaaatgggagaaaatgtggcacttgctaaacgtgcaggtttcttgcatgatattggtaaagcacttgaccatgaagttgagggaagccacgttgaaattggaacagaacttgcgcgtaagtacaaggaaaatccaattgtcatcaatacaattgcgagtcaccacggtgatacagaacctttgagtaacattgcggtacttgttgcggcggctgatgctttgtcagcagcacgtcctggagctcgtcgtgaatcaattgaaaattacatcaaacgtttgaaagaccttgaagcaatttcaacaagctttgaaggtgtggaaacagcatttgccttgcaagctggacgcgaaattcgtgtaatggttaaaccagaaaaattaacggatgaccaaattgtgattttggcgcgtgatgtgaaaaatcgaattgaggatgaaatggattatcctggtaatatcaagattactgttatccgtgaaactcgagcgattgactatgcaaaataaaaaactgtcttttggcagttttttatttcttattacgaaattatatttcttttttgttacaaaagctagttttaagagctagcttttgatagaatgagattaatcgttgattaagagatggaattagagatatatcggaggaaaaaatgcgtgagcgtggtttattaattgttttttctgggccttctggtgttggaaaaggaacagttcgtgctaaaatttttgagagtgaaaacaactttgaatattcagtgtcaatgacaacgcgtaagcaacgtcctggcgaagtagatggaaaagattattatttccggacacgtgatgaatttgaagaaatgattcgcaatggtcagatgctggaatatgctgaatatgttggaaattattatggcacacctttaacttatgtcaatcagacattggacgaaggaaaagatgtttttctagaaattgaagtgcaaggtgcgcttcaagtgaaggaaaaagttccagatggtgtttttgtcttcttgactccaccagatttggaagaattgcgtggacgtttagttggacgtgggacagattcggctgaagtcattgcttcacgacttgaaaaagcaaaagaagaaattcgcttgatgagtgaatatgattatgccgtcgttaatgacaaagttgaacttgctgccgaacgtgttaagaaaattattgaagctgagcattaccgagtggaccgcgtgattgaacgctatgttcatatgattgatgatgtgaaagtttgatttaattggaaaaaattactgacagatttgttggtttaatgcgaaggagctatcagttctactgatagtcctgccagaaatgattaagttgataaattttactgacagaattttgttttgacgataacaagtctgtcagtaaaaatagaatgaaaagtttagaaaatgaggtaatgaattatgatgttagaaccttcaattgacaagttattggaccaagttgattcaaaatattctttagtagttttggaagcaaaacgtgcgcatgaattgcgtgataaagaacgtccaacaaaagaatttaaagctgtaaaaaatactttgcgtgctttggaagaaattgctgatggaacagttaaaattcacccatcacctgaattgaaacgtgaaactttagttgaaaaacgcgaattggaacgtttgcaagctaagatgaaagaacaactcatcaaagagcaaattgctaaagaagaagctgaagaagaagcaaaacaaaaaaatagccgcgccgctaaagcagctgctgcagaataaattttttaagcgttaattggcgctttttttatttctaaaagttactgacagctttgtcagtaagaagcggataagtcaaaagcaggaaaaatgcttttctgttataattaaagataagaaaacggaggtcaaaaataaatgaaaattgctaaagtcatcgttgatgtgcctctgatgcagacggataaacccttttcttacagcctttcagctgaatttgaaaatttgcttgaagtgggcatgcgggttcatgttccttttggaagtggaaacaggcttgttcaaggaattgtcattggatttgaagatgaagaacttgagccgtcagtaaatttgaaaggaatttctgaactactcgacgttgagccagtcctaacggatgaacaactttggttggcagatgaaatgcgtcattcagtattttcttataaaatttcatgtctaaaagccatgttacctaatcttttgaattctaattatgacaagctcctaaaatcaactgacggaacttctgtcaaatggtcacaactgacagaagcagaaaaaatctcgtcaacaaaggctgtgcgtttgggtcatctgtcagtagaatatttagcaaaatctaaagaaaatagaaaaacagaaaaattcttatctattccagatatcgaaaaactagctgaatttgaaattgaaaagagagctaaaaaacgcttagagttgaaatattttctattacgacttcaagaagaaaaaattgcggtcaaatcattaaatttttcttcacaaatcattaaatttttcgttgagcatgacctagtcaaaattgaagaggttgaaatttcgaggacgaaagaaaaatttgaagctgtggaaaatgacagtgctaaaattctcaacttcgaacaaaatgcagcttacgaaaaaataattgcatcttctgacaaaccctttttgttggaaggaattactggttccggtaaaacagaagtttacttacagaccattgaccattttctcaaactcggtaaaacagcaattatgcttgtgccagaaatttcactgacgccacagattacgaatcgatttattgctcgttttggagataaagtggcgattatgcattctggtttatctgatggtgaaaaatatgatgaatggcgaaaaattaaatctggcaaagctcaggtagttgtcggtgcacgttcagctatttttgcacctgttgaaaatttgggaattatcatcattgatgaagaacatgaaacgtcatataagcaagattcaagtcctcgttatcatgcaagagatattgcgcttttgcgtgcaaaatggcatggtgcaagacttgttttaggttctgcaacgccaagtttagaaacgcgagcacgtgccatgcgcggagtttatgaacttttattactgacaaaaagggcaaatgaagcagcaatcctgccagaaataaaaatcattgatatgcgcagtgaaatttctgaccaatctgctaatttctcacactctttactgacaaaaataaaagaaaaaattgacaaagatgaacaagtcattttgatgttgaatcgaaggggttattcttcatttgtcatgtgccgcgaatgtggttttgttgttgattgtcccaattgcgatatttccttgacccttcacatggatacccgaactttgaattgtcattattgtggtcatgtcgaaggaattccgcaaacttgtcctaattgtcattcacgaaaaattcgttattacggttcaggaacgcaaaaagtcgaagaagaacttcgagaaattatgcctgaagcacgagttttgcgaatggatgtagatacaactcggacaaaaaatgctcatgaaaaaattcttgaaaaatttggtaatcatgaagctgatatcctcttaggaactcagatgattgccaaaggtttagattttccaaacgtaaccttagtgggtgtcattaacgcagatactggcctaaatctacctgattttagagcgagtgagcgttcctttgaattgttaatgcaggtggctggacgagctggacgagcagataaaaaaggtgaagtcttcattcaaactttcaatccacatcattacgccattgaaatgaccaaggctcaagattacgaaaaattttatgaaatggaaatgagatttcgtcgtgaactttcctatccaccttattatttcaccgttcaagtgcttgtttctcatcaagatgaagaagttgccattcaaaaatcttatgagatcgctcaattactcaagcaaaatttgacagaaaaagctaaaattttagggccaaccgccagaccaattgccagaacacataacctttatcattatcaaatcttagttaaatatcgttttgaagaagaattagaatcagctttgaatcaagtgcttgaattaacccagattcgggataacaaaaatttacgagtattgattgatagtgaaccacaaaattttgtataaaaatttccacaggtggaaaagttgagaatttgaaaacaaacgaaagttggtgtggaaaatgcagaaaatagaactttttcaacaaacaattgacgcatggctgaccaaagacatcaaaaagttactgacagccctgtcagaagacattagctacaccgaatgctacggggcgcaatacgaaggaaaagcggaaattgaaaaatggtttcgtcagtggaatcatcctgtggaaaataaagtgaagtcatgaactgtggataagtcttatgtagataaggaaactgggtttttcacatggactttccactatgtttataaaggggaagaaaatatttttgacggtctttctcttgttaaattttctggaaataaaatttgtgaaattcaggaatttgaacaaaaacatgaaaaatttcggccgtttttgaaatgaaatgaggtaaatatggttgagaaatttgatttattgaagcattttggagtctatggtgtggcaattgacaatgataaattactagtcattgaaaaaaattcaggtccctatcaaactcgctttgatttacctggaggttcgcaagaagttggtgaatcaatggttgatacattagagcgagaagttcttgaagaaactggctttacggttctttcaagtactaataatcgcctgtattccgcttggatttatgaaaatgaccgtcgagtcgtcacacaccacgttttcaatctttttgatgtaaaattaaatagtgtagccaaaaaattaccacaatttgttgctgacggaaaaaatgattctgacagagcagtctggaaatcgattaaaaacttgtcagtagaaaattcatctccacttgtcctaaaagtaattgccgaaatcaataattatccccatgtggataaagctgaaatttacagagattggaaggtcaactatggaagcaaaaattatcccaagcctttggtttgataacaatgccaaagaagcaatgaactattatgtatctgtatttccaaattcaaaaatcaaaaacatcgaatattatcctgatgaaaagctagataagcatttcgtaggaatgtctggaaaagtattaaatggtgaatttagtctgaatggccttgactttatctgccttgatggcggtacaattttcaaatttaatgaagcagttagttttactgtgacttgtaaaaatcaagccgaaattgatgattattggtcaaaactttctcatgttaaagaagccgaacaatgcggttggtgcaaagataaatttggtatttcttggcaaattattccagaaaatcttggacagttaatggcaaaaggcgataaggctgttcaagtattaatgaaacaaaagaaaattattatcgaggagtttgaaaacttatgacaaaaacaaaaattatctttatggggacaccacaatttgctgcgaccgttttaaaaggtttgattgattctaatcaatatgaaattttagcagtagtgactcaaccagaccgtaaggttggtcggaaacaggaattaagaatgacaccagttaaagaacttgccttaacggttaacttgcctgttcttcaaccagaaaaactttctggctcagtagaaatgactcaaatcatgacgctccttgaatcaggagaagttggaattgtgactgccgcctttggacaatttttgccaggtaaattattagatgttgctcaatttgcagtcaatactcatgcttctttactaccaaaatatcgcggtggggcacctattcattatgctattatgaatggcgaaaaagaagctggtgtaaccatcatggaaatgattcgtaaaatggatgccggtgacatgattgctcaagattctactccaattcttgaggatgataatgttggcactatgtttgaaaagttagctcttgttggacgtgatttgttacttgaaacattgccaaaatatctgactggccaattaaaagctcaagctcaaaacgaagatgaagtgacttttagtcctaatatttcgccagaagaagaaaaaatcgactggaataaatctgcacgtgaaattttcaataaagttcgtggaatgaatccattcccagttgctcataccacatggaatggcgagcgtttcaagatttatgaaacaaaagtcgctgatgattctgtcagtaacttacaagctggtgaaattgtggaaaaaacgaaaaaatcattaaaagttgccacaggcgagggacttcttgaacttcttttcgttcaaccagccggtaaacccaagatggatatcgttagctttcttaatggcctaggtcaaaaaatacaagttggggataagtttggcgaataaatttgtccacaataataaattaaaagttctatcaattttaatgatagaactttttttacttcaaaatttagcaagcaagttagggtgtaataaaaagaaagcgaattactttaaaagttgcttgaactttgatatattaaaaatgtacaggaactgtactagaaagaggtatttatgatttggtcattaatcgtcggagctattattggtgtaattgcaggagcaattacaaataagggcaaatcaatgggatggattgctaatattttagctggtcttgttgggtcttttgtagggcaagcgcttttaggctcttggggtccaagtttagctggtatggcacttatcccttctattgttggtgctgtcatcgttgttgctgttgtttcattcttcttaggtagagctaacaactagatagagcagcaaaagagaggaggtatcgtgtcaaaaggaaaaaaatttatttttattttggctgatttattctttctcaccattcttatccccatattatgggattactttaattatatgaattttcgttgggagcttatgcccacatcagaaattccttacattgggaatcatctttcccaatatatatttatcagctcttcaattttaggagcattattgttaatttgtttgctgattcttattttttatccaaaaacttatcaggaagttctactagatgataaaacaggaaatctaactttaaaagtttcagcaatcgaaggattggtcagagaaattgttagtaacaacggttatatcagaaatccaaaaatcaatgtgactttatatcaagccaaaataaaaattgatgttaaaggagaaattattcccagagttgagattgtcgaaaaaacaaaagaaattgagcaagaaattaaagaaagtatccaaaatttctttggtataaactatgacttaaaattaaaaataaaagttagctcacttgctgaaaataaaagttcgacaagtcgtcgtgtagagtaaggaggtggaaatgaatcttttagaaagatatcgctatccgataattggaggaatagtaggtttaattatagctatttgtatcttcacaatcggattttggaaaatgattcttctcttcttactaattggcttaggaattttcgttggcctttatcttaaacgtacgggaatcattgaacaactgttaaagaaaaaataagaaaatactaggaggaaattatggtacaagaaaacacaaaaacagaagtaactgaagttaaaggtagcttgacttacgaagataaagtgattcaaaaaattgttggacttgcccttgaatctgtcaatggactattgtctgtcgatggaggatttttctcaaatctgacaggaaaactagtaaatacagatgatgttacagcaggtgtcggtgtagaagttggtaaaaaacaagttgcagtggacctaaaagtagtcacagaatacaagaagaatgttcctgatatttatcaaaaaattaaggatgtcattcgtaaagaagtttctgatatgactgatttagaagttgttgaagttaatgttacagttgttgatattaaaacaaaagaacaacaaaaagatgatgaaaaaagtttacaagatcgtgtggttggcgcagctcaaacaacagggaaatttacatctgatcaagtagataaagtcaaagaaaaagttgatgacatgggtgatgatgctcgtgtaaaataagaatcaatttaacaaaaaaactgacaagatgtcagtttttttgttactttcaagaaaattttactttaaatagaaaacggttaagtattatatatagtacaaacgaatcatgaaaagagagtgtttttaagaaatttaaggaaaatcatctgacgaaagtcattgacagtcattgactactaagggtataatagctctgtatcacaacaaatccctataaccccttatataatgggatttcagatgtcattatatcagttagttacgtttttagttacgttcggaaaaaaactcgaaaaatcatagtgctttaagtatattagcgaacttttcggcggtttctttctttttctctttagcaagatgactgtacaaattcattgtgattgaataatctgcatgtcctaatctcatttgaatttctttaggatttacatcattgttcattagtaggcttgcatgagtgtgacggaaaccatgaaaacctatgttaggaacttttgcttttttaaagtgtcgaactaagtgctgtctttcgagttcgtaagttctcattttttgatgatatgagaaaactaaagaatcatgcaaagatatagcaccgtcattttgttgttttctccactctttcaacattgaaattgtctcgatatctacagaaactaaacgattgctttcttttgtttttgcactgtcttgtatctcattgctgtattgtatgagtgtcttagatacactaacggtattattgacaaaatcaatatcagaccatgataaggctaaagcctcacagatacgcaaaccagtagcaagtaaaagcttgtatagagtagtgctttttatatttgctttggttgattctaaagtgtcaaggtaagctaagaagcgtttaagttcatcattgttaaaatactttatttttttgactgttcttgtcttgagttttggagaaaatacttttatagctggattgtctgagataacacctaattgcataccataatcaagaatgcgtttgatgatattaagtaacagcttataatctttgctttttcccttttcacgattaccgttaactatttcagcagtattggcatttctagcccagtcattaacaatattttgcaatagtatagttgtaattttctcaactttatagtttccgatcgctggcaaaatataattttttaaaaaattactattgattctgatagtatttgcttttactgtcaatttataagaatcaaaccaactagcggctaaggcattaaaattgtcaaatgaacctttttctcttgcaacagtagagccatttttgataaacttattcatagcttggtgagctttgttttcgcacgttttacggttcttggctgtaaccgtagtgcgtacttgcttacctgttaggctatctacaccaagatagacatttactttatagacggttgtaccgtcttttttttgaacttctttaatattcattttttctcctgttctattgtcgggcaagacatgattaaggagaaagcgatagtattaaagttttatttattcaaattccatatcatcgataccgtcagtaaagttttctaaaaactcatactcattcatgaagtttatccagtaatctacttgctcttcgtgactgtgaaagcgaggcttgttttctgcatttttaattccttctgccacgtttgtgaaagcgccgcttatgttcatatcccacatcttgttagcctctttttcaatgcgagaatcaggccatttagcagctggctttctactggcatttttatctagcaagtaaactgtagctttttccaaaaacttaccttgggcacgagtgttttcttcaacatattttctaaattctgtgtaatccatttttcaccccttactataaacagtggctatgtagttgaggttgaccgattatttcatcaaacacctcaataaccaatccataatgacgtttttctaactcaaaatattcaataaatttatcataatcaataacatccggttcccaatcgaactgagcaagccattcatcggctctatgttcaatcatatagcggtcggcttctctttcctgccttctgtcccaaccagaagaacgacaatcaagatgtctatgtccaaaggaaacgtgccctatttcgtgaagtaatatattctgagttaccttttcactattgaatatatcaataaaaatataagctgttcctctaatattaaatttcattccatctttaagatgagggtaatctgaaggattatagtattttatttttagtgcgagttctgaaagcaactcctttataactgacatatattttaccccctgccatggtcttcttcccatgtttcacggagcaaatgtttataaagttctttttctctatctgtcagaggcacaccatcaaaagctacagcttcgtcaacagcctcttgaagctcttcgtcagtaagcggagaatttatatcaaaaagaggagtaacttttggttttggtttaacagctcttttagccttttcttgctcttccaattgagaagaagcagtatcgaggacaactttttgtcttggttcttcaagttgcatagatatatcagttattcgttggataacatccggcaattctccaggttcttcccaatcttcagaatgtctagggtcaatatcctctctaagaacaccgaagaaatcagctattttttgaagattaccaggattaggcagggatttaccatttatatattcactaattgagctttgagatatacctgtattcttttgtaagtcaactgctttcttattttttatatctaaatatttttttatattagaagaaactattgttcgcattgcttcatcttgcggagttaatttcccacgtcccatatgctactgtcctctttcgttaatttataaacattatatcggaataaaacgaaataatcaataaaaaacacataaaaatatcggttttttccgtttttatagttgacattgctttaaaccgatgttataattaactcataaagtcaaacaagcgaacgaacaaagcagttgcgaagcttctgtgaatgtagttacacgttgtattcaactcagcgtaagtagcaagtttggcaaataaaaagccccagaggggcggaagttggttaatatggataataactatggctctaacacaggagtgctgttaataattagcgttgttttggcaattttgtctattattttagtcttcatgtaaataggctttatattctattgtatcggcttttttataagtctgataactttgtatcaagctattgtcgtttctggtttcatagcacttattaccaaaacttattggataataaaacgaaccttcagtagtctctatataaacaaaaagattatcttgttcagaaatgctactcggtgtaaaatcaccaaagtaaaacgaatagaaatcggatgcttcggagtaaggggctatggttgtgggaattgtagaagtagaataagtgcggtgatgattcttgaatttgaaatcagctaaaatttcttgtgaaattggtaagcaatctccttcgtcatatctatatttattagggtgaggtaatccgttgaatgttgatttgtttttatcaaataacttcatatgtttgatggttattggtttagatgaatgattaataaaactcattctaacaaaaagagtgttttgttcgttagagtcaatacaaaaatcagaatttactccgagattcatcttagcatttctataattctgaaaataaatccaaaacgaaattaataatgacagacctgacattgttattgttaaaaaatcttcaaagtccataagaacctccaatataattttagtttagtcacttacattatatcacggagttatgatatcgctcacattgagcagggaagactggcgaacaggttcgattcctgaacttcccttactgcgaaagcagaagtttaaaaatagaaaggagaataaaatgggagaatcatttcttgaaaatgccattgaatcagcacaacaaagaaaagaaaatatctgtcctgctatcgaaaagtttgtaacggaaactcttggaaatccaaacacaaaagaaaaccctgcaatggtatcggccatcgcagagttacttaaatttttatgattgtttcatgccaccgttttcgatatttttatcaatcatattatatgcctcggcatataatgatagtttttcaactagtttcatgtctggactagaactcgaaacaacggctaaagcaaacttttcagcatcaattttcaaatttaatttcctcctttccatagtattaagtaaatatctgagaaatatttactcaatcattatagcacttggaggattcaaatacacacacagaaaggagccagtatggcagagaaaacaccaccaaaaattacattaaaagcagcacgagtaaacgctggattaacagctaaagaagttggagaaatagtcggaaaaaactatcaaaccattctgaaatatgagcaagacagttctaatatccccctagattttggaaaagaattgtcaaaaatttatgactatccctttaattatatttttttagggaaaaacatcggtttaaaacgaactggacagaatattgctagttagaaaggcaaaatatgaacgaattacaaaattttacaaatgggttcttcaatcttgacgttaaagtcgagggagaagaaattctatttagtgcagaacaagttgcgaaatctttaggtttcataacaaaaactaacggaaccgaatacgttagatggaacagagttaacgagtttttgccacaagtggcaaaagttgaaaaaggctcatttatcagtgaacctatggtttacaaacttgcattcaaagcaaacaatgctgtatctgaaaaattcacagattggctggctgttgaagtccttccgacgatccgcaagcacggagcttatatgacggatgcgaaagcacaagatgttatttctggtaacggtttggctgatttgctactccaagcaggaaatcagattaagcaacttgaacttgaaaaaagccaaatgaaaccaaaagcgttattcgctgatagtgtttcagcttccgaacacacgattctcattcgagatttagcgaaaatcctgaaacaaaatggaattgatatcggagagaaacgattatttacttggcttagagataacggatacctcgttaaaaaaattggtagcgattataactcaccaactcaacgttcgatgaacttaggtattttagagtttaccgaaaatactcatgttcataatagtggaaaaataaccgtaaccaaaacgcccaaagtaacaggaaaaggtcaaatctattttgtaaacaaatttttacaagatttagctagttaggaaggagaagctatgggagaacgatatgatccaatggctgcgtatctagctaatggcgttctggaagagtttcgtaagatgacgaatgaatggctgaaattccaaaaggagctgttcaaatatgaaagcaagactggagaaatcaggcaggttgatttgttgaaagaattccacatgtcatcagatacgcttaaaaagtggagagaaaacggattaccttcgataaatcgaggtggttcagtcttctatctcttggaagatttacatgatttttattactaaaatgtcgggcaagacatgattaaggagaaaatgactacctccacacacaaagttaatttattaaatgcggtgctccgctagaaaagagaaaataatggaaaaagaagtgcttaaaaaagcagaaaaaattatggaactggcagaaagtattgttgatgaccttcaagataactcaaaaacatacactgaagcaatcgacaaattacaagctatgaagttagagacgcaattagatgatttcatctattcaactctacacttgagaatggtacaagaaaagccgaccgtaaaggatcgacttagatttgattaaagctagctagaaggagaacataatggataaattttctgaggaaattgataaccttatcaatgaaaaagtggattgggctattgagacatcacttacttacagagaagcaatcggtaaagtgaaagaaacttctgattttactttttatggtcaagcattaaaaaaagccatccaatccgaaattgctaatcgcgcattagatagcagaattaattaaatagattcaattttcacgatagagttagaagcataatatgtttccggtttttcaatgtcaaagaaaaattctgagttgactaacatctctaaaaaacttggagaaagaccattgttatgatgtctccaaagtgtatatcccttagaaattgagacggaatcgttatattttatccaagtttgaaatgtttggttttcgtgaaatgtagcgatagaaccgtcagaaaaagtgactttaattgaattcaaaacaaaatacctcctttctataaaactaagcaaataccgcaaatatctgctcacagtaattatagcactcggaggattaaaacgcatacatagaaaggacattaaaaatgttaggaataaaaacatttgaagaaaaggaaaagcttgcagattatgacaagttcgcagaagattacaactcattatgggaatatgcggcaattttggaagaaaaagtatttaagtttgatgaagcttgccaaaaccaagcaatggaaatcattctattaaaaaatgaattagccaaaatgaaaatgacaaacaagaatttaacgattgcaaaataaaaaagccctgcatggcacgcagagcaagtaggaaattcgccaaaacttctacttaaattataccacgaatgcctagaaaattgaaacggagaacattatggaattacaacttataccagtagatggggatggacaaagggttgacttgaatccatcagctataaaagatatggataatatcacacttacagaattcttagctcaggcaaagattatagctgacctttataaaaagggcgaaactgaggttaaaaaacggcttgatgaaggtcaacaattcaatcgtttgagttatggtaaagcagcacaacaaaaggttttaaccatgactaataaacagaaatatgacttagttaaagctcatggttgggattgtgtagagccaattactttaactaaactcaagagcaagtttggagatggaatagaacaagagcttgagcagtccattgtttataaagataagaaagcacctcttaaatgggatgcgtgaggtaaatcatggcagataaagagaagtcagtttttgaactgttaaattcaatagatgtcagtgacaaagtcgaaaaaaagaaatcgggtaaaaatgagctaagttatcttagctggacttgggcctggtctgaatttaaaaagaaatttccaaaagcgacttatgaaatcaagaagtttgtttcaaaagatggaaatgaggtgccgtatatgtatgatagcactactggttttatggtttttacatcagtaaccgttgaagatgttactcatgaaatgtggttgcctgtcatggatggagcaaacaaagctatgaaagataagccttataaatatatgacaaaatataatggcgaaaaatcagttgaacaagcttcaatgtttgatgtaaataaaacaatcatgcgttgtttggtaaaaaatatagcaatgtttggattggggttatatatctatgctggagaagatttaccagaagaaccacctcaacctcaattaagcgatgctgagttaattgagaaatatttaaaacaaaatccagaaaataaacctaatgttgatgaatttttgaaaacaaaatcggaacacgaagttgctgaaatgatgaaagcatatatagattggagtaaataatgattaacaacgttgtattagtaggtcgcttaactcgtgaccctgaacttagatatacaccacagaaccaagcagtaggcacatttggattagctgtaaatcgtcagtttaagaacgccaatggagagcgagaagctgacttcattaattgtgttatttggcgacaacaagccgaaaatttagccaaatttgctaaaaaaggcgctttgattggaataactggacgaattcaaacacgaaactatgagaaccaacaaggacaaaaagtttatgtgactgaagttgttgcagatactttccaaatgctagaaagcaataaaacacaaggtcagcaaacaagtaaaccgcaagctcaaaataaaaagctacaagcaccagatccttttaaagcttctgctgctgatccatttgctggtggtattgaaatttcagatgatgacctaccattttaattaacaaccaggtgcagcgtgcgtaacaaatgcttaaattcgaggggataggcaatgcgcaacatcccccagcctttaatttgaaaaataaaacttgaaataaatatagaagaaaggagtattcgtggcacaaaaaaataaaacaaaaatctatttttggataaaactagatgaaaatttctttaaaaatctagctattaaaaatttgagaaaaacagtaactggtggggatactttagtgataatttaccagcaaatgttgttatcttctttacctaataatggagttatctattatgagggtactttacaagatatcgctcaagaaattgcattaaatcttgatgaaaagcttgatgatgtcagattggctatagattatttccaaaaagcaggtttattgcaaataggagatgacggaagtgcagaaatgcttcaagttccaatgcttataggacaagaaacaaattggaataaatataaaagggataaaaagttggaaaatttccaaccaacttccaaccaacttccaactaattccaaccaagctccaacagagatagagaaagaaatagaattagaaatagaattagaaaaagaaatagaaaaagagaaaaaaacagaaacagaagaattattctcgaactatttttctattttcactaatttatcaaaaaagaatctttcaagaagagcaatggcattgcaagtatttattacactatcttatgaacaaaaggaacgttctgttattggagcaaacaactatgtagaatattataaatctaaaaatcctggagataatgaagcaaagtttagtattaatgcttatgaatttcttagcaatatgatgtttgaagaatatcagcaaaaagtaaaagttaaaaaagaaactctcgggggtcttatctaatggcttttgatacatggagagatgacggagagtttgctattaaagcaactgatgttttaaaaaactatcaagaaggtggggaacttggcgtgtgtgaagttcacggctgtgagattatcggttctaagaaatctgtgctttcttatcctaagaatgaaaaaggtgaagtgattggagaaccttacttatacgatgtaagagtttgcccgatgtgccatgctgaaggaataaagacagttgctactaaagctgtcaatgacttcttaggagaattcaaagctaaaaagggtattgatttgactgaaaatgtcattgttaaatatgatttcgctgatgaattaagtgttgtatcttgtgacaacatggtcaagtggattgttaccaatgttggcagacagaaaaaagtaaaacgattaaaggttagaaagtacatacagatttctgaaaatagattttctagtgatgaagcaagagaaaaatatttgaagatattacatgatattgaagaagcagaaattcttattttcgattcattggcagatttcacagcaaatcaagctgaaaaagcattgactcctttattaagcgcaagtgataactgctcaattattatactaacaattccagaaagtgatgaaaggcttgaacaattgccagcaagattgaaatttaaactcaataatgctcaagtaatgaatttctcaagtacaggacaccaaagatgaaatttaagtttgaattggataaaatgccaactactcagcagcaaaaaggcattaaaaaagtgaatggtaaacttcagttctatgaccgacgtgggacaaacaactacagtcttaaagctcaactcatgaaaaataaaccgaaagagtgctttgaaaaaaacgttcctttgaagctatccgttacttttttctacgctatcaagcaaaaaaagcgttggtggcaatggaaaacaagcagacctgacttagataatcttatgaagaacttacaagattatatgactaagttgcgttattacagtgacgacagccagattgtatggcttgaagctaaaaaggttaatgacgagaaaaacagaatagaaattgaaattacagaggtgtaagaatgattaaagaaattatcgtaattaaatcagagtatgaaaagcttaaagccgataacgaaaccatgaaaatacactgaagaacatttataatcaacctgaagatgatggaattatcagcattgaggagtatccatcacaaattagatactatgctaaaaaatcactcgaagcgattggagaaaaaattgattaaaacaaattttgttactttgaaaaagctgtatggattggcaagaaataataatttcaacgctaaccacaaagagttatctgtgaaaatcagtggtcgaactaagcacaatcacgaactttctcagctttacttagatatttgcaataaatacaaccattcaaagcaaatgaaatggaaagatttatacaaaatacttgaagaattaattccaggtttagcaattgaactgtaatagctctaattcatgaaaattacggttacattgagcgcttaaaccatttcatggataatttatcacgaacaatctaagagcgcttaaaagctaaaatatgaggtgtaagttatgggatattacgacacaagaaatgaagtcaggcgaattagcaagcttgctagtcaaaatatatcgagcgatttaactaaaacagaatatgagttagatagtcaaagtaaatttaatcaagaatttcaagaagaatttcatcaaaaaataaaaatgttaggaggaaaggaaaatggcaacgaaagtctttgatgtatttattgagggagataaagtcgcaactggaacaatagaagaattaatggaaatcttcaaagtttctaaaacagcagtttcactttggataaaaaatggaaaaagtaaagatagagcaataccgaaatataagcacgctttattaaatcaagaaaaaacagatgtgcttttacaggaaaataagaaaacaatgaaacaacttccagcatctgtctatgatttttatgaaaaagaaaacttcatcatgactggaacggcgagagaaatttctgagcgattaggtttaaaaataaaaactgttttctactatgttcaagttgggaaaagagagcagtcatatagaagtaaaagaaatcatgcagttttaaatcaatctgaaactaaaaaacgtttccctaatcgagatgttttaatggaaccgaacgaggaagaagaaaaaggatattattctttgaccaaagaggaacgggcagaacgcagatataaacgcaagttaaaaatgaaaatgatgattgaaaaaatgcaaaaagaagaattaggataaataatgaataaaaaattaatcacacagcaaaaaacagacgatgctgttaacgctacgaagtgaggtggaaaatgacaaatttatttgatgaaacagtcacgattttagaaatccacggtaaaacaattgccgatattgaatatattggtagttcagagaaaaaaattaatacaaataaagcgctcgaattaatgaaaaaaaacgaattatgataatggttatggcgctcaagaaatagcagaaaacctaatgattaaagggaatggtttcatcatgatacgaggggaatatgatggctctgaatggtgggattatatgcaaccagacccatctttaccgcaagtaaatacagatgttaaaagtttcgaagccaacataggctgggaaagcttagaggaaattaacggattggaggacacgaaaaatgactaagtttgaagaagaattatttaataaagttccgtgcaaatttgaattaactacagaagcagaatataaaaaatctacacttataaatcacttcaaaaactggcactcagacgaagaatttcaggagttacttgaacagaatgctgaattgactcgagaaaataacattgtaaatcaaataaactctaaactagaatcgcaaatcattggtttaaaatcccaactccaacagcaagccctgccagtcgtgcctgagtgtgtggctaagcaaattgaaagagttaagaactctaatggtaactttgcaactcttggtttattcgactggaatcatgaagctaaacctgattatactaaatggattcatgaaaatgtatttgattttatgagagcatgcactatcggctacacagtcgaaaaaccgcagatgttctatattgaattaccaaacgtttatggactgaaaaataaagtatcagtttcaaaagtcgaaaacggaacaattgtagaattttcaaatggaaaaaattacgctttaaaacttactgagcaagaaatcaagtcaattgatgagcgttactggcagtttgctgtgcctgtggaggacggagaatgacaagaggatttaaaaaactagacggaaatgcgacacttccagaaagagcgacagaacatagcgcaggatatgacatttcagcaagtgaaacagttacgattcaacctgatgaaattaaaatggtaagcactgggctagctgttcaacttggagatgatgaagtattgaaattatacgaccgttcaattaatccagtcaagcgtggcattgcattgattaattcagtaggaattatcgattcagattactatccgcaagaatttaaaggcttatttatgaacatctcaaaagagcctgtaacgattgctaaaggccaacgaattatgcaaggtgtatttgtcaaataccttacaacagacgatgacaacgcaaatggaaagcgtacaggcggttttggtagcactggggaggcgtgagaatgaaagaatataaagtaaatacgacaacttttagcagcactaaaaagagaaataaaagtattttgattatcaaaagtgactctgacttcaaagttggagatgatttagaactgatttgtttcgcttatggaaattattatcatgaatccgaagataaggtacttcttgacggagatgggccttggggatgccttgaaattactgacaaagataatgctgacagattaaaaacaaaaatcacttgcgttttatcagcatcggaagtaaatgagggaggcaaagtagcatttgaaaataaactacttccaattattaaatcagaaggaagaagtaatggttacgatgattttatcaaagttttgaaaaacgcttttgaatcagaccaattgcctgacggtaatgtgattctcggaattgaggtggttaaatgactgaaatttcaggaaaaagtttgcatgaaatatacaaagaagatgctagaaaatataaagagtcgatagaaaaaggccgtgtgtatagtgaatcagaagatattttaactggtaattttgataaaagcgaatctttgactgtcacaatgcctatggaagaatttgacaagcttgaaaagctggcactttcagctcacactgacaaactttcggctgaaaaactccaagaaattcgagtagaagagcttaaagattttaattcaaaaattttacaagcagaacttgaaaatcagaaactacaaaaagagattgatgctgctaaaaaatatattgaagaatcttataaagcagataaagaagacaataaattacttgatctaattattgaagctgttgcaaaactaaaatcagataacaaaactgcaaaaaagtatatcgagcatgttattggaacgattaaacatgatgggcatttaggaactattcaaacagactggattttgcctgatttagaaaaagcactcgcagtcattgaaaaaggagaaaacaatgaaatttaaagcaaaaccaaaatatgcaacgctcgtacaagctgaagaagacgaatttggagaattcgattggctcaaagaaagcttggatgaagaaggatatattcacggatactatgtggatggatatatcattggaggaatagcagaagtaacagatgagtatttccaacctgaattttggtgtcctattgacaaattaacactcgcagcgattggaggggatagatgacaattactgagcaacaattctatgacatgctcaatgttgatgaacatatgaatttcacaaatcaaattcaagaacttgtttttgataaaaaaggacgtgaagaattttattctaaaatcttaaatatccaccatgatatgagtattgattttttcagagattattttatgactcactcggctgtctcgtcaaaagggcagcattatacaccagatgcacttggtaagctcacagcgttgcttgtaggtggttctggaggtacagatggcggatcaagctcaggcggaacaacaaacccaactactcctagtgacggtaaaaccgttaccttaccaggtaaagatggtaagccaggtacagatgatgatgttactgtaactggggatcaaccattgacaccaggttcagacggaagtgttacacttccaagtgatggaggaaaagttgatcgtcctgatggctcatacaatgttcctggaggaacaatagtagacccagatggcacgattcatctcccaggtggtgatatcgttaacccagatggtactgttacattacctggacaagacggtaaaactggtacaggcgatgacggtaaggttaaaccaaacggcccaattattccaggtgataatggaagtgtcactctcccagacggaggaggtacagttacaacaccaggaggaacgattaatgttccaggaggaagtgtcgtagacccagatggcacagttcatctcccaggtggcaatgtcgttaacccagatggtactattacattacctggacaagacggtaaaactggcacaggtgatgacggtaaggttaaaccaaatggtccaactattttaaacccagatggaagcattacgctccctggcggtggtacagttcaaacgcctggaggagctattgatcttcctgaaggtactgttattgacccagatggcacaattcatcttccaaacggtgaaataattaatccagatagcaccattatcggtaaaaatactaaattaaatacttctaataagactcaaaattcaacattgactcctcttggaactcctgttggaatcggcacaagtaatactacattaccaaaaactggcgatgattctgtaagtagtgcagaagcgttagttttaggatttggtaccttacttggtgtactcactcttactgaggtaaaacgtcgtaaagaaaattaatttgcttatgattatagcagatagtttatgaacgcaaatttaaaatttaaaagattatgccattgaaaatcataaagggaagaaactaaaaaatatgaaaaaagtaagtattatcattcctttcaaggggcagacggaatcggaactaatgcttccgttagcatctatttataatcagattggaattgatctttcacaactggatgtccatcttgttaatgatgggggaaaacccattaatttaaaaaagtttgatgttttagcagacaaacttgaaattaattatcatgaaataccaagtagtgggccgggtacagctaggcagtacggtatagatcattctaagagtaaatacgttatgtttattgatgctgatgatattctctattatgtgggcgcattatggccgttttataatgcggctaatcaaggccatcaaatgatattggccgggtattgggaacaagttgccggaaatccctatacttacatcgttcataataataaggatgttaaagctgtttatggaaagtggtataaacgtacttacttagaaatgataaatttaagatttttggttgatttaccaatttatgaagatacttattttgttggtttggcttgtatactatcaactgataaatgttaccttgaagaagtcgtttacatgtggttatgtaatcctaaatccattacaagaaattctgaaaatatgtttaattatcaagctcatatttgggcaagagaaaacaggcattggtttgaaatgattcgtaaatggaagcctgaaaggttacaatctgattttgaaaactatttaacagatatgtatttgaaatcccaaaaattttcgccaatagatgaggaaaaatggttaaaggaacagcgtatactgatcgaaaatgtttctgatattttctctggctggactccagaacttcaaaaacaggttaatgagaaaagcgccgatattaataatcagtggtatggaattaatactgatggttttaaggagtggatagctcaaactcttccctggtaacataaaggatttttaaaagttaagttaatcttttgaaacgaatcctttccaattttaggcggatagataaaaatatctatctgcctaatgttattatttattattattattttttaaactttatttattagagaggttgggttcgttaatgaagaaacaaggtagacaacttaatattttgaatagtttgttcttgaaaaattcgaaagagcaaaaatcgtcgtcaagggagattcctgacagtcaaattgaattgaaagctagtaaagaattaggagtggcaatacggcaaaagaaagtgagtaatatggtgggaaggagtaactattcttcagaattgagaacacacaaacaactacttgaaaaatatctacaacattcagaaaaatactttaatgatttagctgaatataaaaaaggatatctagtattaaatcgtagtttagaagatttaaatcaactttctcaaaagatgactaataaaaaagaagaatatacttctgaaatggtcaaatacgaaggaataaaacaaaagtatgaacaaagccttaaggaatatcaagaaatcactgaagaatatgaaaatattattcaagatagagaagtggttcaaagaaagtttgaagaacactctatagctctgaaaaaaattaacgatgaggtacaagagttaattgataaaaagtctgaaaaaaacgatatttttgttgagttaaagggtaaattggtgatagagagagaagtatttaaagcaacacaaagtcgtttaaacgggattgtctctgtctatgagttacttaaaaaaaattatcaggaaaagaaagaaacttttgaagaatcccgtaagaaatatcaccatgcaaataccataaaaaatgattgggagatgctagtcaaagattttgaaaaaactaaagctaataaacagaaattcgagcaaaaccttcaatctattgataaaaaaataaagaatacagaagaagaagcaaaaacctcaaaagaaatttatagttttgttgagccttctttagcagcaatggaagaaaaatataaagaacacaaaaaaaactatgaagcagtagctatagcttataatatttccaaaaaaagctatgatgcagaatatgataagtatgctgagcttaaagaaaatcttgaggaaatgaatagtttaaaaaatccgagtaagactgtcattggttatatcacccgtgacagggatgttgccaaaagtagggttgatagtttagcgaaagatttttatcctttggaagaaaagttcaaattacaaaaaagtgtttttgagcaaattaatgctagctatgaactggtgaagaagctggttgatgagaaaaaggataagtcaaaagtttataatgattccttaagccaaacattggctgctcagaaaaaaattacaatggttttagaagttttaaaatcaaaatatgggattcttaaccaccaacggggacaatcacaagaagcatctaaagttatttctcaggaatacgataaactcgaacgagaattcataaaagagcaaacgtccttcaaaaatataaaagatgattatatagcttttgaaactcggtataactccactaaagaatcttatgatactgccaaagaaaagcttgctcaaagtgaggaaaatcttgaaattgttaaaaaagcatattctgatgttgcaggtcttctcagaattgcaacggcaaataaagaatctattctagcaaactataaagaatctgaaaaagaactcaagaagttgacaggcataaaagatggactaaagtttgaattagaagataatttctcagctttagaggaaacataccaaaatggtgagcaactttatttacgactaaaggaacagtcaaaaaattggcatgacgaatatcctcagtataatagtttatataaaaaaatattaccggagtatacaaaggtgagtaaccaactcgaaaagctaaatcaacaatacaaagttatttatagtgattatcaatttttagataaatctagagaggctgctcaaaagcaatatcaagaagaaatgaaaaaatataattccaatcaggaattatataatcgattgactcaagaatttaatcattgtttagatttaagaaatattgttcaaaaaaaagataatgactttgaaactgctttgcataatttgaatcaatttatctttaaaaatgatatgtttactttcccaattaatgaagcaaccggttctaattttatagatgaatttaatattcctgaaattgagtttaatgaatcatcaataagattaaccaggaaattcgaactatcaaaatggacagaaacatttcaaagattttattcccaaactgaggtaatagctaaggatcttgttaaagcattggcggaatatcaaaaacaggtttcaatttttatacgacttggagggaaaagacttatcgatttgggaaatagtgatatagcttatcgtggaacaaacattgaaaactacttaaataggctattaaccaacttcaaggagtggcagatagaatatgaaaatagagagcaggttttcgccttattagttaaagattatcgtcaatatttggatgaatcaattaaattaaatgagaacattgctaaaatgtcagattctaagaatggtttgcaagaaattgtgaatgcaattaattcacttccaaattacatggatatttatagtgcttcttaccgcaatgttgaagtgttagcgaatagtcttgggagtgaggtttcagacttaacacatttacaaagtgttgatgaattaaaagtgacaattcataaagtttatcttgagcatattcaagctttgattgatgaaaacctagaagatacaattacacattttaccaaaattcgttccagttacgatcaaagtattagtaatttaagaaaacgattggattcaatggaaaaaatgacaggtattccgacaagaaaaattgtaatagaaagctccctaccaaatgatcttgatttaaaaacctactttaagagtgcattagatgataatgtaaaacaattactttctacaattactggaagttcatcatttattaatagcgtgaaaaaagttaatcaatttaaacgagttcaaaatctcttatctgttaatgaaggaggaattgcaattgttcttccagaagtaccaatcaattttaatccaaaggaactagaattttcacttgtagtagctagcgtaaaaaatattgaagctccgaataaggtagaaaagttggtttcttcttatccaacgccagaacaaccagatattctcagtgagaaaccaagttttatcgaagatattcttgaaatagagaaaatagaaaagcaacaccaaaacatagaaaaaaaagaagcgctaaaagctcttgcttaatatcagttttaataatatatctaactgaaaggtattgataatgaattattttgtaaatgagaatatttttaccctgaattctgggacagaattttcagcgattaaacgattgaaaatgttcaaaaatcatcgtgttgaagctaaaattttgacaagaaattacaatcctcaactctctggagatttaaagagggtaggtttaactcatgatgatgtcataaatatgtatgattattttcaagatgtaataaatgtttctgcaagagatgttgatgtgcgttacacaaacaagattaataaaagaaaatatcatattgaaggaattgatgctaatgaatcactgattaagcatgctggaaaaacaattgctaaagtaatgattgcaccagcgacagttggattagttggttcaatggaatataatgattcgatgaatcatgtagtagctaaagatatttgggatcgtagaggttttctttcttctacacaatactttcatccagacggaactcaagggccgcaaatcttttttgatatcaatggaactcctaagttggaaatcatacatatgaatattcaagggattctacatccaacaatgtataaattattgaattataaaggtaagaatagacgatttaatcgagaagaagaactctttacttttttcatgaatgagatagcaagtcaagaagcaagcgtatttataaatgatcgaccatcactcatccccgctgttgcaggtgtggaaggtgcagtaggaaaatggcaatttttacataattctcattcaaaaaataatcagcaagcaggagcttcaagattagtggtggattatcttaatgatttatttactgtgtataaagataattttgatggtttaattgttgctactaagcaacaaaaagatgaaattactaaattttatgattttaagcaggtcatagctctcactgatacttttgctaaaaaagttaaaaaatcagcttctcgaaataaaaataagattatttatgttgggcgtttatcatcagagaaaaaaccagctgatgttgtagaaatttttgcgaatgtttatcgcagattaccggaaacaagccttgatttttatggctattcatctccttcagagattcaaaaagatttagaaaaacttgtagaaactaataatttaaaaaatgttgttaactttaaaggttaccaatcagaggaagcgctagaaattgctttaaataatgcaggacttttacttaacacttcggaaggagaagcgtttgggatgaatgttttagaagctttaaatcatggggtgccagttgtagcatataaggttaagtatgggctgactgaacagatagagaatggggagaatggctaccttgttccttatggagcaattcaaactgctgctgactctattgcagaaattattcaatcaaaagcaaattgggataagttttctcgctctgcttacgaaaaggcaaaagagtatagcgaagaagctgtttgggggcagtggcttaacgagaagattattgctgataatttattcataagataatcaaatataggaatgaggaatcatgttattttttattaactcaacatttaatcaaaaaaatttcggaatagagcatgcacagcttaaacgtgcggcattatttcgaaaaaataatgaggcttttaaacttgtttttcgagaatggaatcctaatattcatcgatttttaggtgaagtaggcatctctaattcagaaactttatgtatgtttgattattttcagaaagcagaacttgtagaggaaaaagtcctccatgttgaagatttagattttggagtcgattctttaacttataataaggaacctaatcaatttagatatcttgtctttcaaggacaacaacttattgctcgtgttcgatattttggcgaagatcctcttgaacgagtaagtgctgtagaattttttgatgggtttggaaatctttatcgagttgacttttatgattttcgaggttttttgagtttaagtcaatggtatacacctgataacaagattggcacagaagtttggatggatatcaaaggcaagccagtattggaaacttttaataaatatgatggaaatcacaagtataccaaaagtggttggcgtctgaatggtgctgatggagcaatttataattttactaatattgatgagttaacgctccattttcttaatttattaaacgaagagtattggcaagatgataaagcaaatatttttatcatggatcgaacacatttggcggattgggctttattgaacttggatcgtcctgcttatacggtacttcatttgcataattcacatgctggaaatgcccaagagcccatgcattcggtcatgaataacttttatgagtttggattgatgaattcaaatggttacgatgctattgtttcagcaacagaaaaacaaacacttgatgtttcaaaacgatttaatcctcaaagcaaattatttactattcctgttggagttgttccaaatgaagttttttcagaaaagcgaattgatatgaaggagcgtaaagtgcatagcgttttggtgactgcacgtgttgcacctgaaaaacgaattgatcatatcattagggcgatagggattgcaagacaaactgttccagatattacgctagatttttatggttatgttgatcatcgagatgatgattctgcacaaaaggccattaatgctgcgataaaagaataccatatggaagaagcagtgcatcaatttgagtatgctaataatgttggggagctgcaaaaagagttccaagtctatgccctagcttcaatcatggaaggttttaatttatctctcatggaggcaataagccatgggatggttggggtcacttatgatgtaaactatggaccaaatgagttgatagtggatggagaaaatggttttgttgttccttatgagggaattcaagaaatggctgaccgtttagttgaactgtttactcaggaagataaactacaaaaaatgtctactcagtcttatgaattatctagacgttattctgaagaaaatgtctggaaagcttggcaagctctcattaacgatgcaaacaaaaagaatattgcttatcgttcaccgattacagagggaataggggatcaaaggatttactctacaaaaaaatctaagtagaaaaggaaaagttataacaattgttgttatagcttctttttgttaaaaatttcagcaaaaaaagattattaaaaatatatttggcttaggagtttgagaaaacttactaaatggtatagattgaaaaataaatgataaagcgctataatatgaaagaatttcattttgttcaggtaaaaatagatttttaatgacttgtgatgaggagaattagatgcgcatagcgagacaaccaagatatcagcagattgcattacaaattgctgaaagaattgtacgtaatgaacttaaagttggacaaaaaatatacgctcgttcaactcttgcaacaacttttgctgtctcacccgaaacggcacgtaaagcaatcaatgttctaagtgacttgggaatagttgaccctgttcatgggagcggtgtgaatattgcttcaaagcaaaaggcacaggaatatctggctcaatatcaagaagtggaaacaatgcaagatttacgaacacaaatcatgcagagtgtggagagtcagagaagagaattagctaatttttcatccatcttggataaattggttgaccaaactgagcattttcaaaaaacaaatcctttaactcctattgaatttgaattggaaaaagactctgaaaagtttggactgagcctaggagaaatgaatctttggcaaaatacaggggcgacagttgttgccattttgcaaaatgcagaattaattgtttcgccaggaccgtacgcaactttaaatcaaggagataccttatattttgtgggtgcttctgatacaggacaaattgtccaaaatttcttttatggcaactaagacatcgtttacaaaatgatgccttttttttaagcttaagtttagttatttgacatagtgactacatattgttattattgagtggtcactttaaatgagaaaatcacttgcgtaacttaaaacttctaattattaattaacctatttatttagaatttatacttctaaaaatgttttaagcttccctgtgttagagtaaaggagagttattttgccagtaaaaataaaaattgaacatttaactaaaatttttggcaagcggataaaaaccgcattaacaatggttgaaaaaggtgagcccaaaaatgaaattttgaaaaaaaccggtgcaactgtaggggtttatgatacaaattttgaaatcaatgagggtgagatttttgtaatcatgggtctatctggttcaggtaaatcaactttgttgcgtttgcttaatcggttgattgaaccaacgagcggaaaaatatttattgacaaccaagatgttgctacattaaataaagaagatttgcttcaagttcgccgtaaaacaatgagtatggttttccaaaattttggtctatttccacatcgaacaattttagaaaataccgagtatggtttggaagttcaaaatgtaccaaaagaagagcggcgcaaacgtgcggagaaggccttggataatgcaaacttattagactttaaagatcagtatcctaagcaactatctggtggaatgcaacaacgggtaggacttgcgcgtgccttagctaatgacccagagattctgcttatggatgaagcgttctctgctcttgatcctttgattcgtcgtgaaatgcaagatgagctacttgaacttcaagcaaaatttcaaaaaacaattatctttgtttctcatgatttgaacgaagccctccgtattggtgaccgcatcgcaatcatgaaagatggtaaaatcatgcaaattggtactggtgaggaaatcttgaccaatccagcaaatgattatgttaaaactttcgtagaagatgtggatcgtgcaaaagttattacagcagaaaacatcatgattccagctttaactactaacattgatgttgatggacctagcgttgccttgaagaagatgaagactgaagaagtcagctctctaatggctgttgacaaaaaacgtcaattccgtggtgttgttacgagtgaacaagctattgctgctagaaaaaataatcaaccattaaaagatgtgatgactacagatgttggaacagtttctaaagaaatgcttgtaagagatatcttgccaattatctatgatgccccaacgcctttagcagttgttgatgataatggattccttaaaggtgtattgattcgaggaagtgttttagaggccttagctgatattcctgatgaggacgaagtagaggagattgaaaaagaggaggagaataaatgattgatttagctattggacaagtacccatagcaaactgggtgtcatcggcaacagattggattactagtacttttagttcaggatttgatgtgattcaaaaatcaggaacggtattgatgaacggtattacaggtgctttaactgctgttccattctggttgatgattgctgttgttactatccttgccattttggtttcaggtaaaaaaattgcctttcctttattcactttcatcggtctttctttaattgctaaccagggcttatggtcagatttgatgagtacaatcacacttgtcttactttcaagtttattgtcaatcatcattggagttcctttagggatttggatggccaaatctgatttagtggctaagatcgttcaaccgattttggactttatgcaaacaatgcctggtttcgtttatttgattccagcggttgcattctttggaattggagttgttcctggggtatttgcctctgttatctttgcacttccaccaacagtcagaatgactaacttgggaattcgtcaagtttcaacagaattagttgaagcggcagattcatttggttcaactgcccgtcaaaagctctttaaattggaatttcctttggctaaaggaacaattatggccggtgttaaccaaacgattatgttagctctttctatggttgttatcgcttctatgattggggcgcctggcttaggtcgtggggtacttgcagctgttcaatcagctgatattggtaaagggtttgtaagtgggatttcattagttattttggctattattattgaccgctttacacaaaaacttaatgtttctcctcttgaaaaacagggaaatcctacagttaaaaaatggaaacgtggaattgccttagtttcattgttagctttaattgttggtgccttttcaggaatgtcttttggaaaaacagcctctgataaaaaagttgacttagtttatatgaactgggattcagaagttgcatcaatcaatgttttgactcaagcgatgaaagaacatggctttgatgtaaaaacgacagctttagataatgcagtggcttggcaaacggtagccaatggtcaagcagatggaatggtttctgcttggttaccaaatactcataaaacacaatggcaaaaatatggtaaatctgttgatttgttaggtcctaaccttaaaggggctaaagttgggtttgttgttccaagttatatgaatgttaattcaattgaagatttaacaaatcaagcgaataagacaatcacaggtattgaaccaggtgcaggtgtaatggctgctagtgaaaaaacgcttaatagctatgataatcttaaagattggaaacttgttccttcatcatcaggtgctatgactgtagctcttggtgaagcaatcaaacaacataaagatattgtcattactggttggtcacctcattggatgtttaacaaatatgatttgaaatatttggctgatccaaaaggaacaatgggaacttcagaaaatattaatacgattgttcgtaaaggtttgaagaaagaaaatccagaagcttataaagttttagataaatttaattggacaactaaggatatggaagctgtcatgcttgatattcaaaatggtaaaacgccagaagaagctgccaaaaattggattaaagatcatcaaaaagaagttgataaatggtttaaataatcaacgaagatttaaatttaatgaaaactttctagcattatagttagaaggttttttattatttcattctaagtttattatttttagatttataacatttatgttaaaatgattttgtagagtcgaatgaggaaattttactaaagttttattatttgactgttaatctataaaactaggaggagagacaaatgaatcgtacatttattaaaggctttttggcggggaatgcacttttgatagctggacttgctgccactgctattggcattaaaacaaaagttatcaatcctatcaagaaaaaagaagaacaaattgaaatgggtagaaaacgagcagccagaaaacggattgccccttaagttaacaaacataataagaaaaacgtaaatcgaaagatttacgttttttattttgttcctttaaaaataagctcattgattgaagtgctcataaaaaagataaattttggacggaatttttcatatgcaatgggaatatcggcttctaaccaaagagtgagaacggtaataagttgagcgttaaagtatcttaggagttcttgagctgtaaaataatttgctaaaccatgttttttataagagagttaaagtgtttttcagcccacttccaagttctataactgattggaccgattaaccggaaaggaagttgagaaccaaaaataatatgagcttcttctttatgttgccaaaggaccggaagtagaaggtcagaaaggagttcaatagtaacatcttcacagttatattgaagtaaacgctcattaacttcatctacaatattcagatagatgtattcgacaattccgggaacgcccgttttaaaattatttttaatcgttgtgcgggtaatgtgtgaccttttagaaatttcttcaatggtcactttttgggattcggaggcgatatttaagagagtgcgaataataatttctttcgtatcttttgtcatgatgcttttattttatacttcaaggagtataaaaacctttctttttttaagttatctacttaataggcaataattaaaaataatctattatagataatttttttagtattctgaaatagtatatcattgttttagtaagaaattaattgttttgattattttttagtttgataaaaacttttacaaagtctttgctttttcgtaatatataattgttgatagttttgacatagcgctgtgaaaaataaaatcaataatggaaaggaaagatgaggtgaaaatttatcaaaaagaaagtgtttatgaagcatttaatcatcgactagaatatatttgtagttattttgaccatctgattatttctttttctggtggtaaggattcgggtttgatgttggaattggttcatctttattatgaaagtcatgaatggatgaaaaaagggataaaagtttctgttttttatttggattatgagggaaattatcaagaaactaaagattatatcgaacgttcaatgggaaagtatccagaatttgattattatcacgtctgtcttcctgtatcggcttcttgtggaatttcgatgtcacaatcgacttggttgccttgggacccagaacatcaagaactttggttgaattcaattcctccaaaagctatttgtttagaaaatcaagtatttccattttttaaagttggaatgtctgattatgagtttcaaagtaagttttgccagtggcttcatcgagaaaaagaggctgtacgaacggctgttttggtggggattcgtgctcaggaaagtttaaatcgttataatgcggtaacgcgcgaggaaactttttctcgttttggaacgactaattatagccatcgtattagtcaagatgtctttaatttttatccaatgtatgattggctatttgaagatatctggcgagctaatgctaaatttgagcttgattataatcatctttatgatttgtactatcaggcgggagttccttataaatcaatgagggttactaatcctttccatcagtgtggggtgcattcattaaagctttatcaggcgttagagccagcgacttggggaaaattagttggtcgtgttaatggagcaaattttgcagcgctttatggtggaactgcagcaatgggctaccgtggagctgtgctacctaaagaacatacttggaaatcttacgttgaatttttacttgagacattgccagaggaaactcgaaaggtttatcgtaaaaaatttaaatcttcaatggattattggatgaaaactggtggagctttaccagaaaatgtggttgatgagttagaggagcttggctcggactttgaacgtttgggtccaccaacaaataagcgcaaatataagcaaagatatgaagtgattcgctttaaagattatccggacgatgtgccaattaaaaattttaggttggttccttcatataaacgcatgtgtatcacgattttaaagaatgatacttcttgtcagtatatggggtttggtcaaacgaaggatgaattacagaaaaaacaagaggcaatggaaaaatgggagacatttttataagtccagcttatgatatcaggcgagtgccaattgagaagattagagcaaatgcttataatccaaatcgaacagcacctcctgaatttcaattacttgaacggtcgattttggaagatggttatacaatgcctatcgtttgttattacgataaagaacaggatttttatgaaattgtggatggttttcatcgttatcttgtcatgaaaaattctgaagaaattgctaaacgagaaggaaattgtttacctgtgtcgattattgatcgtccacttgaagatagaattgctagtaccattcgacataatcgtgctagggggacacattcaatcgaattgatgacagaaattgttcaacaattggtagaatcggggttgagtgaccagtggattatgaaacatattggaatggataaagaagagttgcttcgtttaaaacagttgagtggtttggcttcacttttccaaaatcaggaattttctcgggcttggaattgggaagaggatgaagaaatcagtgaagagtgaatttgaatgtttctttgaatttattttattcacttattgaaaagttatctataaaaaactaaaaaagaaggattattattatggaacatgaatatttgtttgtttactcaagattaaagttgttgattaaagatgctcataaatcttttaatcaagttgagcgggaacttggttatcctcggaatactttgaaaaattataagtataagaaaaaaccgagtgttggtcgtgtttttgaaatggcaaactattttaatgtgtcaattgaatttttgttaggaatggaagaaaaagacaataaaaatagtttagcttatcgtttagaaaaattgaatcgtgagaaaaaagaacttgaaatcttgattttagaaggtcaaaaataataagaaacgtttagattaatttttcactaaaatatttacgttaagggattgacacttttttgtaaatgttgtattattgttttagttaaatgaagtttcattagtggaattcatttgacttcttttcttacatagtattgaggataggttttgatgatttattctcttgaaggttctttctttgtaggaagagccttttagttctctttatttttggcttaaaagttacaaattaaatcttaaataagggcttatgttataattaagatatattgaataggaaatgagagagttatggaagagaaaaaaacttcagggatgtttgcggtttttgcggcacttggggctaatgttctggttgcaatcagtaagtttattggatttggtttatctggctcagctgcgatgcttaacgaaagtattcactcagtggtggattgtgggaatcagattttacttttgtttggtgaccgtcgttcaagacaagcgagcactaatctccatcaatttggcgaagctagggcaaaatatttctttagtatgatagtggcaacattcctcttttttggtgggggtgtcattggtgtaatggaggcctatgataagttggttcacccagcacacagtgttgaaaatgcgggcattgttattggaatcttgttgattggcatggcaattgaaggttcatcattaagagtggcttttaaagaaattagcgaattgaatacagaaaaattaccgatctttaagtttttacatgaaagtcgccatagcgaaattttagttatttttgctgaggatttatgcgcaattattggtttacttttagcgcttttaggaactgtcttgacgatggtgacgggcaattctgtttttgatgcaattagtgggttattgattggtttcttgcttatggcagcagcgattttcttaacaagagaattttatagtttaattgttggtgaacgtgtgacagatagcgatttagaaaagattttgacagcttttgatcgtcctgaagtagaacgagtaattaatgttaaaacggttcaccttggcccaacagagattttgattgcagcaaaaattgatttggtgagtcaacttgttttagaagattatgaaattattaatcaaattgaagcggaaatcagaaaaaaaattagtgataagaagtgctatatttatattgaaattgacgaattcgttcagggctatgtccaatcttcagatttataagcctaatttactgacagaaatattttaaagatgagacaagaaggagagcgcctatgaaaaatttttttaatcatattgaactgaaatttgctaatctattatcgaaaattagttttatgttgcttatggtagtagggcttttgatggtttattttctatttagagaagtttataatcttgttttacttgcttttctttctgagagtgaggttcattattatgatattttggaaagtattctctccttctttatcttctttgaatttttaactttgattatcacttcattgagaaataaaggacatgtgtcattaattttcctcttatcactcgggattacttcactgattcgacttttgttaacctatcatgaacgattggttggagtattattgattgctagtgctattctgatattaattattggtgtctttgtcttaaagaaatttgtttttccaaatgatgatacagcagactatttctaatcttgtctgacagttctgtcagtaaaattgaagacaaaaaatactgacagatttgtcagtattttttttagaattttttcaggtaaattttgtcaatatagtgattttctgttttgtgaagaataatttctgcccgatttcttgtgggctcaatatattctctgagattgacacgattgacacgtgcccatgtttcacgggctagattgattactttatcttctggcatttttgtaaattgatgatagaagtttgtctggtcatatttagctagttttaaaaggctgtcaaaacgttcgaggtaccatttttcaatgagtttttcgtcagcatcgacataaattgaaaaatcgtaaaaatcactgatataaagcagttgattttgtggattttgaagcacattaattccttctacaataagaatatcagggctgtcaatgatttgactttggttaggtaaaatatcgtaagtttcatgtgagtaaatcggaacttcaaatttttcaccatttttgacgtgataaagaaaacttgttaatttttccatatcatagctttcaggaaaacctttgcggtcgagaatccccatattttttaaatcattagtcgtgtacaaaaatccgtcggttgtcactaaatcaacggttaattttggaaaggcacgtgaaaggagaagctggagaagtcttgcggtcgttgattttccaacggcgactgagccagaaatcccaatgatgagtgggggagttttgacaattttttgtaggaaaagtcccttagagtaactcatgtcttctaaattttttttatataagcgaagaagatgaatcagtggtaaatagacgtcctccacatcttgtaaactgatttcatcattgagtgagcggattgattctaactcatcatgagttaagggagcaatcgaagtattataaagattttgccatgtttttcggctaatttcgtcaaaattaatgaattcattcatgacaaatattttatcatatttttggcttatcaaggtaaaaaaactaataaatctgtaagcgtattaaataagttactgacaagatttttacacttctgtcagtaaaagtgtaagagattacaaaataagtagaagttctaaaaatttttttaagataaaaaagggcttttatgttaaaataaaattaatggttaaaacaaatatgtattatgaagacaatcaagatttatcgcatgacttccagaccttaacagttgaattgttaggtcagtcaatgcgttttaaaacagatcgtggtgtcttttcaaaaaatggaattgattatggttctcgtgttttattagaaaactatcaacctgaaagtgcaaaaagtcttttagatgttgggtgtggttatggaacattagggttaaccttagctaaaaagtttgatttagatgtgacaatggttgatgtcaatagtcgggcacttgatttatgccgtcaaaacgcgattgacaatgctgtcagtaatagtaaaattgaactttcaaatatttatgagtctgtcagtgaaaaatatgatgcgattatctcaaatccgccaattagggccggtaaagaagtggtccatgaaattttagctggtgcttttggtcacttaaatgatggagggcatttgacgattgttatccaaaagaaacagggtgccccgtctgctcaaaagaaaatggaagaagtatttggtaattgtcagcttgtagctagagataaaggatactttattttaagaagttataaaaatatataattattgataagataaaacgagggggagcctatgacctatcggatggttgatctcattcaaaagaaaagagatggtggtgaatttagccaagctgaaatcgattggatgattgaaaattatgtcaaaggaatcgtgccagactatcaaatgtcagcacttgcgatggcaatttattttaaagggatgactacagaagaaactgctcatctcacgatggcaatggttcattcaggaaaagaattcgatttgactgatattgccggaatcaaggttgataaacattctactggtggagtgggtgataaagtaacacttattttagctccgcttgtagcgtcatttggggttcctgttgcgaaaatgtctggtcgtgggcttggacatacgggaggaactttggacaaattggagtcaattcctggcttcaaatttgaaaaaacggaaaaagaatttattgatcaggtcaaagaaacaggaattgccataattgggcaatccgatgaacttgttaaagccgataaattactctatgctcttcgagatgtcacagcaactgttgatattattcctctaattgctagttctgtcatgtccaaaaaaattgccgcaggctctgacgccattctactagatgtaactgtaggagatggggcttttatgaagtcagttgaagatgctcgccttctcgctcaaacaatggttgaccttggtaaatctgtaggacgagaaaccgtcgctgtcatcacaaatatgagtcagcctcttggttttgctatcggaaatcgaaatgaaatgactgaagcagttcatactctacaaggaaaagcgccaaaggaattccaagaatttattgcggaacttgcccaaattatgctgcaacttgcgggacttgaaaaatcaattcctgaaattttagagcattttactaatggtttagcttacggaaaatttgttgaaatggtcaaggcccaaggtggtgacccaactgcctttgactatttgacagctcctcttcaagtaaaatatcaagtggaaattaaagcagataaatcaggatttattagtgaagaaaaagccttaggaattggtcttcttgctatgaaattaggagcaggacgtgcaactaagactgatgatattgattttgaagcaggtgttactctgacgaaaaaggtaggagataaggtgagtgccggtgaagtcattgctcagctttattctaaccgcgaaattactgacgaattagttgctgaatttaatgacagtttggtcattagtgatcaacaagttcatcaaaaagaaattctagaaattatcagataagatgaaaaatgatttaaaaatcccaacacctgtcatggccctgcaagtcatcttgtcagctttggctggagcagcgaccaaattgtacttacaaaattttggttggcttattcaacttattgcttttatcattatcttcgttgtagtctatctcatcgttggaatgatttacttaagattaaaaaaatagaaagaacataaaatgcaaattaataaatatattgaccatactattcttaaagccgatgctcccaaatctaaagttcaacaaataattgatgaagcaaaaaaatatgattttatgagcgtttgtattaacccaacatgggtaaattatgccagccaagaacttaaagactcagacgttaaagtatgtacagttattggttttcctttaggtgctaatacttctgaactcaaagcttttgaagctaaaaacgctattgaaaacggtgctgatgaaattgacatggtcattaatattggtgcagccaaatctaaggattgggatcttgttgagtcagatattgcagctgtcaacgcagtaaaaggtgataaacttcttaaagtcatcattgaaacaagcctcttgactgacgatgaaaagattaaagcttgccaaattgctaaagcagttggtgctgattttgtcaaaacttcaacaggcttctcaacaggtggagcaactgttcatgatgtaaaattaatgcgtcaaacggttggtccagatatgggagttaaggcttctggtggagttcataatcttgaagaagcaaaagcaatgattgatgctggtgcaacacgtcttggtgtttcggccggcgttgcaattatggaaggtctgacttcaaatgacaactactaaaaaaatgattgctgccgcacgcgaagcggcgagtttggcatatgttccttactctcattttcctgtaggagcagcttttcatacaactgatggtcaaattatcacaggttgtaatattgaaaatgctagttttggactttctaattgtgctgaacgaacagctatttttaaagcaatatcagaaggcctgaaagattttgatgctctttatgtattcggagaaacagaagaaccaattagtccttgtggtgcttgtagacaagttattgcagaattttgtccagcagatatgccagtttttttgatttctaaaaatgaagatgtaaaagaaacttcagttgaggaacttttaccatattctttcaaaaatcttgattaaaataaaattgatatgctatcaataggtagcatattattttgtaactaaagtaagcgctttaacttttttcttttaaaaaatgtaaaaatggtaattactgataaatatgaataattcttagtaattgataggttatttccgaacatttagcgagaaaaagggatattcagcttatttggacttgcaaaaaggctaaatatatcttaaaatagtcttaagctatatttagccaaacaaaactcggaggataccctttccatgaaaaaacgtgtaatcgcagttagtgctctcgcacttgcatcagtcgcagtccttgcaggatgccgttcacatgacgcagccggatcaggtaaagcaaaaactgaccttaaagcagcaatcgtcaccgatactggtggtgtaaacgaccgttcatttaaccaatccgcttgggaaggtcttcaaagctgggggaaagaaaataacctgaaaaaaggtacaggatacacttatttccaatctaactctgcttcagattatacaactaactataactctgcggaacaacaaggctacaaacttttgtttggtatcggattctctttacaagatgcaacatcagctgcagcaaaaaataatcctaaatctaactttgtaatcgttgactcagtcatcaaagaccaaaaaaatgtggcatcagcaacttttgctgataacgaaagtgcctaccttgccggtgtagctgccgcaaaagcaactaagactaacaaaattggtttcatcggtggaatgcaatcagatgttattacacgttttgaaaaaggttatgaagctggagctaaatctgtaaacccagatattaaagttgatgttcaatatgcgggatctttctctgacgcggccaagggtaaaacaattgctgcggctatgtacggtgctggtgatgacgtagtttatcaatgtgctggtggtgtaggaactggtgtcttcagtgaagctaaagcattgaactcaactaaaaatgaggctgacaaagtttgggttatcggtgttgaccaagaccaagaatatcttggaaaatacaaatctaaagacggtaaagattctaactttgtacttgtatcaacaatcaaagaagttggtaatgttgtaaaagatatcgctgacaagactaaagatggtaaattccctggtggaacaatcgttacttatgaccttaaaaatggtggggttaacttaggacttgacagtgcaaattcagaaatcaaagatgcagttgctaaagcaaaagcagatattattgatggaaaaatcactgttccttcaaaataattgaatactgataaaagataaaaaagagttagttatattaactaattctttttttataaattaaaagctaatagaagataagatttgcgattattttaaatgttctttatttgtaagtcatatgaactgtgatataatggtagacagatattaaagtggtatatattgttattatttagttagggggaactatggcaagaaaatcagtaccgaattatgtaaaaatacatgatgccttaaaagatgaagttgaaaaaggcatctggaaaattggacaacgtcttccaagcgaacgtgatttggctgagcgctttactgtcagtcgaatgacagcaagacaagcggtaacagctttggttgatgaaggaattcttgaccgtcgtgtgggttctggaacttatgttgctagccgacgtgttcgtgaaaaaatgcgtggaacaacttcctttacagaaattatcagctcacaaggtaaagttccttcaacagaagttttgagttatattagaacggcgccaaatgaggttgaatgtgaaaaactaaatatcaccaaaaaggattcaatcatccgaatggagcggattcgttatgcggataatgttccaatttgttatgaagtggcaagtattcctttcaaattggtcaaatcttttgataaaaaagaaattacgagtaacttctttaaaactttagaaaatcacggacatgtgattggtcgtagtgaacagattgtttcagctaaaagagtcagtacagaggtttcagagtatttaaaaacaagagttggagctgctattcttggcttaactcaggtttcttatttaacagatggtacagcttttgaatatgtcttatctcaatatgttggtgaccgttttgagttttatttggaaagataaaaaggacttagtgaagtcctttttttacttgccgacgatatttgtactgacgaagttgaaaatgaatccaacatcctatacaaaaaccacttaaagcaatagaagcggctaaaaagacaaaagctgcaaagattattgctaagataggatgattagtgattgaggaaatcaaactagcacttaatagagcagtagcgataatttgattgaagcgaaggtctgatttatcttcgagcacatattctgaagctttcttctttagaaagcttttggcgattaaaataataaaatttttctcgaaaagaatgccagatagtccagcgagaataggaagtagtagaatccaatagaaatgagtgatgactgccaaaatgacactgagaacaataaaagtttgattagtacgaacgagtgggcgaggaatgccctgaaatgtatatttagccataaaaactctccaatcttgataaattgattttatcttaattggagagttttggttataagatttttttaatttgataagtaaatttgttgaaggcttcaattagagatttacggtgaaagttgtcccttttccaagaatggatacaacgtcaattgttccgtgaagctcttgaacatttttctcaacgatagcaagtcctaaacctgttccattaacttctgcacgactttcatcaacccggtagaagcggtcgaaaattcgctctttttgaatttcactaagaccaggaccattgtcagttacactgaaaatgactttattttgttcaagatgtaagctgacaaaaatttgtccatttgctggagtgtatttaattgcattttcaatcaaattctcaaaaatgctatgaaccatttgttcattggttttaaaagtgatttcttcaatttgggattctaaatgaagtgatttttcattaatttgtggtcctgagctttggagaatattttgtatcaaagctgaaagattaattttctttttatcaattcgatgattttgtttggtcaaaagcagtgtatcctgaactaaattcatcaggcgtgaactttctttattgataatagatgcgaaattttttgtgtcagaacttgaaattgaatctgtttccagaagttcagcgaagcctttgatagaagtaaggggagtttttaattcatgagaaacgttagcaataaaagcattgtgggcatccactgttcgacgataagagctaacatccatcatagtcaccataaatcgactatccaaatcaggtaaaggagtgatacggacttgataataagccccaagtttttcaaaatagaaaagtttttcttgaatatcaggatgtaaaattttatcaacaagaaaatttaagaaatcagcataggggctgaaaatatctagattttcagtatctgaaaattcatttttgaaagaagcattggtccgacgaatttttcctttattattataaatgaaaattggaaattggaaaaattcaataaattcgtagagattttctttcttttcagtatgagagagcgcttgtttctgaattttttcgcccaatttattgagctcagttgtaattttatcgtcgttctcattcatcaaatagctttgagttaatggactacgctcgatatttttaattttagcaacggtattttctcgaaaaacataagctctctgagcagaacgtaaaacttggatggcgacagccaagtaaaataaaattgcaaaaatgataatggcaaaatctgtaaagaaagtagaggtacgattttctgtaacctttagataaccgttaatttgaccctcgctaaatatgggactggtcacggttatttcttgagaatctaaactacgtgcgtaagtcgcaccctttttaatttttttagtatccgaatttactgtattctttggaagatgttcaaaattatctggcagaggattatcaggatgtttttctaaaaagagttgtattttatctattgtttttaatactcgatttgtatcattttctaagatattttggttcgatagaatcaccaaacttaaggtcgcaataatatataggaccgtcataagcatgatgtgtttaagtttcattttcttcaaaatagtatccgaatcctcgttttgttttgatataatgattatttaattttttacgaattttagaaatgagcacatcaatggtgcgggtttcagcagtgtctgaaattccccaaaaatgttgtaggagttcttcacgactgacaattttcccctctcttttagctaagagctcaaggatttcaaattctcgtttggttaaatctaaaactttttcgtcaaaagtgacttctttttttataaaatcaatgaccaatctgtcagtaactaatgatgaaggactttcatctaaagattcactgacagtttcggagggtgcttggttatacatttgatttctgcgaatgagcgcatcggctctgacaatgatttctttcattggagtcgttttatctaaatactcatcagaacctgctgacagccctgtcagtttcatttcatcatcatctcgagcagttaaaattaaaattggtgtaaaattaccttctttacgaagtttttgggtgacttcaattccggaatattcgggcatcattaaatcaagtagaagtaaatcaaagggatttttacgagctttgtcataagcttttttcccgtctgatacaatagttacttcgtaatcattttgccgaaaattataagataaaagggtcaaaattgcccgatcatcatcagcaattaaaatttttttcatacttttaattataacgaaaacagggagttttgtatagaataaattattaattttagctaaaaaaaataatggatacttagactttgataaagataaaaaaattacattttattattttaaatcatcaattagaaaataatgaataaacataaaaaatgatataaattttgttataatagagcttatggaaatcgaaaaaacgaatcgaatgaatactctttttgagttttatgcgacactcttgactgataaacaaatgaattatattgaactttattatgccgatgattatagtttggcggagattgctgaagaatttaatatcagtcgtcaagctgtttatgacaatatcaaaagaacagaaaaagtacttgaaagctatgaagaaaaattacatctttttagtaattatgtagttcgtaatcaattattagaagagctaatgaaaaaatattctactgaccaatatttaatcactaaactacaagaaattcaacaaattgatgaagaagagttttaaagaatttactgacagatatttttttattactgacagctttgaatcaactgataaaggaatctgtcagctcacctttctcatataaaatacaaactttaatgaaattttactgacagaaaagttaaaatatgctataattagacttcaaggttcaaagaattactaacagaataatcagtaggtctctccctaaatttgggggcgttacggattcgacaggcattgtcgcgcatgaactgcaactgctgagggatcaggataatcatccgcagataaatataactgctaaaaataatacacaaacttacgcaatggcagcctaaacagcaccatgcgtgcctgatttttgctcactgatggcaatttgacggcctaaacttttagtcagatacgttgttgtggaggcttgacgcagcaaaagagatttaaagccccgcaaaatgtcgctgtttgagactggctttggcattttgttaaatttgagaaagtcctatggttgtagacgttgatgtagcaaggtgtttggacaggggttcgactcccctcgcctccattgaatggattttatagaatccaaaagtattagaaatcgctcaacagagcgttttttattttttataatccgatatgatacgatacaatctgataaaagggagggagaaaaagagggagaaaaaataaaaaaaccagtttattaatactggttaaaaatcaatataatcggaaaattgttgccctattttatctttagcaaatttagtgatatgagtataaatgttcattgttgtttttaaatctgcatgtcctaaacgatattgaacttgttttaaactcatgcctgattcaaaaagcaagcttgcgtgagtatgtctaaatgcatgaattctgattggttcaatgtctttttctttggttatctctaaaagccattttctaggttttgaaggtgatagcatccctccattttcagattcaaaaattcgtgtagattcaggataggtttggtgcaattcatcaaggattttacaagttttttcatcaaggcttaacaatctgtttgaattagctttagggggaagtatttcatatcctacaggagaatgagaaatagccttgttgatgtcaagagttgattttctataatctttccattcaagagcgagaagttcacctttacgaattccagtaaaagcaaggatacgaaataaagctattttcttaatatcattcgttttttctactaaagccataaaatctcttaactcatcagtatcataaaaatctttcttttcttcaacctttttcttaattccttgagaggttacaggagcggctggattggcttgtatgtaacttagtagagcagcgtgattaaataccttgcgaaccattccgaatagtttacgagcgaatttaagcttcccagataaatcatttctaaaagtttgtagatccataggcgtaaaatctgatagtttagtactccctatgacgggtaagacatgtttttcaaatgctctagtagttttgtagtaagtactgttctgtacttccttttcataaaccaatagccattcatcataaagttctttaaacgtcatagcactttttggcgtaggattatcaatttcttcttggatactatgcaaagctgctcgtgcatcagctttggttttaaagccacttttttcagcgtactggcttttaccgttcttttttccaatatatgctttgaatttataagcagtagtgccatttttctttttatatgcttttatttccaaagttgctttttatacctcatttctgataaaatggtatagtaaaaagcttattaaaagcttttgtactacttcatactttaaatccgcccctcgtcgccaaacttgggcggattttttatttattaataaaatacagctattaatgcgggtactgtaattttccctcctaaagtagaggtataactatatagaccataaacatttccataaattgttatttgatcatcttcaagtagacgatgtttattccaattatctgaatctatttgtaccatgtatatatcatcgtatccgtctgctccagtagcgacacgaagcattgcccctccgctatccatgtcttgaacttggattactttacctgtaatttgtaatttttctccttcatgactattaccgtttctagccatttcatcatatgtagaagttggataagtagctgggtttgttttatcagcttcctctttagccttagcgtcagctgcagctttagccttagcttcttcatcagctttagctttagcttcagcatcagcctttgctttagcatcggcttcttttttcttaattacttcagggttctgtttgatagtaatttctttagtggttttaccaccatcattttttgcagttacttcaattgtatcttggtcgttggcttcatcaatctcatattttagagtgaaattgccctctttatcagaagtcactttgtcaccaataataccatatccaatttggacttttgtatttggtgttgttttaccagtaattgcagcagtttttgagccgtctgcaacaactgacacagggatttcaagcgtaggtttattacttgattcagttgtgcttttttcgccactattctttgaacccgaattactactcggagaacatgcagctaatgaaatagcagtaagcatagttactccaataagtgctatttttttcataatgtttatgttcctaatctagctttttatgaggatcaagacattgctcgtttttatatttgcattaagcatcaaaaatttcagtcacttattttatttatggttttctatagcttgcttaatttcgttttggtataaagcgatatcaatagtggtatctatctcaaatgtaccagcgtcacgaatttctattaggttttttgtcgctttttgataaaatctaaaaacccattttctgttattgtcatcaattaaaattccaaaataactctttgtatcacgatagtataagcgtgaaggatctatgaaatctttggaagcaactttaaatacggtgaaagcttcaagctcttcaggagtcgtaatgattccgttgttaggagtattttctgataattcttcagattcatcaattgtctttgtttctacacttgtattcaaagctgccgaaagtttttcgtttactctttcagtaataaattgattgaagccttttttaatgatcggagaaaatttttcaagagtactctttgtttttattccgtcgtatatttgtgataccaaataagccagtaaattcccacattatgcttatgggcaagaaagtcagcacagaaatgggaacacaataatagtcggtgattattatcacatccaaagtaccgtcacttatgattactatggtacggacggtacctatctaggacaacaattaaccacggggctttataacaagccatattcggtcaatgtgccttatcgatttggcaattactatatcgaaggaagcacgacacggtcaggattttatccaaaatacgatgaaacgcttaatgtttactataaatacgtcccaccaatcgtttattataatacaagcaatccttatgcgacgacttactatgtcaatggttatgaatatgtaccgaattacattgcgccagttgtttattatgcaccaacttatggctattacggtggaggcacttcttactcaggcggtaatggttattcatcaggaggaggatatagtaattctagtggtgcttactatccgacttatgttccacaatttgcttattattctaaagaagctcaacttgtatcagaagaaaattattatagtggagccagtacatactcactgccaaaaaccgggaataagggtgcagcttgggcgccagcattaggttttggactattgacagccgaagatgcgggagaaagtttagaagtgccacctgtagcgattggacttggagtcgttgctctggtatctttggtagttgcaggaggaatttggttatttagtgatagagaaggtcctataaataaaccaaatagaaagaagcaaggaagggaactaaatgaagaaaagaaaaatgatccaaagtggaagggaaatcccaacaagaattctaaccgagcaatgaaaaaacatacaccaagtaagaaacataacggaggaaaataagatgtttgagccaaaactatggactaaaccaacaaatacaaagtggcttgttaaagaaatatctcaatatttggattggataataaaaaaagaaatttttgatggagaaataaatatctttcttacaaatgctaaatttgtttacgattctagtgctagaaaaagagaaggaaactttttcggaccttttgataaatcaattattccgtcactttattttccgcttggagatatttttaggacaatatctcgtagaggaaaagaaaatgcggtctgtgattggctacaatatttaacgctctttctctatgattatgtagattggcaagaagacagggagttcaatagtgaattaaacaatgatttagcagataaaatgatttatgaatatatagattttaataaaattagctttgaatcagaggataggaggaaaaaggaaaatagaaagcgagcaaaaaataaggggaaaaagaaagaaaaaaagaaagaaaaaaagagaagacacatgaaaagaattggaaaagagtttctaaaaaaataaatgaaggatagaaaaaatgagaaaatcgcgtacaatgatagctcagaaaatttagacgatatatttttaatcaaagataaaaataaacctaaagcaaataaagaaaggagcagtgaagaaaaagcaagggaaaccaatcaaattgtggataatcttaaaaagatgcaagagcctggaaagagatggaacgaagaacagaagaatgaagttcactatgaaagaaatggactcgttagatttgaaagccttactaaacaaaagccaagaaaaattaaaagaggaaaaagctatcaagtgtttatggaaaatatagatatttatcttgattctaatgaggttagattagaaataaaaaaactgcttcaagatactaaagattatttacttcaaggagtctttgatgtttttgatgctaatcgttatcttagaggtaatatttattttttagttcataaagggagtcaattaaatgattatgaacgaaagattctaaaatcatttaaaaataaaccatatttaaaaaatatcattacaatcattagtatttgtgtgataacatacttaatctttaagtatatttaagtgataaaagatttataatgaatatgaaaaaaatagaagagcataggctcttctattttttatcatacctcaatcccatcgcattgattgagacaatcacggttgagattgacatcaggactgctgcaatgagagggtcaatataaatccctgtaaatggataaagaatacccgctgcaacaggaatagcaataatgttatagcctgctccaaaccagaggttttgtttcatttttctaagcatgcgtttggagatattaatcatatccaggacgtcacttggattggagttaactaggacgacatcagcggtactgatagcaaccgaagttcctgctccaatcgcaaaaccaatcgtagcagttgcaagagctggggaatcattgacaccatcaccaatgaaaagcacgccggctttcttttggtactctttcacaatttctgctttatcttcaggttttaattctgctctaaattcgggaatatttagtgcactagcaattttttgagcagtttctttattatcacccgtgagcataacaggggtaattccttgggctaataaaccattgataaaggctttcgcgtctgctttaggagaatctcctaaggcaataaatcctaaaacatcttgttgttcattgattaggaaagatacagttaaacctaaatctaaatattgagcaatcttttgttcatcataagaaagttgattttcacgaagatatttatagttaacaatttgataaaagttttgattaacttgccctttaattccaactcctggaatattttcaaccgcttcaacttttagattttcaagaggtttagcagctgaaacgattgattgagcaatcgggtgagtggaacttccttcaagtgctgccatgatttggagaatgtctgtttcatcagtaaaatcaataacattacgaacaataaacttaccgtcagttaatgttcctgttttatccattaaggcatatttaattgtatttgttttttccaaagaggttctgttttgaattaataaaccatttttagcagaaatactggttaagcgagaaacaacaagtggaaccgcaagacctaaagcgtgtggacatgcaattacaaaaacagaaaccgcaagaagtagagcaaaactaaagttggaactaattgtccaaaaaattaatgagaagataccgacaataagtgcggcatagaaaaggtaaccagccactctatctgccatattttccaaattagatttttgagcttgggctttcttgactaattcggccacttgattgagaaatgaatcttttccaagggttgtgactttcatctcaaatggttggttttgattgagggaaccaccataaacaaggtcatttatttttttattgactgctcggctttcaccagtaatcattgactcatcaacgagcgcttcacttaatataaggccatctgcaggtattttttcattttctttcactaaaagtaaatcgccaacttttagttctgaaagctccacatccttcccactttttaagtgagcttttttgggaacaaggcttgctaaatctttcaatgcatcgccagcacccatgattgctttcatctcaatcaggtgaccaatcaacataatgacaattaaagttgccagttcaaaccagaagttcatgcccatatgtccgttaagactcataattgtggcgtaaacagaataagcataggcaacagtaattcccattgtaatcagcatcatcatggctggcttacggctttttaattcaccttttgctccgctaaaaaaaggagtcccagagtaaaagaagataattgtaccaaggatgagttgcaaaatttcacttccaggaaatttaaggattgtaaagcccgcgattggtgaaatgagtagaagcggaatcattagaataatggcaactttgagctttttactcatatcacccatatgcatcatgtgtcctccatgattcatcatatccatattgtccatatcatgcatattatccatattgtgcatctcatggttttcgtgctccatatccatcatttcatgactatgatgatgctcagacatcatttcatcgtgattagacgaatgagttttatttgacatattttcctcctaaatgaatgctttgaattttctatctatatacagtttacaattgtaaactatcaaagtcaagggaaaagctgtattctataaatattacaaaacaataactaaaaggtttcttttgtgacctaaatgtgatattataatatatatttatagcgatactcaataaaaaagtatcggcaaggagagaataaatgaaaaaaatacggccagaagtgactacggttacctccaagtctcattttcgaacttggaaatcagggaaaagttggttatttgctacttcagcattagctataattatcgtttcaggaacgattactgaccaaaatgtaaaagcggacacagcagttgacagtagtcagcaaattagtggtattactgaggtaacaagttattcagcactagcttcatcgacaaatagtgatgtagctgctagtcaaaatcaagttgcttatgaacaagctagtgaccaaagttctaataattcactggctaacacagtagaaactgatactgagggaataacttcaaatgtgtcagatagtagcaattcaattaatgaaagccaaaatacgacaagtacagcggttattcaaactcctacaaacaatatcgtatcgcttgcagattcaagctcatcaaatgataatggcagcaattctatattaagttcttctaatgctgcagacagcgttgattcggcagctgtctctcaaagttcaacaagttcatcagtaattttgagtgaaagttcagcaattgatagtggtattggatcaacttctcaaagttcggaaatgaatcttgcgggaaatagtagtgctaatgcttcaagtgctgctgttgcttcttttacggctattctagcgactaattcgtctatggtactaccaatacttactcaggcactagctgcagcagcgcctgctacaacaagtagttcagctattcttaacacaacactcggagatcttgtaaatcaagcaatttcaacagtaggaattagtggtttagcaaatatttttagcacacttggaacttttaatattccaggaatgactacagctgcggcagctcttaatggtgttgaacaaatcgtcaatattgttggaaatatccaggaagcagctgctaatcctggagcctttctattaagtggaatgaaatctgcaggtttagatgttagccaaattccattagttggagggcagattgtggcagcatttaatgctatcccatcaatgagccctgctgctatgcttacttttcttgaaaatccaacaattccaggactttcaagtattccgggggcaagtctagtactaagtccagtactaagtccagtacttagcgcaataagtactgtaacaagtgggattgttaatcaacttaatacgacaacttccaatgccttgggtggtgttaattttgatttagacacacttgtctctcttcaaggaaatgatcttgtcaactacttggctggtttagtagttaattcagcgattaatcgagtaggtcaaattgcttggagtcaattatctccaactattagtaatattcctcttgtaggtactacagttaataatgttttaagcccaatattaaataatcttactggagcatctttgggtgaagttgcgaatttaacgggagtttccagccttcttgaccaagtaaataatagtttgggtaatcttacaagccttggttcaacagccttagccactattgagaacaaagtccaaaatagtctaaactcacttggtaatcttcctgctggtgcttcggatattcttaaccaagtgctcaatcaattgcaaaatgctatcaataatattgttgaaagtgcgacggggattgtaaataatttaccaggtcttggagctatcgaaaatggtctttcgaacactattagtcaaatacaaaataatattaataatttcgttaataatgcacttaatggaataacgacaattatcaattctttaactccaagtgttggtgcttcaacagttaatccaaattctagtgctaatagtagccaatcaagcagtagtgccagttcttcatcaagtgcagctagtagttcaacttcatcttcaaatgtatcaagcaacacgagttctaattctagtgaagtaaatacttcaagttcgacttctaatgcttcaagctcaagctcagagggttcaagttcttcaagttcaaattccagcgaaagtagtgccacaagttcatcctcggtagactcaaatcaatcgagttcagctggggtaaatagttcaaattcaagctcagaagcttcaagcatttcgagttcaaattccagtgaaagtagtattgctagttcatcttcggtagactcaagtcaatcgagttcagctggggtaaatggctcaagttcaagctcagagagttcaagcgtttttagttcaaattctagtgaaagtagcattgctagttcatcttcggtggactcaagtcaatcgagttcagctggagtaaatggctcaagttcaacctcagagggctcaagcgctttaagttcgaattctagtgaaagtagcattgctagttcgtcttcggtagactcaagtcaaacaagttcagctagagtaaataattcaaattccagtgaaagtagtattgccagttcatcttcggtggactcaagtcaatcaagttcagctggagtaaatggctcaagttcaacctcagaaggttcaagtgcttcaagcttaagttcaagcgaaagtagtatgacaagttctggtgggacaagtgattcaaattcaaacactggtcaaactagtactacaagttcatcttctgaaaattcaagtcaatcgagtctgagttcaaatgaatcaagtagtgcaagtttgacttcatctgagtcaagtggttcaacaacatcttcaagtatgttgactaatccaaatttacaatctaatgataaaaatggctcaagtctaacttcaaatagttcgtatacttcagaaatgaaactaaataacttgagtgattcaaatttaccttcgaatgaagcaaaagtttcgactttaatttctaaggtatcaagtagtccaagtctttcaagttcattaagcgcaacgagcttgcaaattgtaccaactgtaacgaaagaagagcttcccaaaacaggtgctgtttagtattagcagagttgggaataggcttagtggcaacgttaactattggaaaagttaaatataaaaaaaggttttgagtagtatattttaattaaggacttcttttctttggaaagaagtttctttttaatttggaaattcttcatttattaaaaattacgaacaatttaaaataaataaagaaaaatgaatgatgatgattagaggttgaaagttagcttatggtataatagttctatgaacttgatagatggaaaagcacttgctgctaaaatgcaagctgagttgaaagttaaagtcgataaattaaaagaagcggacaatgttccaggtcttgccgttattcttgtgggcgaagatcctgcgagtcaaatttatgtccgaaataaagcacgacaagccacagcaattggtttaaattctagtgtggttcgtctaccagaaactgtgtcagaacaagaactgttagatttaattgaacagtataatcagtcagaacaatggcatggtattttggtacaattgccattgccagaacatatttctgaagaaaaggttttactagctattgatccagaaaaagatgtggatggttttcacccaatgaatatgggacgtttgtggtctgggaatcctttgatgattccctcaactccagccggtattatggaaatgttccgtgaatataatgtggaactttctggtaaacgtgcagttgtgattggtcgttcaaatatcgtcggaaaaccaatggcgcaattattaatgatggctgatgctactgtgacaattgctcattcaaaaacagaaaacttgcgcgaattgactaaggaagctgatattttggtggttgctattggccgtgaccggatgattaaagctgaggatgtcaaagaaggtgcagttgtaattgatgttgggatgaaccgtgatgaagatggaaaacttcatggcgatgttgattttgatgaagtaaaagatgttgcaagtttgattacccctgttcctggtggagttggtccgatgacgattacaatgctcatggaacagacagttcgtgcagcaagtagaaaaatgaatgaaaataaatagttaattaataaaagagtaactaagtttatagtaatttctaaggacttatttttaagttagaagttttttgaagataaactttttactttttttcgattttagcagtagaaattttattaacagaataattagtaaaaagattaattgagaactaaagagtgagggaatgacagaatatttatcagtatcaaccttaacaaaatatttaaaagcgaaatttgaccgtgatccatatcttgaacgggtttatttgacaggagaaatttcaaattttagaagaagaccaaatcatcaatattttgcacttaaagatgagggcgctgtgattcaagctacgatgtgggcgggacaatttcgcaaattagactttgaattagaagaggggatgaaagttttggctgttggtcgaatcagtatttatccaccttctggctcttattctataaatattgaaagtttagttccagatggcgttggagctcttgcggttaagtttgaacagttgaagaaaaagctgactgctgaagggctatttgaacaacgttggaaacaaactttgccacaattttctaagaaaatagctgtggtaactagcccgtcaggagcggtcattcgagatattattacgacggttcaacgtcgttttccgatgagtcaaatcattctttatccgacaaaagttcaaggacaaggttcggctgaagaaattgctggaaatatccgtcgagctaatgaacgtggtgattttgatgtcatgattattggtcgtggtggcggttctatcgaagatttatggggatttaatgaagaaattgtggttcgagcaatttttgaatcacgtattccaattatttcatcggttgggcatgaaacagatgtgactttagccgattttgttgctgatagtcgtgcagcgactccaactgcagcagccgaattagcaacaccaaatacgaaggttgatttaataaattggacgaatgagcaggaaaaacgactttttaaccgcttaacacatttaattaaaataaggcgtgaacgagtagataaattaagccagtcagtagtttttagacagccagaacgcttgtacgatggacacttacaaaaacttgaccgtctgtgtgaacgtttgtcagtgctgacggaaaataaagttgcaaatatgaaacaccgttatgagctgtcagctgggaaattaattccgacttacggaaagatagttgaagctaaaaagaataagacggagcaactttatcagtctttacttttattagatatctcgaaaataaaagcgcgtggtttttccctcgttactgacgaaaagggaaagattattaaatccgtaagtgatgtgaaaaaaggtcagactttagatgttgaattgactgacggaaaagtaatagtggaggtaaaataatggcaaccaaaaaagaagatgtaaaatttgaagataatttggtagagttagaaaatattgttcgtaagttagaatctggtgatgtagcgttggaagatgctattgctgaatttcaaaaaggaatgaaaatttcggaaactttgaaaaaaacactcaatgaagcggaagaaacattagtaaaaatagttggaaaaaatgatcaggagagtgatttctctccggaacagaaagactactaaaataaaaaacctttgatttttcaaggttttttattttaaacaaaattttactgacaaaaaagcctattattctaatatcaatcttatttattatatactaatagtagatagagttatggtcaagtcttttatagaaagagtagattaaatgaagaaaaaatttgtattagcgccagattctttcaaagaaagtttgagtgcgctggaagtttgtcaagcaatggaaaaaggaattaaaaaagtatttcctaaggctgaaataatttctatgccaatggctgatggtggtgagggaacaacagatgctttgattgatgcaacgggtggacgacgggtatataaaaaagtacaaggttcatttgcaaatacaaatgtagaggcctattttggtattttgggaaactcaaatacggcggtcattgagatggcaaaggcaaatggtctggaattggttgctttggaagatagaaatccattgattacatcaacctatggaacaggacaattaattaaggctgcaatggatgaaggagtagataaaatcatcattggcattggtggaagtgcgactaatgacggtggctctggaatggctcgtgctttgggagctaaatttttaaataaagaccaagaagagattccacttggtggaggtttccttaaagaagttagaacaattgatatgagtgattttgacccaagagtggaagaaattgaaatattaattgctactgatgttaccaatcctttaaccggaaataatggcgcttcttatgtttttggaccacaaaagggagcaactgaggaaatggtcaaagtattggatgaaaacttgaagcattatgcagaaattgttcataatgaactggggaaagatgttaaaaataaaccgggagctggtgcagcaggtggtttgggagcaggtttgcttgcttttaccaatgcaaaaatgcaattaggaattgagcttgttgcacaaacaatatacttagaagataaaattaaagaagctgattatgtatttacaggtgaaggtggaatggattatcagacaaaatttggtaaagcaccctatggcgtctgtaaaattgctaaaaaatacaaaaaaccttgctttgccttggcaggatatattggggatggagcagatgttctttatgacgaaggaatgaccgctatttttggtgttttgagtcaagcacaatctttgtcagatgccttggctgacggcgcaaagaacgttgagcgaacgagtgaaaatattacaagagtattagcaatgaatgagcaaaaggctcacttataaaaatggaatggatttaaaaaataaaaaaatttcctcaaatcatcacggtttttagccgtgaattttggtataattagggtaatggatacgaagatactaaagttagaagactttttaactgaattttatgaaagcgctgaatttccaactggcttagccgaatcagcaaaatattctttattggcaggcggtaaacgaattcgccccctcctttttttaaacctattagaggcttttgatttagaattgagtaaggctcattatcatgtggcagccgcacttgagatgattcatacgggttctttaatccatgatgacttaccagcaatggataatgatgattatcgtcgagggcagttaactaatcacaagaaatttaacgaggcaactgcaattttagctggtgatactttattttttgaccctttctttatcctttcaactgctgatttatccgcagaaataatagtagcgttgacgcgtgaattggcctttgattcaggttcttatggaatggttgcgggtcaaatcttggatatggctggtgaaggaaaagagttgacattggctgaaattgagcagattcatcgcttgaaaactgggcgacttttaacttttccttttgtagctgctggaattgttgctcaaaaatcaacggatgaagttgaaaaacttcgtcaagtggggcaaattttgggattggcttttcaaattcgagacgatattttagatgtcacagcaacttttgctgagcttggaaaaacaccaggtaaggatattttagaggagaaatcaacatatgttgctcatttaggacttgagggagcaaaaaaatcactgacaggaaatttgtcagaagttaaaaaattactgacagacttatcagttactgacagctctgaaatttttaaaattattgagcaattggaagtgaaataaaaaaatagaaatataaaaagaaattattagttacatttctaagaaaaatacgtataattactataaagaaagatctacatgaaagaaagaattgacgtacttgccacgaatcaaggtttgtttgaaacacgagagcaggccaaaagaggagtaatggctggtctagttgttgatagtaaatcaggagaacgttacgataaacctggtcagaaaattgatgatggaacagaacttcgtcttaaaggtgaaaagttaagatatgttagtcgaggagggttaaaattagaaaaggctcttaaagaattccatttagaaattaatggaaaaacttgtcttgatattggttcttcaactggtggttttactgatgtaatgcttcaaaatggtgccaaattagtctatgctttagatgttggaaccaatcaattggcttggaaaattcgctcagatgaacgcgttgtcgttatggaacaatttaatttccgaaatgctgttttagctgactttgaacaaggaagaccgtcatttactagtatagatgttagttttatttctttagatttaattctaccaccactttatgaaattttggaggaaaatggcgaagtagcagctcttattaaaccgcagtttgaagcgggacgtgaacaagtcggaaaaaatggaattattcgtgaccctaaagttcaccgaatgactattgaaaaagttttaaaaacagccactcaacttggtttttcagtaaaaggtttgaccttttcgccaatcaagggtggggctggaaacgttgaatttcttgtccatttacttaaagatggaaaagcagaaattgctcagcaggttaatattgaatcagttttacaaaaagaaagtgaagaactatgaaaagagaagaccgattaaactttattgctcaatttatccgtgaaaacgaaattaaaacgcaagaagaacttgtgaataccctcttaactcatggaattgacgttactcaagcgaccgtttcccgcgatattaaatcacttgccctaatcaaggtgccagctgaatctggtggttatcgttatgatttaccaaaaaacaaggaagttttacagtcaagccttcataaagccttagcttttgatgcaattacgggaacaaaaatcaaagataatatgctctggattcttgctaatccagggacaacaagtcttgtgaaaaattatcttttggaagaatatagcgatgatattttttcaatcattattgatgatgatagtgctttagttatttttgaaatggaagaagatgctaaaaatctttataatttactgacaagaatattgtgacaaaattctgctgaatattttgagcgaattaatagctgtcagtaaaaaaagaatcaaagtaggaaagataaggttattaggttactgatagccttgtcatttatttttgagaaaggaaattttgatgttacaagagatttcaatcaaaaattttgcaattattgaagaaattcatctatcctttgagagtggaatgacgattttaactggggaaactggtgcgggaaaatcaataattattgatgcaatgtctttattattaggtgggcgtgcttcgagtgattttgtgcgacatggggcaaacaaagccgaaatagaaggtctctttttctttgataaaactccagaattgaaggcggtattattagaacttggctttgaagaagtagattctgaaattattttaagacgtgagatttttgctaatggtcgttccgtttgtcgaatcaatggtcaaatggttaatttagctacgctaagacaagtgggtgaattattagttgatattcatggtcaacacgatagccaagaattgatgaatccgaaaagccatcttcgtttacttgatgaatttggtgacgaagtctttgatcagataaaaaataattacaaactcaaatttgaaaacttcaaaaatttgcgtcaacagctcaatctacgacaaaaaaatgagcaagaatttgctcaaagaattgaaattcttcaatttcaggctgaagaaattgaagcggcggaaattaatcttgaagaagatgaacaattagttaatcgccgagaaaagttaaataatattaaaaatattgctgattcgcttagtagtgcttatctagcgcttgatgatgaagataatgattattcaagtcttaataatatccgaacaacaatgacagaattggataaaattagtaattttgataatgactatcaagaacttgctgacaagacagctgaaagttattatgtattagaagaagttgctaatcaaattcaaagaatcatgagtgatttagaatttaatccagctgaacttttacaaattgaagaccggattatgaccttgaccactttgaaaaaaaaatatggcccagaactgtccgaggtgatgaactatttagagaaagtccaactcgaactctcagaactgacgggttcagaaaatgactcagaaaatctagaaaattcagttaaagttgcacaagttcaactcattgaagcaagtaaaaaacttaatgaagcacgccataaaattgccaaagaagttgaaaaagatattaaacacgaactttctgagctttatatggaaaaagctgatttcaaagttagttttgaaggggcaaagttttcgccaaacgggaatgagcatgttgaattctttattcaaaccaatccgggagaaggatttaaaccactggcaaaaacagcttcgggtggtgaactttcacgtttaatgctcgccataaaatcaagcttttcaagacgggaaaataaaacagccattgtttttgatgaggtcgatactggtgtttctggtcgtgttgctcaagcgattgctaataaaatatataaaattgctaggcatggacaagttcttgcaatttctcaccttccacaagttgtggccattgccgacagacaattttatattgaaaaagcttcaaccaatgacattactacttccacagttagaaaattaaacgctgaagaaagagtaaatgaaattgcgaaaatgcttgctggtgaagatttaactaaagaagccttagctcaggctaaacgtttattgagcaaataaatcgaatattattaagaaaaagtcttgatttttaatcagggctttttatcttttagatgacaaaatcataatttgtgtaaaattgcaaccacaaatgtgtatataccgaaaataataaatgttaaaattaaattgtagttacactattaaaaatattggagtatatgtgaaagtaaataaaatttggcttttaatcattttggtctgtttgtttttttcaatttatgggcattataatcaaaattattttttcttgttcgtaggtattgttggtgcctgtgcgggaataatctgtatgttatgcgaaatgctgatccaaattcttagaaatcaaaagataaaaaaataaattttaaaaagctagttttcgataaatttctttgatttgttagcaaatgttactgacaagccttttgaaaaaggctagaatatctttatatactatgtgccaacttccaagtcagagagccatagataaaaacgccttctcctatataagataagggcgtttttattataaatttgaagcctcaatttattggggctttttatctccaaaggagatattatgaagtaaaattagattttttaccattaagaacttctgttaaagttcttttatgaattaaactcaatatgttataatgagatatcaaccatagtactgaaaggagaggtttgtaatttaaaaactgaagtcgtattttacaatttaggagttaaaaatgagtaaaacacgtttagaagcatttacggatgctgtcatcgcaattatcatgactgtcttagttttagaattggtccgtccagattcagatagcttacaaagttttattgctttacttccgcatctgggtgtctattttgtaagtttttttatattggctatttactgggtcaatcaccatcatctttttcaaagcatcaaaagaattaatggaaaagttctatggataaatattagttttctttttgtcttatcacttattcctattttttctaactgggtatcaatctatcctaattcatttatcccagaattaggctatgtgattatctttttcttcgggaattttatttatctacttttgacaagagaattattgaaaatcaatggacatcgtaaaacgtctgagacaacgattagaaaaaatatcctaagtgttgtgctcaatattgtcagcattttattaggttattttatagctccagtaatcatgcttgttggttcagccttaattttttcaatgtgggtgattccagataaaaatattgaaaaaatgtttaaataatcttttaataaaaatatgagtttacttaataaaaaagtttggaataaataactgaccttctgtcagtaaataatattataagtaaagaggaataacaatgattaaagcatacatcaaatattggaaaaaagcaggagatttaaaatcttattcaaatcgttcggattattggtgggttttcttgactaattcaatcatatttgcgattctcagcattttaaactttatggtgacaatcccaaaagctggtaaaataatgagccaatctgcaactttatcacaaaaagaaattattcaacaggtgacagacttatatgccaagcccacgggtggagcattagtaataattattgttacagctctcattggtctagctattcttgttcctaatatcagtttgacagctcgtcgtttacgtgatgctaggtttccttggtggattgctcttgtttttggagtagctgcaatttatgggctggttacaatgtttattcatcaagatcttctagcaaaaatgggttattttgttggatttatcaatttcattatttatattctttgcctttttccaaccaaatatggcattgacgaagaagatgattcaagaacttatgaataattaaaaaaatagagaggtaaaatatggttcaagcttataaaaaattttggctgggagctttcactttcaataaaaaaaccagtcgtaaagatttttggtcagccttattaactcatatcataatatttgtcatcttgtttaaagcttatcatttctttaatctactagatttttatcaactaacgactttatggcaaacttttgcttcattctttcaattaatatttaatctatatttctttggaagtttattgtccttcattgctctaactgttcggagattaaatgatgcagatttaccttggggacttatttttcttaattttatccttggtctaggaactcttgtgctcttgatacttaacctatttccaagttcgactagcgctttaaaattcaaggaatacgagattaattcttctcaagaatttaataatttaccagagacaaagacattatcaggtatattcaaggactattttaaaaattactttgaatttcgcggaagaacgacaagaagaaatttttggtggatgcaactgttttgggggctgaccgttattatttttctgtttttaatctatcttttcaatcaatttgaacaaataatgtttggctacaatttcattggtagtatggtactacgtttattatttttcctatttatcttaggaacatttttcccacaacttacgattcatgtaagacgcttaagagatgctggtttgagtaatttaggactatcacttttgttaggtggaacaagtggaatattaattttttatcaaatgttcacgaagacattaaaaataacatatacaactggtcactatcaattagttcaatatctcttatttttactagtaatgattgcagtattgagtttaattcttgtagaagtaatggcgacaggagaattaaaaacaaataaaaaaaattctttatttgaaaaaatagactgattaatttcagtctatttttagtattaattgttaaactataaaaagtcacgtttacacaacttgtaaattgaattgacatcaaagaagtcagtaatagatacaaatgcagttcacgtaagccttttcattaaaaaaatctttacataatcatgtaaactactacaaaaatagaaaaaaagtgatataataaactgtaagtatacaaggaggacggcgctcttgccaaaaacaatagcatttaagcatgatacagtcttactacatgaaaccgtagatatgcttgaagtaaagccaaatggaatttatgttgatgcgacactaggtggcgcaggacatagtgagtatcttcttagtaaactgactgatggtcatctttattcatttgaccaggacgaaactgctcatgaaaacgcaaaggtacgcttaagtgagcaacttgcagaagataaagtaacattgattaaaagtaattttcgctatcttaaatcagctttagctgaattaggagtcacgaaaattgatggaattctttatgatttaggagtttccagcccacaattcgatgatagtcaacgaggtttctcttataaaaaagaggcaagattagacatgcggatggaccaaaatcaaactctttctgcttatgaagttgtaaatgattacccttacgaagcattagttcgcatttttttccgctacggcgaagataaattctctaaacaaattgctcgtaagattgaacaagcaagaaaaattaaacctattgagacaacaattgagcttgcagatttaataaaatctgcattgcctcaaaaagaactcaagaaaaaagggcatccagccaaacgcattttccaagcgattcgtattgaagtaaatgatgaacttggagcagcggaagaatcaatcgaacaagccattgatttattaaaagttgatggtcgaatctcggtaattactttccattctttagaagatcgtttaacaaaaacaattttcaaagaatatagtacagttaatgttcctaagggattaccgatgcttcctaaagatatggaagctaaactaaaattgattaatcgcaaaccagttcttgcaagcgaagaagaactcgaatttaataatcgagctcatagtgcaaaattaagagtagcgcaaaaacaaagagattaatcaaataacaagttggtctaataaagagggttttcccacttgaggattgtttttggatgtcttatataaatgaaataacaatatttagcttttctcttttcaatggtgaatagagtaagttgaatttctttagtaagataaacgagtggaggcaaagatggcagcacagcctaaagaatacttcgatatagaaactgcggcgaaaaaagatagttatcttattgatacagaaactttagcgccagaagttctagcaagtaagtttaaaaagttttctggtgttgaaaaggtattctatctgacaatggtagttgctgctttagtgttggctgttggtctactttatgttaagactaagacacttgaagttcaagggaatacaatggacttacgttcaaaaatttctcaagaaacaacccgaaaaactgagtatgatcaacaaattttagatttaacatcaggtactaaagtgcttgatacggcgaataaagctgatttaaaacaaaatccttctaatgtattgaaagcaacgaaatgataaaatttttaaaaaaactaattttctttccttttagaaaagtatcacgaaatgcccgaaaaacgaattggagtacagaaagaaatcgtaaacgagtaggtaagagcctgtttttcctagctattgcgctgtttacggtttttatatttcgttttgtctggctaattaccgtcaatcatgtcggtggaaccaatcttacaacgatggccaagagcaactatcaaagcacagtaacggttcaggcgaagcgtgggacaatatatgaccgtacaggtgcggccattgcggtagactcaagtacctatacaatttatgctgtaattgataaaacacaggttgattcaaacggaaatcctctttatattgataagaaagattttaccaaagttgaagatttcttgaatagtaaacttaaaattgaccgtgatttaattaaaaagcagctcaattctaaattgaaacaagttcaatttgggaataaagggagtgatatcactcttgaacagatgaaggatattcaaaaagcggctgagaatgaaaaaattgttggacttggtttcacggcaaatatttctcgttcttatccttttggaaattttgcttctcaatttattggtattgctcgtcctaaagatgaaaatgggacgcaagctctcaagggtgatatgggcttggaaaaagccttcaataatgttttgagtggtgaaaatggtaaagaaacttatcaaaaagatatctatggtcgcccaattccaggaacaactaaagtcattgaacctgttaaaaatggtcaagacgtttatactacacttgatgcacaacttcaaagaaatcttgaaggatatatggacaaggcggctacggatactggagcacaacaactttcaggaactttagttgatgctcataccggtgagattttagcaacaagtcaacgtccaacctatacggcaacaacgatcaatgatgctgagaaacaaaagtatttcacttggaacagtttgctctcacaatcagcctttgaaccgggttcaacatttaaaactttcttgatggctggagcgcttgatagtggaaaagtaaatcttaatgaaacttaccaacggaaacttcaagtttatgatacaacgattaatgactgggatgtaacagaaaataaaagttatactttgccagaaaccgtaacctatgctcaaggttttgctttatcttcaaatattgggatgagtaaaattgaaatgaatatgggagatgctttatggggaagttatcttaataaatttaaatttggtcttaaagtaagagccggtttagatggtgaaaatccgggagcccttccttcatcaaatgccgtttcgcaaattcaatcttcatttggtcaaggggttgcggttactccacttcaattgattagaggttggacggctattgctggaaatggaacaatgcttgagccacatattgtcagcaaagtagtagatccgaatacaaaaacaagtttgacttctaaagcagaagttgttggacatccggtctctaatgatgcagcaagtggtgtgcgtgatttgatgttaacagtaaatactgaccctgtttacggaacatcttattcaacaagtggtgattctgagcaaaatcttgctgctggtcctttatttatggtcaatggtgaaccggctgcagttaaaacggggacagcccaaattgcctcaacaacgggtggttatatgacaggttctcaagattacctttactctgctgttgtgatgtatcctgctaagaatcctgattttattttctatatgaatgtaaaaattcctacagaaagttggacacttaaatatattgctcgagtggcaaatccattgttaacaagtgctgaagcaatgaaaaatgatttatcagttagtgctgatactgatactaaagctggcaaagtgaccattgagaattataaaggcaaagattcaggagatactgctgatagcttacgccgtactgtccttagtccggttattatcgggacaggggcaaaagtaactgctcaatcgattgctgaaggtgaaaaagtttcagcaaattcacgaattttacttttgacgaatgataaagatcaggtgatgcctgatatgtatgattggtcgaaaaaagaagttgagcaattggctaattggtttggaattaaagtaacttatgaagggtcaggaaataaagtcttgactcagagtatcgaaacttctaccaatgttaaaaaaggtcaaactctaactgttaaaatgggaaattaaaaattattgattgaggctccacagacactagtctatgtggagcttcaaaaattaggagaagaaaatgttattgaatgggatagtggcggcggtaattacaatgattataacaatcattggtattcctcgcttcattatgttcttccacaagaaaaaattgggtgggcaaccaacccttgaagatgtaaaacagcatgctagtaaagctgggactcctacaatgggcggttttgtcttcgttgttgtgagtttagtagtttcattaattgccgctttggtttttggcaaatttagtccagctttcattactgcgtggtgggtctttgccatgtatgctgtcattggcttcttagatgactttttgaaagtattcaaacaaattaatgaaggtttgactgccaaacaaaaaatgttggctcaaattttaattgggattgtttcctatttcatttacagtcatggcgaaaaatcacatattattcatcttttaagttgggaatttaatattgggattttcttttcaatttttattattatttggcttgtgggttggtcaaatgcggtcaatcttactgacggaatcgacggtcttgcctcaatcactgttgcgatttcactgacagcttatgcagttatcgcagtagcacatcaacagtacgatgttttgttaattatcttgtcagtcattggtggtttgcttggattctttgtcttcaatcacaaaccagcaaaaattttcatgggtgatgttggttccttggctttgggtggttttcttgcaattgtatcaatcctacttcatgccgaatggactttgcttttaattggtgcggtttatgtcgttgaaacactttcagtgatgctacaagttgcttatttcaagaaaacaggcggtaaacgtatttttagaatgactcctattcatcatcattttgaactcggtggattttctggaaaagcagctggttggtcagaatggaaaattgacattgtcttctggttatttacagcagtgctatcagtaattgcgctttgtatttactttgctttttaattaataaatttactgacagaatggtcagtgaaaagtcgctcttgtgagcgactttttttattttttaaagttaatattttactgacagaatgctcaagaaaatattatttaacttttagaaaagcttaagttttacttgggttgaaattaagttttaacaattataatcaatttatcaagaaaagaaaggattccaaaatgaaaaatgttcttaaacttttaaaggggaaagaaattatttttgtttcattactaacattaattgttggtggagtaggtggctttttcattggtaagggccaaagtaatcaatcacagcaaaataattttcaagaacaaatgcaaaatcgctttggacaaaatggacggagtccagacactaatagcggtgcgactatgggtggttctaacagtcagtcaagtaattcaggaacgacacaagaaagtagtgacgaaagtggaactgcatcagcataaagggccaagtggtttttaaggacgttgagccaatcattctttctgtctttatttttaataaattgactgacgtgcttaaaatcgacttacaaaaaagagtctatcagaagaagactcagaaatgaggaaaatatggattttataagacgtgcatggcttttcactaaagccaaaattggacggacaatacttttaattgttgccttttcagcaattttaatttttgtactttcaggattaattattaatagtgcagctaatgtttctattgataatgctaaaaaatcagctggagcaaccgtgtcactctctgttaacatgcaaaatgttatcaaagaagcacaaaatagtgcaacatcaagttcaagtagtagcagttcaactgatacttctgaagcaggtaaacgatttaatattgatttaccaacgatttcagaaacaactgctgaaaatattgccaaacttgatggtgtaaaatcagcaagtttcacttatcaggctcaagcatcagcaagttctggtattgaaaaagtttcaacaagtagtagttcttcaagttcatcaacagatacgcaagcagctggtggatttggtggacgtgaaggaggaatgggcggagcttcccaagaggacttcacaatcagtgggacaaatgatttagcagcaagtacaagcttcacagattcttataagattagttctggacgcgcaattaaggcttcagatgaggggacgaacaatgttgtcattgaatcaacccttgctagccaaaactcgttaaaagtgggttcaactttcacaatcaaagatagtaatgacaaaacatataaaatgactgttgttggtatctatacaacaacaagtagctcgacagaaagctcaattcaatacatgaatacaatgtatactgcactttctgtagcaaattctatcaaaggtacgactggcaaagtatcaaatgcaacttatagcatggaaaatcctgcacaagcagatacttttgtaaaagctgctaataaattagttaatgacagtaatttccaagtttctaaaaatgaccaagcttatcaaaatgtaaaatcatcattgaataatgttgcaagttttgctagaaatattgtactcattgtagcaattgctggagccattatcttagcgcttatcgtgatgctcatggttcgcgaacgtcgttttgaaattggtgttctgatgagtcttggagaatcaaaactcaaaattattggtcaatttttctttgaactcttcatggttatgattgtttcggttggtattgcatcagctgctggaaatgtagtaggaaatgtcgttggacaacaacttttaaaacaagaaacaacgcagacaacgacaagcacaagcaacatggaaggagctccaggagcaaatggaggcaaaaccgaaggtcaaagaccatcaggaaatgctggcggatttatggggcgtgcaggtggagcaattggctttggacaatcagcttctgaagcaaaagcacttgaaaaattgaatattaaaacttctgtcagcgaaattttacttcttgttgctattgcgattttgattacactaatcgctgtcggtctagcaagtattggaattctcagattgaatcctaaacaagttttaacaaattgatttctaagaagaaccagtctaataatttactgacagctttcgttattgataaaaaaataatcaccagattctgtcagtaaatttttaaaatgagaggagcaaagatgactctaaaagttgaaaatttaacttattattatagcaaccccgatgactatctatttaaagatgtcacagaaagttttgaaaaaggcacgatgtatgccattctaggacaatccggctcaggaaaaactacttttctttccctgcttgccggacttgatacaccaaaatctggaagtatgtcttttgatgataaagcaatcaaatcaagtaatttaacaaattatcgtaaaaaaacagtaagtaccgtttttcaagcttataacttactgacctacatgagtgcttatgacaacgtcaaaacagccgtaaaaatctcgtcagtaaaatttgaaaatgaaaaagcagcaatagaagaagcgttgaataaagtaggattgagcacagacctaatttataaacctgtcagtaaactttcaggtggtcagcaacaaagagtggccatcgctagagcattagttttaaatcatgagataattattgctgacgaacccacagggaatctcgatgaagaaacaacagctcaaattgttgaactctttaaagaaattgctcataaagataataaaattgtgattctggttactcacgaaaatgaagttgccaaagcatcagatgttgtatttacccttaaacatcgtaaatttgaaaagacagcatagaatataaaaaccattacaataattgtaatggttttttatccagccaaaacagataagctcaaggtttatggacaattaaactagagttgctcaataatacttatggcactaagaataattacaaaattatgttaaaatagcttctaggagtatagccatgagtttaaatttaagagatcttgaatatttttatcaattgtcaaaattgcgttcgttcaccaatgttgccaaacatttcagggttagtcaacccactatttcttacgcaatcaaacgtttagaaacctactatgactgtgatttattttataaagattcctcgcatcaggtagttgatttaactcctgagggcgaacttttggcaatgagaaccaatgaaattctctctgaactaaatcacacgaaaaaagctattcatcgttcgagtatgaaagattttaaagttggttttccgccaattataagttcatatcttctatcaaagcaagataatttgaactttttgaatgccttacatatgatttatggtggttctaatgaactcttgagcctacttttaaatgaagaaatagattcgagccttttaggaagtctagaaaagattaagcatccccaattagaaatagaagaactctttcaaaaagaattttttatcattatgtcggatagtcatccactagccaatgaaaaagaattaggatttaaagatttacttaatgaagactttatcttattgggagagcataatatccactttaatgcctttaatcgtttaaacgaaaaatataatcaatcagctaatgtagttttgaaattagatgatgctcataccataaaagagcttgtcagaaaaaatttaggaatcagtcttatggcagatatccgcttatcagaagactttaaaaatctagttaaagtaccatttattgaagaagataaacaattctttcatattaattatgcctatcaaaaaaattctattctctctgaaagtgaaaaaaactttttagaaatattgaaaacattaaaataaatattgcataagagcatcaatgatttggtgcttttttgatagtaattatttacagtagaaagcgcacaaaaaactttcaggaaatgttataattagaagtatgatgtgaatcgtttttagagcaaatagcattatccagtcaaagaaaaatataaggaaattatattataatttattaatcactaaatatttgagaagaaattaataagaagataagactagataggaattaaagtaaaatggaaaaagattatttaaaaacaagatttgaaccagaagaatttgaaaaattaaaaaagaaacttgtcagatatgagtgtgctttagatgttgtcagaactcaactttctaatctaaatacctattataataattttgaggcaatcaacccaattgagcatatcaaacatcgtttaaaatcaccggaaagtattgcaggaaagctgaaaaagaaagatttacctgtgaccgctgatgctgctgatgaacatttatcagatattgcaggaattcgtattatttgttcttatgctaaaaatatctatgagattgttgaaattatcaaaagccaagaagcatttacagttgttagcgaaaaagattatttaagaaatgtaaaaaaaacaggctatcgtagttatcatatgattgtcgaagttaatttaggacatctatttagtgaacaaacctgccgagttgaaattcagttgcgaacttcggcaatggatttttgggcaacgttggaacataaagttcgctataaatatgatggacaaattcctgaacaactcagtggtgaactacaaaattgtgcagagcaaattcatgcactagatgaaagaatgtatcttattcataaagttgtggatatgattaatcagtccgaagttgatattgaacaaattggttactaactaataaaacaaaaataagaacttgtcaaaggatggataatctgttatacttattgagtatgtttttgcatactaataaaactgttcatccgctgagcttaatttgctagatgctgcttaatgatgggcaagaggagaaaaaaatgaaccttatcgaatctatcaacgctgcgcaactccgcactgatatccctgacttccgtcctggtgacactgtacgtgttcacgcaaaagttgtcgaaggaactcgcgaacgtatccaaatgttcgaaggcgttgttatcgctcgtaaaaactcaggaattaacgaaacttacactgttcgtaaaatctcaaacggtgttggtgtagaacgtatcttcccagttcatactccacgtgttgaacaaatcgaagttatccgtcacggtaaagtacgtcgtgcgaaactttactacctccgtgcactcacaggtaaaaaagctcgtatcgctgaacgtcgtcgttaagatacaccagtttaaccgctctattgagcggtttttttcttagttaaataaatgatttcctgtctagctcattgaaatgattttagagaatttttttaatactttagtactagtaaaataaatttatttagtcgtatagtatgataagcgatattatgtttaagaaaaagaaagtgggatgcatggaaaatcaagaaattttagtctctgtcaaacgttttattgaatatgggttatccagcaagtcacaaacatgccgtgtcgaatggttttgggatgtatacagtagaggacggaaagatacaaaaaggttggttttcagaagatattttaagcgtgctcatgcaatttgggcatattaaataatggaaatactgactattatgcataaaataaaagactactcacgggagattaaggtcttaatgggaatattagcttaagaaaaagaaggattataaaccttgtatttgatttttaaactttgcaacagaaccgttccagatattaaatcaaaggatattaaaaattctggaattacatggattcatgataatataaaatgacaatcaattccatttgagtatactctattgaactattatatgcgaaagttaaattaattaccttgtaagcccaaaagatacataaacatcaaatcaatggttgccaccactaaatatatagttcctattttagtaccaaacagactataaaaaccaaaagctccaatagcaaatacaggaacttctaatattaatttatagaatccttttaacatagtcggtgatttaggcgctccatatttcccccaaaaatacacgattcctatacttaatatgaaatagactattttcaaataaatgtttttacttataaaaacaccactaaataacccgataactgttactatttctaaaaaaaatctgatgattaacgtaatgttagccatatctatacccccttagcatatactctaatgtcctataatagttttatcaatttcaacttttcacctcttttttaatttcctgattaaacgagttaaaaaatttggctctagagtcttagtaatatctttccaattttcaacattaggtggcatattttctttccagtagttaacaaatatagtttcaacttctattttgtcctcagttatatatgagtattgagaaaattcttgattatcatttataaaacgagtttctactacaaaacctctaagagcttgtacgaattgactatgtttaactgggttacgtggttgtaaaaccataaactctattttgtctctacttaatctatctatgcaatccttaattagttcttctgttatttctgatgtttgataaattctatctcctgtgtctaattcaaatttcattttatcactactttcttttttagtaaccctgatgaaagccatgtaaaacgatttttgttttgcgtggcttttatcggggcttcgttggtctgctcgacgacaggagcagtccgcttgcaaagcggataatatttttatttttcgttatgccttccgtagaaatttccaatttccctagctgaaataagaaattcgtccgctaactctttactaaataatgtgttaagttctgttaaaagttctctgtaggctttgtggtaatctgtattatcaagaactgtataattgtatctaccaactaaatctatcccttcattaactaaacttcgtgctttatataaacgtttacttgctttttctgtttgtaccattccttgttctctaagtgaagaaatttcttcgccaacacggtcgtaaagttcttctgtactttcttttttattattgtctgtcattttatcaccttctatttaattttaaattctttttttaaaatattttctaaatatcgtgaagcggttagttcttgttcgttagcccttgttgctaattcttcggctaattctttctttaatgtgtacgacttagatattctaggtagtttttgtgtttcaattacacgggtattttttggaatagtatttttcatttcttccattctatcttcaaatgccatatcaggtcatatcctttcatgatatgctatattataatataatatagcatgctataatttggtaaacttagtaaagttcttatctatttcattgaaaaattctttgttttgttgaaacaatttgctatcgtttttcattttaactaaaggaacatggtttaatgtactcttgttgataagttctttttctgaaaaaaaggcgattgttcgtttatccttatttaattcagtgacaaaatctcgtgaagattttgtgttatgtttgattctattacctataaattttagctctgcttttactagactttgtctagtttcaaaattgataatatcttcttttaattgttgcattcttaaatctaaattacctttagaaataaatccatattcactaggttcaataggactaaaaacataatcagatataataatcatattttgtgtaattgttgaaaaatcagggtgacaatcaattagtacataatcaaactgctttaagttatcaaaattgtctgaaaaccaaaggtacattaacatttctctatttgccttattttgtatttcactatttataatatctaaatccatagaagcaggaatgattgatagattttcatgtatgctaataatttctacttcatttttcttagaaaaaatatcagcaaccgtacctgtagttttaaaaatgtcatatgtttgagttaaactacattggtggtcagtatcaattaataaaacattgtaaccttcttctgacaaccactctccataattgaatactaaggttgtcttaccaacccctcccttaatggcagaaaatgtaattatttccatagaaatgcctccttttatttatataacatattatatcatagcatgctatgatatgcaacaatatagtatgctcctatatccactttgcaagcggactgctcctgtcgtcgagcagaccaacgaagccccgataaaagccatgcaaaacaaaacacgttttacatggctttcatcagggatatttttatagtttaggtgtgaaaggtttgtgttgtggtggttcttgtttgtcctcttgctcgctactttgttctggttcttctttaaactggtggctttctatttgtttttcaggttctttttcaagtttagcaagcactttttttatttctttgtgcaattgagattgattaatttcatcaatctgtagcttttcttttgttgttagattggtaaaatcgtaagtgtccgttttgcaatggtgggtcacttgaatagattgtttcgggctattatccttgtataactccatttttgccacaaaaagcgggtcgcttactgctaactcattatttctatcatcaaaaattttctgaatatttttcaactcaataattgggttattctgtttaggtgattgtttctgtgagaatactatttcttgctcctgctcttgtacgggtgttttttcaatcacttcaagcgtttggttgaatacctttttaatttcttgtaaggattgtttcatcaagtctttgtcttgcgcccacgtactaatataaccaactgaatacccgcttgtatcaattcccatagtctgcatggatagataagcgacactttccgcctgcgcttctttgtgcgctcgtgtaaggggttcgtcaagttcttttagagccttcgtgttgtgtagttggctatgtgcaaattcatgaaacaatgtcttgagttgttcagttcttgagtttagagaatttaaagcaatggtatgctctttcggacgatagtatccgccaatatctttatcgagtgccttaatatgaatccttataccgtattctttattaatatattcagaaactttatctaatttatcagtacagaaaatctctgtctgttctgtggtgtattcatttgagataaaatcatgagcagttaaaacgggttcgcctgtggtgtttgcaatatcaaaaacgggaacgtaccgataagcgacaatggctttatcttctgtcgtattgtattttttcttttcttcttcgtttaagggtttgataattggggcggtaatatataaagcttttgcccctttattcacgtgacgattaaattttttttgccagtctttatacccgctaacaagtgtcgcttgtgggttttgagcttgaattaacaatacgttattcacactataattcggaaatttcgccaaagtatttaaatactttttaaagctttcactatctgacatttcttcaagctgtgtttctgctttttgcaataattcttgtttccattgctctttgtcttcatttttacgtggcatgttttcgtcccttctttcttgtttcacttgtagaagtgttttttcaaaatactgtagactagaaaaagaaactagtcttttttcaatgggtgttctatgcttgttatccctttcaaatactgggataaaagtttcaaaaatgaatttttggtagtttttatgaataatgctttggtcggattgaataactttagcttctgataaagaaatacctgattcttttactaaataacttgagagcttatttttttcaataattaaggattttgtgtaatctaaaccgctttttcctcggttgtgtcttttagtgatataaccaaagttgtgtcttagatttgtccgtattggtataaaagcggaatgtttgctcgttagaggaacagacacatagtaagggcggttgtctttttggataatgtttttgttatcggcttcaagaaatatgttgttatcttcaagcactttttttacgtctatcgtatacaagaattttttaattggcatgcgttatccctcatttttaaacaaaaaaaggtatcttcaactgaaaaaataatcagaagaagataccttggtttgaagattcatcacgtcgcttagttttttaatgtggcttagacgtttcaaccactcaacacgtcgcttagttttttaatgtggcttagacgtttcaaccactcatctttttttatcttcttctattataaaatatttagttgtaaaaaacaaggtgaacgtttagttcgggtttattcgctttgttcaaagtcttcatcaaaaagaatttcaggattattaatttcagtgattggctgtgtatcataaagggctttatattcgggtagtttttcacctgcaattgtttgtatccctgtttgcatatagccaataagaaaatagtcaacgtttggctttttttcaaattcaaatatagcattccctttatcagataatagggcatagttatgttcaatcacttgattggcaaagactgctttttcaaattcttttttttctagttcattcattttgaaaactccttaaattgtattttgtaatgattatctagcgctacaatggcgttataggtgttctttttttcttttttcttgatacctttaattaatgttgttttgccacttaataggtctgtaaaattttgtttggtgagtttctttcctcgaaaatcttttgaaagggtgattttacagtttgggtagttgctacaaccataaaatttacctttatctgtcaattgcccgtcgcataaaggacacttggcaaggacttttgcttcgtcttgcttgatttgttcctgttgtaagccttgtaaaaatctgccgactttttccataccgaaacgtttctctaattgttgtatgaggtcaaggatataacgttgggtagcttggataaattgttcttgtttggcgttcccttgtccgatttgttttaaaactttctcccattcagcggtaaaatcagcacttgctatgggtaaacctgtcaacaattggcaaagtgttgttcctttagacgtgcaatacaaaatatttttttcagaaacaatatatttttcttttttcaaggtttcaataatgttggctcgtgttgcttctgttcctattccttgcgtttccttcaagatttgtttgttttctttatcctcaattgtccgccctgcgttctccatagcttcaataattgtaccctcggtataacggggtaacggttttgtctgcttggtttccgtgagtaatgttgaggcatacacgctattttcttttaagtctggtaacgtatcttctttttttgtgtctgtttttgtgtcttgtaggattcttctatagcctagatttttaactacctttccttttgctttaaagtccacttgttgaatatcaaaggtgaaaatggtctgttcgtattgatagggttcttcatacatagcaatggtacgtttcaacacttctaaatagatattacgttctgcacttgttagctgttgcaacgcttcttcactgggaattttatctgttggcacaatagcataatgggcttgaacttttttattatcgacatagcgcttgtttggcgttttaagcgggttttcaatccgcttggatataatgttcagatagtcgcttaaatgagctgtaaggtacgcaaattcgttttcagtaacaaaatgacagtctgacctaggataacttaacaatttatgcttttcatatagactttgaacagtagttaaagtttgttgcgcagttaatttaaaccgtttattggcaaatttttgcaagtcacttaaattgaatagtttagggctatactctgactttagctctttgttgattgattttagagtggcttgattttcggcttgcaactggtgttgctgtagaaaatcatctaagttctttctctcggtaaagtttttctcgtaagtcgctaaaacgtcgcccttatcgctgtgaacattactttttaactggtagtagtcttgcggtttgaaatgatctatatcaaaattacgtttgaaaatcatataaagcgtgggggtctgtactcttcccatagaaaaggtttcttgaatatgatgttcgccaaaaagtaaagtagctaatcggcttaaattcattcctgtgagccaatctgctttttctcgtgcttgcgcttctaaataaaaattataggtttcagaagcggggcgtaaattcttgaatgctcgtgttaattcctcttttgtttggctattaaaccatgcccgtttaatcgtaacttttgaaaagttcacgcctgcttgattaaagatagaataagcgatattttcaccttcacggtcactatctgtagcgataattagcgtatcagcttgttttagaagctttttaacggtttggaattggtcttttgtacctttagtgacttcaaatttaaaattttgaggaaagataggtaaatcttgcttgcgccactgcttatatttttcatcataagcagttggtaaggcaagcccgactaaatgaccgataccataggttaaagtaacgcttgcgtttgggaaaaaatcattgtctgtaatttcataatagccattatttcttttcacattcttgaatatttgtgaaatatctttggcttgattgggtttttctgctaaaataacaatgtgcatacttcggtatgtcctttcttttgtcttgcgtgtatctgcctttttacatgcaagacttttttattttttaaacattcgagtagcgttggaaacagtagaagaaatacctctcatcaaaccgccacttggtcgtccaccaaaaataacgttggcaatgcctgctcctttaatttcgacaaaacctaaaccaattatcaacatcacatcacctgcaccgatattctttttggctagaagttcgataatacccgccatagcggaaacggcaatgattaaatttgtaaattcataaccaacacgttttaaataatcgttaatcatgttattatcaactgttaaatatgaaatagctacccacacactaaatacttgaatataaatccattcagcgtgaaagacacaaaaacgataaacaaatgagattacaacaacggtcataaataggagcattaaaacaagcataatccctgataaagaggcaaaccccatactttttaaaccaaacttcgcaaaatttgtaaaggttttagcgcttgaatcagcaatgtctacgaaaagatatttacaaaatggatagataattttatttaaacaaaaagatagtaagataggcaataaataaatcatcattcctacttttaccccgcctattgctaactcactcaataattggtcttgtgttttaccttctccttcggaaagcataccaacgataatccgatacaaaacgatacaaataatcactgatgagccaatggctataaagatagtattcatttgtttgaaaataccgctaagctctgtcccactgaataaaccgtcggcaataaatttaaagaaagactcaataacgtctgtgagccatttttgaaaagttttttctatacttcctgctaggtcaaacggattgataactgcaaggttcataattttactccttccgtgttattaacgtagtagtttcagggataaagaaccgactatcttttttatcctgtcctctctgttttagttctaaaataactttgttattattttttatatctacgtcataaattaactcgttttccgattttatcactagttcttttttgtcagaattataatcatagtggtaattattccacgaagggtaataagacttaacaattttgtctttggcgtcaaattccgtttctgaaactctttggtcgtcagggtctcctgtagattgtaaattccaatcaccactaaaactaaattcttttttaccgcaagcactcaatccaaaacatacaaggacaattagaagcactccgcttattatttttttcattttttgtcactccattctattcatcttcactttcaaaattaattgcagttggggaatcttcggtagcataatagtcaaaagaaacgtcattttctgtttctttttcaaacattaaatctgactgctcagctatttcaggttcttttgttgtgtcttcttctaccacttcgagtggactttctttaggtcgttcagtttcttgttcttgttcctgcatgtttgcaagtaaagcttcacgttcttttagataggctttttgttcgtccgttatggtttcgtttgctttagaggtttcttttttgtctgcttgttcctgtgcttgaaaagctgtatcttccgcttgttttgcttcctcttgctgtttaagacgataagcgtgatactctgtgattctttctttatagcgttctaactgttcctcacttggagtaggggaataattcgcttgtgattttgggttaagttgggtcgcccctttaaatagcttaaattgaaatgcttttttcactcgtagagggtgcttgtttgaaaaaacaatgacactttcgtcttcgggtagagtcatgatttcgtcagccgtcattaattgacgttggctatattgttccccttcactagtgcttgttcccccgctatccttgctattatgctgtttgcttttactttgagtgtcaatccgaacagtcgttttaccaagcattttttcaaagtattcagcagttgtcatattagcagagttaagacaaattttaacgctacagttacctagaatactttcagctttttctcgtttgtatttatcgtaaagttgggtcaagctttgcaaaataatacctacaccaatgccatatccacgacaagttgctaaaaattcttcaaaagtagggaatttccctagattgacaaattcgtctaaccaaaaatcaacattgataggtaattttgcgccgtgttttgcgcctagtttgtacagttcattaaataactgactaaagaaaatattaatcaaactttcccatgaattatccatgacgggaataatgacgtataaagcaatttttttacgtccaatatcttgtaagtgaaaatcactaaaactagtaaactgactgacttcctcgtccacaaagtctgaaattgtggttagtaaactcataatgattgagccttgcatttccccttgggactttttaaatccaagttcataacttcgtcttgcggggtgtcgtctatctagttgcataaattgcttatctagttcactatcgcccttttcattgtttgcggggtcaaattcttgtaaaaagtctaatattcctgtcatggtgcggtcttttggttcaaactcataacgagaatataaaattaaagctttcaataacgcccgttggctgtagtaccatacgtcacgttttccgtctttgttggcactatcaacaattttggtagcgactgtacttgcttcaatatctttatttacatagtcaattggattgtggcgatcactgtttgtcatatccataaaatttaatacatggacttcgtagccttgcatttcttttattccgcctgttaactcgtaaacttcccctttagggtcagtaatgacttgactatgttcagtttcatttaaaacgttagtaatgactacactttgggttttgtacgagccgggaccaccaaaaaccatgatatttctattcggtttactttcagttggctgtattaacactttattggcttctttttcaatgcctagtattgttcctgtcataaaatatcagctccttgtttttgttgtccctgcgttgtttaattggtctacagtgtaaattaacgattgtttaaattcttcttgaactgttttttgtttctttacaataaagttgcttccttggataacttctgcaatggttgaaaatcttgctgtcccgtgtgcttgactatttttatctttcttagtcttatttctattccctgccagtaacacatagagtggatagaagaaagagaacgccaccccgacatagaaagcaatattttttgctttaatatagcctgtaacagtagcaattgggtgcaataatcgttctttcagtgttagaagaatgatgtctaaagtaaaattcagtttatgaactttaaatccctcaaataaagcaagtaaaaccaatactaaaattaagcagacaatgactgatattgcatagacaataagtgttcgctttaattttttcttatccatttagtcacttcctttcaaaaatttgtttaaatgagtggtatttgtccctgcatacgccttgtttttgtaaataaaagttgggacggtatgaatgttgtattcatcaatatattttcgatttttcttttgattaagattgataaactcaatatctctatgaaagaaattgtgcatatagacttgattaaagactttcttacagtccttacagtcgtcacgataaaagaagttgattttatcctcttttatcgtcgtgataacggctttgctactttctgtttggtgtcggtcatagacgataaaacctgcaaagagtaatagaactaagaaaaatagtgttgaacctatattctttttattcattgagcgtacccgcattctttaaagacacaaatttatttgctatggggtcaaactcggcttgatacatgaatttagcccctatcttgtcgcttccttgaatggtaacttcattttcaacaatgattaatactttttgcgttttatcattcgttggtgcataaaagatttgtggctgttcttttagcttagaaatagtttgaacagaggcgttataggcgtttttttgttttggaaaaatcgcttctaaggcttcatcagttgtaaattgacttgctttttctcgtctatccgcaatagatattttttttgtgtcatagtcaaacagacttgaaaatacgccatttgtcgcaaggacaagctgttggttggcgtttccgttcttttgttcgtataactcattgtatttgctatctagtgctttattttgctttgtgagggtagctatttcttggtcttttttgtcagtggctttgttggcactatccacgtatcgaacaaaacagactgctaaaatcacacaagcgacataagctattacgtgtactgcttttaaaatgattgttttcttctccataatttattttctcccttgaataaaatcaatctgtgcaacggtcgctttattgattacacgccaacttcttgtcccactattaggcgatactacgtttgtttcactcactaagatagaaccgtcttcattgacatactcgactacggcgatatgtcctgcggtagggtcactccctgctaagccaccatagaaactagcgccccaaccaacgtgtggtgtacctttttctactttgtagccttttgctcttgcactagcgccccatgaaccaccatttccgctgtcgccactaaaccactcgattggtgtaccaagttgtgccatacggttaaaagcgccccaagtacattgtccgaaaggataagagttgcctgcataatttttattatcaggtgctggcaatttaagtttgccctcatattctttaggaggtgcaagtgttggtgcggaatttgtccctgtcgcctctttactaggcgtttgttccactacgcaaccgtcctcgtcagtatcggattgactggcttcttttttatttatagttttgtctatttgatttttaggaagtacattgtctgctttataaggggcttgtccatatttttcaatggcttctttatcaatccatttaaatttttgtcctagcgattgataagcgccaattaaagacacaagatagttcgggtcagtcgcccaaccccctttaaaaatagctgtgagggacgaaataccgtctgtattattaattgcgcctgtatagagactttgatgtgccataaattccgctttaccaacgatacctgcgttatagtctttaaaataagtgtacgctccgcctgtgttatcgcctacgcttgttcctgcctttgttcctgttatatcaacggcttcattaccataactggcaagcgtaactggaaaatcttcttttttagaagttttaacgcctcccatgttgtgtgctttccaaaaggaagttccactagggtttgtaaagttaaaaccattttcaaccatagtttgagcaatgcttgcacttggtagaaaaccgcctgctttccacgagaggatataggcttctttgtgacttttaacaaagtcttcaacgcttttagggactttcttcaagtcttcggttgtattgctgtcgctattacttggttgtacgcaatcttcttcatgtcctgaaacaaccataaagataagaataaataatcctactacaagccatataatttttttagcaatacttatttttgctttggttacaaacatattttcacttcctttaatcaaggcaagaaataattagctactccactatttaatctaaaaattcaaatggaaggtctttgtcgtcaatttccatgacttcttttgttccgaacgggtcaggttcggtcatgttgggcgtattattctttcctgaatttgttgtaatagcggggtcgggtggaattggggcttcctttctactttctagcatttgaaaattatctgcgacaacttcggtaacataaacacgctgtccttgttgattttcatagttgcgagtttgaatgcgccctgtaatgccaataagtgcgcctttttttgcccagttaacaaggttttcagcttgttgtcgccatatcacacaattaatgaagtctgcttcacggtcgccgttagcgtttttaaattgacgattgactgccaatgaaaaagtggctacggcttgattttgtggcgtatagcgtaattcagggtcacgagtaactcgtcctactaaagtaacgttatttatcatttttcacctcgtctgtatctttttttatttccttttgtaatttttcaattctatcattcaaagcgtctgcgtttttttgcatgttagcttttttatctttatctttttctttacttattgcttttttctgttcgtttaattcttcttgggtactctttaagtcgtaacgattttggaaagctttatcaggaaatttattgactactgcttgggcgttttgtagttcatcttcggctagaaaaacatttaacatacgcaaagcagtattcttatcctcaatgaatgaaagttgcgttttcatggtatctatttcatgattagcaattgcttgttcaatggtaagtttatcttttaaagcttttttattggtagtattcccattaatttcaaggtcataaatttgttgtataggttggtcttttttatcaggtgcttttttgtcgtctttgtgtttctcgttaaaatcggcttgttcttgataaatcttctcaattattttctctaattgatttgggttatatgctaaagacttttgaaaatcaccttgttcaaaatacatgttagagatatctttgtcagaataatcaaggtgtttcatttctttttcaacgctttgtaaatcccctgcattcaataatttttcaatttttaagtcgttctttgtctgctctacttttgcctgcattgtgttaatttctgtatttgcatggcgacggatagcaacgcttgttgcaaatgaacagataatcactgcactaattgctccaatcaacaaatattttgttcgcttttttaagcgataatcatttgttttaatggctgaaatatactcatgtgtaatgtagttgtaggtgtcatgaatgagtaaagttaattcttctaaattttttgtagatagaatatttttaacaaggtcattccctacttttgccacttcttgttgctgtcctagacacttttcataagaaaatcctgtaataataaacagtgccaatgcacgatatttttcaaaattactggtgcggttgtcataaggtaaacaatcattatctgaaaaataactgtattgaatgagttccattgggtgatagaaaattgtacttgggtgaatacttacagaatgtcttgctaaaatattgtcttttaaaatagcgagtaaaatactcaatttaattgggtattcttcttgcttaatatcaataagcattttcatactgtctatatctttaaagataagctgcattgctccgtcaacgtctttaatatcttctaagggtaaaaaggagtcgctagttttatataaaaaatccaactgcttaatcgtttcaatgttgacttgttgtttggatagttcaacaacaaccttcccttcttgcctacggattgtcccatattcaaagttactgattttaaaagctttcttattagtggttggtgcgctaattttaaccataagtcacgcccctttcttggctcgtgttcattaataaatgaaattttctgcttcttcaatttcttgtggtgtcatagctatgagttcttcatagttgatagattcacctgtagaataggtttcttcgtattgttccctatcaatgagatagagttcttcgggggttaaggtgattttcataaacgcccgttggcttccgtgaataattaaggcttccccttgttttttcttctttaacagtttttgttctttgtctgaaaagcgaacttttaaacgttgagataaatcttctacgcccatatcgtctaaaccaaagaacacctttgtaaaagcattcccaacgattgcttgccctagatttgttccgtctgtggtttttgctttgagtacgtcttctagctgttgtgtccctgcaattgctcctgcgttatatttacggaaacgtttataggcttggaaaaagaaacttgacgcgtcaggattctgtgttaaaaagtgaaattcatcaacaattaacttaatattttctgtcttatttttggtaatttcgtcccacaaatagctaaatgtattcaaatagcaagccccttgaacatcaggttcattttgtagagattttaaatcaaaactcaaaaggttagtatgcaagttaatgttggttacgccattaaataaagtagtgcttcctgatacatacccttctaaaatgtagaaaaagtcttccaatttcgcaaaccgttttgggtcattggtctctaactttttgatttcgtcataaaaattagaaagcgtagggtactgttcacttttaatctcatgaatagaacggtagcgtaaaataccactgcttcgataagtttctcgcaaaactttatcaatcaaagctttttcaacttgtgtcatatcaggtttcaaaacttggcaaaaccctttgacacgtgtaattttatctttaataacttcttctatgtcaatatcgtctgtttcgttttggtcgtctgagataatatccgaaaaaatttctaaaggattgatttttgttttagcgttgctagataaatgcactactgttcctcctagcaactcaacaatatcgctgtactcattttcggggtcaataataaatactttaattccttttgccacatattttaggattttttgtatcatataggttgttttaccaacgccacttgttccaattacaaccatgttctggtttagtgttgttcgtttattcaaatagtcaatcgcaattaaactatctgtatctttgtttattccctctacatctgaacggggacttaattccaaaatttcgctatcgtcaaaagggaacatactacttgcggtttcagtattcgattgtttataggtatattcttcaagtaaattttcctgcaaaggcaaactgctccaaaaagcttgtatcatagcttttgtaggggtcatatactttaattgaagtttaattaatgtacctgtgacactgtctgtaagattgtctaaggcttctttgctttcttcttgcaaatagatataagtgtattgtgtgataaaggtactgcgattttgaatgtaattttctagttgcatatccgctttatcaatttgattttgaatttctttctttttcaaagggtcataagtttttagtaattctgcacgtttatttttaatggtatcattataaaatttcaccattttattactactagcattttccataaactgtacaatagaaatattccctttttttcgttttaattcagataaccagttaccataagctcgcttaggatagtcagtaatcaaaagaatacgaatataattattcccgctttcaatacggtcgggtaattcttcaaatgaaaaggggtaaagttcgtccatgcctgaagtatcaagaaatgtttctaggttagataaatcttgtttttcaacgtattgaataccttcttctgaaatatccgcttgtttcgccgtttttttcatagacggaagtaggtcttttattttaaaatttgccatgttctctctcacctctctttttaatcacccgtgtaattaatcatggattgtaagacttgtttatactccgctccacttaattggttagcatgaatatcatattcattcaaagtatcattcaaagcttttgtaatgcctctaatttgttcgtttagctcctgtttggcaaattctaaactagtgaatgttttgtctttgattttttgagataatattaataagtgttgttttgtcgtcatatccttactattcattagttcttggtagtaatgaacgtaactcgcaattaagtttagtaacggggttaactgtgcttgttcctcttttgggagttggttttgttggtctttaacggttaaataccgctttttccaatagagaacatagctgtttaaatttactgtagttgttcggtcaatatactgttgtttaccagtcccttcatttagggttgcaatcaaaaaagcattgtaatcatcgaacacatcagcttgttcttcggggtttaacaagtctaaattcaagcctgatatttcaatcatacttaataaataacctgttttcgtgacaatgaagtcttgatactgtccctgaataatactcatggcttcaatatcatcttttccttttttgattggtgagggaacataagtaaattcatagttttttagtttttcttgtaatgagtttttcttaacgttcaatttttatgcccctttctttgcctcgtttgtaaaacaaacgttgtcgtttgccatatctatgtttcagctctaagtcgctttttaaactaatattaggtcgtgcatttactggctttgtagtaatcagtgctaaggtaactgtaaataagacaagagcgataaacactttaatcaaaaagaacagcaacgtatacggtggtaagataaaaagtaacaacgtaatagctgttggaatacttaaaactttaatcaagtcaattaatcctagcccaaacgcaacgccatatttgtttgtgacattatccccaaaaagaaattctttcccttttttcatttcaaccgcctcgtttctagtctgaataaattatccatgctctcgtttgattattgctataggcaatcaacttcaagtcaatgaaaacataacccttcttctctaatttgttaatttcttcttgtacccgcaagcttaaattgcttttaaaaactccgctatctagcgttttgatgtatttcatagtatcactccatttcttgctctactatagttggtatatatctttgttttcaatattctgacaattataagtaaaaaaattaagtgaacaatccgtagagccaaggaagaatccatacaatcgctgcgcctaatgccaccaatccaccgacacgtcccaacgccttgtatacttcgttcttttcttgtgggtcatcagcagaaggtaatctttttatgattatccataaggcaactacaatccctactgcaacaattagccccgtaagtacaccttgaattgttccgatagcgtctgataatttcttttgcacttcgtcaccttttttgtcagcaaaggcaatcgttggcgttgtaagcattaatgttgttaaactaacacttgctagataaaatttctcttttatttttttcatgaatttactccttctcttgtttttgtataggttgttgtgttgctacaactgttttttgctgttgctgttcttgtttagggacttcttcttttttttgttgagctgttctaaacttttgaatcgcctgtttggcttgttctcgtgtctgatagcctgtgtttaaaatttttgttttaccatttctcaatattctgccaacactaatactagttttaccttggaaatcggtttgttctattactgctaattgattttcgtagctcgttagtgctttatcaatttctaccccataaatagatagaaatccttcaaacatactggtaatagcaaaaactgtttcatttctaaactctgcaaaacgcttttttgcattgctaaaatcaaagctgtgtaattcttcacttgaataattaactgcattttcttttaaacatgtttctaactgggctttattgattgtaactgcttgttctgcttgcttacgtaaagcttcttctcgttgcttttctatatccgttgtactggtactttcaacttcaacggtttctcccgtttcaaatgtgattgtttctttttgcattagcgtttcaccacctttttaaggtataataatagcttgagggtaaaagcaaaaaccttgtttttttgctttgtagaccgctttaagaatgaccgttcttaaagggtcgccctctttttttactttactaattacttttttgatgtcttttcctgttaaaacaagagcagttccaactgggcgaaaagtcacttcttcaaaatattcaggttctcgttgttttaacgtaataaaatagcgaggatttttccctagtatttcacttgcttctcgcatggtataccattcattatctttaatatcatctatcatttgttgaaagcctcctttctttcatatttttgttacaaaataagtataccactaattaactaacattggtagtattttaatttttacatttttggactgtatcctctatcgtttttatgctttttcttcttcggtttatgagcgggacgttcaggttcgctttcccctcgtaaaatcgtaaagagtagatttgttcctagtcctttgagcagattgaaattatttgtattgttgcggtagtagtttttttcttccacatttttttctttgttaagttcatctttgacattcgtatagtttttatcaaacacagcttttaatgtttgcttgcctgcttgactaaaatctttcgtttgaacacattcattgaaaaacataactttcatgcttggattttcaaagaactgtttttctatttctgataagtgagtgtgtccttcttctaataaacctgtaagcaagcgttctttcgttgcggtatcgtacttcataggttgtctatcattcaaaacatcaatcactactttttcttcgagttggtcgccaaaatagagaatagcattgcacaattgctctttttgtagtccattcaattgctttctgtcaatcattggcaagtgttcttttatcgttgtttcatggtaataatgaacggcttttattgccatttcatagcgagcaaggggttggataatgccttggaaagcttttttaacttcgtcggattgacgagcaacactttctttattctctaactgaatatcgtgtttagcacagaatgttttaagaatagcttcttgtttattcagtttttctttcatcacacgaacactgatatacgggtcttttaaaagcaaggatagattgtgtgacaattcctgttgttggcttttaaataaaatttgttccgtttcttttaagtcaaaaagttgttcattatgaatggttttatcaactaattctcttgccatataaggactaagtgcgtttgtattgacttttggatagtgagcagaaataaaccgttgggcttctttatttaaaagaatttctgcttgttcaaccgcttctttttggtctttaattttacttaaaatcggttcttgttcttgcccattcgtcatcgcttgtttagctagtgcagagtttttccagttatttaacatacgctttttatcttccaatttctcaaaggaaataaagacgttaagttctttagaaaggtcagataaaatacgtttttctttgggcgtaaaatgacgagtaaacggatttgtttggttcttttcttcggtttctttttctagttgttcttgtttgtataagagttgattatactttttaatttctctattgatgtccccgttttcactaggcaatccttttaattcaagttgatgggcatagcttccaaggtgttttgttgggagttctttctttccttgttctttaaaacttttatccgttacggttatgtttaatccttttttttctaaagagtcattaatcgcaattgcccaattttcacgccattgttttaagcgttctttactatcccaatccgttgttttttctgtggagcattgataagttttcttttctttatcgtaaattttgttgccttgttcatcatagtgataaacttttttttgacgagttccccaatccccgttttctttaaatggacggtttgttgtcataatatgagcatgaggattaccgtctttatctctatgaatagcaatatcagccaccatgccatgattgacaaaattttcttgacaatagtttaaaaggagttcttcttgttcttcttcgttcaattcagaaggcaacgctaaaataaaatctcttgctagttgagcattttttgatttttcgattttttctacttcgttccataatttttgacggtctaacgtccagtccggtgcattgcttggttttaaaataaaagttttaggagcaacacttcgaccatagaaattaaatttgttatagcgttcactgtataatttttccccactacgataagaggcgctagcaattgcagactgtcctttccctcttgaaataactttagcttcaaaatgataaatagccataagaagtgttctcctttcttttttattttttacacgagcaaagcgagttttttcaacacgttcaatctgaaagattggcaatttataacatgatttttcatggtatataagtgcgcccttatatcttatagggatattttaccactttttattagtattttgtacttatctgtcttttgccttattttgttggatttgatagaatataattatcaagaagtgtttcaaataagaaaggactaggaagttatggcaaagaaaaaaagcttggaagatttacaaaaagaattagcaaagaaacaagaagacattaaaattatcaatagaaaaattggacaacaaaaaagatacattaatactcgtattggagaagaactcttaaaaggtttagaaatttctatttctgattttgattcagaagataagattaaaaaatttgtttctttagtcatttcaaattcaaaaaatgcagttcatcaacaattcaaaaatacgactttagaaaatgaaaataaaactttgaatgagtaatagttatgactattaaaaataaaaaagatttatcttcctcgattgaacagttagaaaaggcaatcaatcagcaagaaacaattttaaaaaaatttgataatgaacaacttgattttgaacaaattaagaaattagaaaatttgttgattcaagaaagagaaaaagcaaaacaagttcaaataaaaattaatcgttctgttttacagaataattctgaaaactataaagaacgaaaaaaacggacacggcaattaattcaaaaaggcgctttacttgaaaaatatcttgaagctaaacatttaactgttgatgaaacagaacagcttttacaaatttttgcaaatatgataaatgaacaaaaacctgataagtataaaaaataaaaaaagtttagagctaatctctaaactttttttatttcattatccataatttgtttgccacaccttgggcaatagacaccaccatattgttttgctttttttacttttaaacgagaaatttctaaaatataatcacaatctttacacaaaaatttttgtttgatactaattattttgttcatttaaagttcctgccttttaaccgttggtaggtattgttcaatggcttttttaaggtacttacaaatatttttctttgagtagtcctcttgtttagctctcacataagacaagtggtctttcacgccattcaaacctcgtaaagctttcagttcgtcataaagaggataaacatgtgcctgtaagcctgccatcaatttggtgtctgtcatttcgtaaggacttaacaacatattttctaacaaaacttgagtgtatttacttttcatagcttgataaacaagtttttcttcggtttcttctttagattttttgtcggcttggtaggctttgtcctctagcttataactgttatcgtctgctcgacgttttttcgtgatatgaaagacaatagagtcaattgaacgtccttttttaatcttgtcataggtcacattaaagtgtgtatgagcgttgatttctttcaacgaattttgcaaaacgtaactttcaaattttgtaaaacgttcataaagatttaaagtatctgttattgttcttaattctttcactggaatagatggattgcggtaggcttccacttgctccgctcgccgtccgcctttaacactgtaatgctcgtattggttataatgcatagataaccatttataaagaataatgctgtatttactgtttaattccataacatcagataaagcatactgcgtaaaattcttttttaactcaatcaaatagggcataatatgacgattaaactctatcattactttatcattgtaactgttccattttacggtgggaattggcacaatactcgtcatttcaaaatctttctcattatccttgaattgcttaatctcaaaaaatgctgttttttgcattctctcaatggcttctttaaaacgtgtatgttttccattatctgaaacatcaaaaaaagaaaagagttcggcttttgaaagatagattgtattgtctttgggtaaattttccgtatcaatgcacgataccgccaactcaaaaatctttaaggggactttatccattttggcaacggatgttatcaagtcattatgctccactatttttcgtttctcaatttctttcaaagaacacactatcctttcattgctgtttcggtcgttttttgttataatttccatgagaagttgctccttatgagtaattttggttaagcatgaagaaaaattctttagacgcaatttcttcatgcttttattatatcataataaagagagagacgataaatttttctctccttatacatagttttttctctccttatacatagttttttctctccttatacatagttttttctctcctaaaaaatctgtatccccttgaaaaaaaagactttttcctcacgcaaaagaacaaaagattaaaatatataagataaatataaataggcttcgccttttttcactccgtttcaaaaatcttaaaatcaaagtcaaaagaaaggtcaaaatcaaaaccgctccgcaaggattggttgggctagtttgtaacctttcactagcaactagtctctttgtttagttttacctgcttgtcttgttttattaagcgaacagtcggcactgttcggtcagggtcacaccctaacaacctaaaggcagatttaaagtgtcctataagctcatattttagtttctaagcgattttaaaagccttctgatacaaattattgaacacaaaacaaaaagcccttaaaggggcttatatgcgcttatttcgtttgttcgtttcttgtcatgccatatttttgacgataacgtcgaaaagtcgttcgattaattccagttttacgctcgatttctttttctgttaatccttgttggtataaatcaaaggcatgttgcaagccctcatcttcaaaagaatatttcttttttcgtcctttaaatcgtccgcgttgtttggcaatggcaataccttgggcttgccgttctctaatccgttttcgttcactttctgcttggtatttgtacaattcaatcatcaagttattaattaaacgccttaaattgtcgtcttcaatccctgtcatggacggcaagtttaagacttccagcgttgcgcctttttgttgaatttggttcatcagttcggttaattctttgttatttcgtcctaagcggtctaattctgtcaccacgacaatatcaccctcacgtaaataagtcagcatggcttgtaattgaggacgttcagtcgattgtccgcttgccttatctgaaaacaccttagaaacgtcctgtaaggcttctaactggcggtctaggttttgttctttgctacttactcgtgcataccctatttttgccataagccacctcttatctttgaacaagtctattgaacacttataaagcctattatagcaagaattaaaaatagttcaatagcctataccctattgaacataaaacgatacttgactttctaaaattatatagttatactgtatacatagagactatatacagtgtaactatataataaaaaaaggaggaacatatatgagtagaaatcctcatttacctttaaccgaaacaactttttacattctattagttttaaccactcctgcacatggatatgccattattcaagaaatagaaaagttgagtaatggatttgtaaaggtagcggctggaaccatgtatggggcgattgaaaatttacttaagcttaattggatagaagaaattccaaatagggaaaaaagaagaagagtttacaaaattaccgatataggagaagaagttttaacactagaaatagaacgtttaagaagtctgattaaactatcttctgaatttggatattaggagggaaaaacatgaagaaatttagaattttcttatctttaaaaaaagaagaagaatggattaattctatacaagaagagggctataagttagtttctgttaattctgcagtttctatgtatacttttgaaaaattatctactaaagaaatgttcattccttatgtacgccttgattttagagaaaaaagtatgaagaaaacaaactatgaagattatgtaacactattttctgatagtggttggaaactaataaaaggaagtcgttttggtggtgctcagtactttcagcaaaaacgtcctgacgtatcaagaggaatattttctgacaaagattctcaagaaagtgcgaagagaagatatgttaaatatggttattcatgcggatttttatttttattgtgttcttatagttttagtagaaatacatcctggacccaaattataaacttcaagtcatggtatctaacaccaaatatctggaatttaaaaggtgtcagtttttggtatgcttttctttttgaaactccctttgctttattccgtgtattaccgttattcttctttttatttttaggtatctattacctcatacgttcacttataaatgacgattcaaaatttaaaagaaaataagaataaagaaagaacctcttctaaattgtagtgcaccccaaaatatagatttgaaaagaataatcaactagcaatttgggttttttaatatgattcgatacaaaaaagaatttaagcagtctcttgttgagatgcacaatcaaggccgttcatatactgatctatccactgaatacagaccttcggtcgacccaatccgtaactgggtcaagttgtacgcggtccacgaagtggaccgcgaaaaatggacgcaagctgatgtaaacgcattacaaaaggaaaacgacaaatttcgcgaagaacttcagattttaaaacgaaccgcggtgttactttcgaagtacaactaacgcaaaatcgcgagttaggactggaaattattgacagttcgctcgcaatgggacaccgcataacaagcgttttctcagctttgatatagctcgaagcacttattatcaatggaaaattggcatcccagccaacaagaaacgcgtcgcaacgctctaaaaacggcaatcaaagccgtctacaacaccaatcgtgggatctatggctaccgacgcatcgccgcatttttacggttcattttgaacactgaagttggtgatcgtttggtttaggagctcatgaatgagatgagccttaaatctcacatggtcaggaagtcatataagaagccgacgacgaccactgacacaccataaaagcccaatctcatgaagaatttggatgatttgagtggagttctaacgactgacatcacgtacatccagctgatgaatagagactgggtttacctggcgacggtctatgacccagaaaaacgccgtgttgtctcatatggactgagttcagagatgaccaaagaattcgcaacatctgttgtcgtgaagtctctaagagccaacggtaaaccaaagataattcacagcgacatgggaagccagtacacttaaagtggttctgttgcaaagtttccaagggatagaaaatataatattgaaatttggacaaaagataaacatttagaaagctattcaagatatgattactagcttgtgagcccttattcttgaaaaggaggccagctaagagtaggaaagatattacttctgaaacaatgtctattttagtcaattataattctctgaaaaacaaaaagaggtcaaaactgttaagttatgagctactttattagtttatcaaaaagggtgataaccccgaatgctaatttaattttgtcaaatgtcttttagcttatcctatttttcttggataggggtaagtgaaatttctcctaattttgatgtaactttaaacatgtcctgattgtattttaaaacaatttctttagctatttcattcataacatcatcaatcgtattgactattttagtttttgaaatcggtattacttttatttcgtattctccaaatattttatcattaagatcaaatgttagtaatttctcctcagaaaattcagggtcgtagttttttaataaatttatcaattgaagaaagttaggatgtgctactttacatgtttcttgataatcaagatatatatgtgtatatttttcaccttctgatttcacgaaagagatattggctttttgatttactgttttattaccaaaaagggccttatttccttttatcaaattacaaaaagaatggtaatctttagttttataaaattttcgagcatatgcaatatttattgtattttctatcaaggttttatgcaaaatcatagaagaagtcatgttattcgtagcttctaaaacaattaagccatttaatacatctctcgtattaattagcaacatttttaaaatcattctcaacatgtttactttcttctgctcttgttgctccatgattccagttggaattagcatgttatcaaaaggaagccaactatctatttttttctgttgttgcttcataaagctatcaacttcaatatccatattatctccatttttattctttttctatatgttatcatgacgttaagtcaagtttttagagtaacaaacgtagaattttaatctatttattttaagcacttaccttttcaaattgattaggtgtaagataccctaaactttgatggattcgttttgaattataaaaggcttcgatgtaccagaaaatactctgataggcttcttcaaagttcttatatttaaattgatacacccactctctttttaaatgtccatgccaagattcaagactggcattatgataagggtatccccttcgactgaaagagtgagtcatcccataatacttaagcaactcttcatactctagactcgtatactggcttccttggtcagaatgaagaataacagcttctggatagtcttgtgatttaatggccttatttaaagttctttgcactaattctacagtcattcgcttgcccaaatcccaagcaatgacttttttagtataacgatccataatggttgagagataagcccatccttgttgagtaggaatataagtaatgtcggttgaccaaaccttatttttctttgtaggttcagtctgtataagattttttcgattgatgtgatcacttagtgagtatccaggcttaaatttcttaatgactacagacttgagttgaagttgcttcattagcttctgtaccagttttaacccgactttttccccttgtttaagtagaagatgatgaattttaggagcaccatagattcctcggttagcattgaagagttgagacattttgagtggcaggtattgtctccttaattgagttttagatggatgtcggttaatccgttcataataacttgattcaggaacatcaaggagttgacagcttagtctgacattgagtgctaaagtttgtatggtttgagccatatccgcagcactcacttctttttctcggcgaatatggtcaatactttttttaagatgtctcgttcttccttaactttaaccagttgtctttttaattctagaaaatcagctttagagacggagctttcattagatttagagtagaggtctatccatttataaattgttgcaggggccacgtcgtattctttagacagctgggtgacggattgaccagaatgatagaaggcgataagggtttctttaaattcttttgagtagcgttttttcatgtttttgtcctttgtctaaattatacaatagtgactctaagatttaaggataacatcaatttcttgcagtttaaagtttgaaacccataccttcacttgcattaataggttttgtttcatataatatactaatatagtatagaaaattaaaaaaaacaccaaaatggtttaacttaagcaagttttgatttaatttttcagaaaaattagggtttttcttacagaatttaataaaaagaggggttatatttatgaatgatttattttatcatcggctaaaggaactagttgaatcaagtggtaaatctgcaaatcaaatagaaagggaattgggttaccctagaaattctttgaataattataagttgggaggagaaccctctgggacaagattaataggactatcagagtattttaatgtgtctccaaaatatctgatgggtataattgatgagcctaatgacagttctgcaattaatctttttaaaactctaactcaagaagagaaaaaagaaatgtttataatttgtcaaaaatggctttttttagaatatcaaatagagttataacaataataaatttagggagtttttcttattaatatgatgaaaaaaggaatttttgtaattactatagtgatatctatagcattgataattggaggtttttatagttataattctaggataaataatctttcaaaagctgataaaggaaaagaagttgtaaaaaatagcagtgaaaaaaatcagatagaccttacctataaaaagtattataaaaatttaccaaaatcagttcaaaataaaatagatgatatttcatccaaaaataaagaagttactttaacttgtatttggcaatctgattcagttatttctgaacaatttcaacaaaacttacaaaaatattatggaaataagttttggaacatcaaaaatatcacctacaatggcgaaacaagtgaacaattattggctgaaaaagttcaaaatcaagtattggcgactaaccctgatgttgttttatatgaagctccactttttaatgataaccaaaacattgaagcaacagcctcatggactagtaatgagcaacttataacaaatttggctagtacaggagcagaggtgatagttcaaccctctccaccgatttatggtggtgttgtgtaccccgtacaagaagaacagtttaaacaatctttatctacaaagtatccctatatagactactgggctagttacccagacaaaaattctgatgaaatgaaggggctgttttctgatgatggagtatatagaacattaaatgcttcggggaataaggtttggctagattatattactaaatattttacagcaaactaattaagttataaataacaattattaaatattggagaagaaatgcaggaaacacaggaacagacgattgatttaagagggatttttaaaattattcgcaaaaggttaggtttaatattatttagtgctttaatagtcacaatattagggagcatctacacattttttatagcctccccagtttacacagcctcaactcaacttgtcgttaaactaccaaattcggataattcagcagcctacgctggacaagtgaccgggaatattcaaatggcgaacacaattaaccaagttattgttagtccagtcattttagataaagttcaaagtaatttaaatctatctgatgactctttccaaaaacaagttacagcagcaaatcaaacaaattcacaagttattacgcttactgtaaaatattctaatccttacatggctcaaaagattgcagacgagactgctaaaatatttagttcagacgcagcgaaactattgaatgttactaacgttaatattctatccaaagcaaaagctcaaacaacaccaattagtcctaaacctaaattgtatttagcaatatctgttatagccggattagctttaggtttagccattgctttattgaaggaattgtttgataacaaaattaataaagaagaagatattgaagtcctggggctcaccgttcttggtgtaacaacctatgctcaaatgagtgattttaataagattgctaataaaaatggtacgcaatcgggaactaagtcaagttcgcctagcgaccatggagtaaataggacatcaaaaaggaataaaagataggagttcaggatggctaaaaataaaagaagcatagacaacaatcgttatattattaccagtgtcaatcctcaatcacctatttccgaacaatatcgtacgattcgtacgaccattgattttaaaatggctgatcaagggattaaaagttttctagtaacatcttcagaagcagctgcaggtaaatcaaccgcgagtgctaatatagctgttgcttttgcacaacaaggtaaaaaagtacttttaattgatggtgatcttcgtaaaccgactgttaacattacttttaaagtacaaaatagagtagggttaaccaatattttaatgcatcaatcttcgattgaagatgccatacaagggacaagactttctgaaaatcttacaataattacctctggtccaattccacctaatccatcggaattattagcatctagtgcaatgaagaatttgattgactctgtgtccgatttctttgatgttgttttgattgatactccacctctctctgcagttactgatgctcaaattttgagtagttatgtaggaggagtggttcttgttgtacgtgcctatgaaacaaaaaaagagagtttagcaaaaacaaaaaaaatactggaacaagttaatgcaaatatattaggagttgttttgcatggggtagactcttctgactcaccgtcgtattactactacggagtagagtaattggaataaattttaatcaaataaaagacagaaatttgtagaagaggagagcaaatgattgatattcattgccatattttaccgggtatagatgatggagctaaaacttctggagatactctgacaatgctgaaatcagcaattgatgaagggataacaaccatcactgccactcctcatcataatcctcaatttaataatgaatcaccccttattttgaaaaaagttaaggaagtccaaaatatcattgacgaacatcaattaccaattgaagttttacctggacaagaggtgagaatatatggtgatttattaaaagaattttctgaaggaaagttactgacagcagcgggcacttcaagttatatattgattgaatttccatcaaatcatgtgccagcttatgctaaagaacttttttataatattcaattggagggacttcaacctattttggtccaccctgagcgtaatagcggaatcattgagaaccctgatatattatttgattttattgaacaaggagtactaagtcagataacagcttcaagtgtcactggtcattttggtaaaaaaatacaaaagctgtcatttaaaatgatagaaaaccatcttacgcattttgttgcatcagatgcgcataatgtgacgtcacgtgcatttaagatgaaggaagcgtttgaaattattgaagatagttatggttctgatgtatcacgaatgtttcaaaataatgcagagtcagtgattttaaacgaaagtttttatcaagaaaaaccaacaaagatcaaaacaaagaaatttttaggattattttaaagggattaaatggagtaaataatggaattttttgaggatgcctcatcacctgaatcggaagagcctaagttagtagaattaaaaaatttttcttatagagagctaattataaaaagagcaattgatatcctaggaggattagcaggttcagttttatttcttattgcggctgcattgctttatgtcccttacaaaatgagctcggaaaaagatcaagggccaatgttctataaacaaaaacgctatggaaaaaacggtaaaattttttatattttaaaatttagaacaatgattcttaatgccgagcagtatttagagctacatccagaagttaaagctgcctatcacgccaatggcaataaactagaaagtgatccccgtgtaacgaagattggttcatttattagacaacactcaattgatgaattaccacaatttatcaatgtccttaaaggggatatggcattagttggtccaagaccaattctgctttttgaagcgaaagaatatggggagcgcctcccttacttactcatgtgcaaaccaggaatcactggttattggacgacacatggtcgaagtaaggttctttttcctcaacgagcagatttagaactctattatctccagtaccatagcaccaagaatgacatcaagcttcttatgcttacaattgcacaaagtattcacggatcggacgcttactaaaaaatgaaggaaaaacatatttacattattggttcaaaaggaattccagcaaagtatggtggttttgagacttttgtagaagaactaacagcacatcaaagtaataaaaaccttaagtatcatgttgcttgtttatcaaatgacatacaatcaaattttattcataatggtgccgactgttttaatattccaaagaaaaatattggaccagcaaatgccatttattatgatttggcagctttaaagtactcacttaaagaaattgtagaaaataggtatgagggtgcaattatttacattttagcttgtcgtattggtccatttattggtcactataaaaagcaaatgaaaaaattaggaattactttgatggtaaatcctgatggggagtgtgaaataatatggacaaccagagaaaagcttgatttcatgcgggtttgcgcggcttgaccttttcacctcaacttgtttttgcttgtcatggtgcgttatggccagcatgttttcaggggttgatggcttctggttgcgctctatacttaacccacctcagcgaaagctgatagagcagaaaacagaatgaggaggtatgaggacaagcctgcgtatagattgttgctgcaatctgtatacaggcttgttgttgtgctatgaagtaggaaaggtgaatagtgaaagacgagcatgacaatttaaggaaaagaactgctgggattgtgtataagcctaggccaagaataggaactatggaatgacggttggagagaagtaatggaagaaaaaatcagacttgcggttttcggacagaaacgtctttctcgtgaaggcgggatagagattgttgtaaaagagttatgcacccgaatggcacagaacggttgtgatataacttgctacaatagagcaggccatcatgtgagcggtgcagagtatgacaaaataattgaatatgatggcatccgtcaaaaggttgtcccgaccattgagaagaagggacttgcagcggtaagttcttcctttttcgcagcactttgtagtgcatttggaagatatgatgtggtgcatatccatgcggaaggtcctgcttttttctgttggataccaaaactttttggcaagcgtgtaatcagcactattcacggtttggactgggcccgcgaaaaatggaaatttggcgttggatcaaaatttatccggcagggtgaaaaaaatgccgtgaaatatgcagatgaaatcattgttctaagcaaaggcgttcagaaatatttcatggagacctacggaagggagacacattttatccctaatggtgtcaatcggccggaggtccgggaggcaaagctgatcacggatcatttcggactggaaaaggattcctacatactgttcctcggtcgtctggtgccggagaaggggattcgatatctggttgaggcattcaagaatgtcaagacagataaaaaactggtcatcgcaggtggctctagtgatacggattcctttatggaggaattgaaagaactggcgaagggtgacgatcggattctctttactgggtttgtgcagggagcaatgctggatgaactgtacagcaacgcttacatctacacactgccgtccgatctggaaggaatgccattaagtctgctggaggcgatgagctacagcaattgctgtctggtatccgatattccagagtgtgcagaggttgtggaagataaggcgttgatttttaaaaagtcgaatatagaggacttgcaaaaaaaactgcaagaggcctgtgaccatccagaaatggttataagaatgaagaatcaggcagctgactttatctgcgagaaatacaactgggataaagttgtaaaggaaacgatgaaactgtacaggagaaaataatagatgagagtattgataataaataatctcctctaaccgataaccgaatgcaggtagcgaaacaaggaatagttatgaggcgaaatacatagggagggtagagacagtggagaaaaagagagatagttttgttgatcaacttaaagggttagcttgctttcttgtagtctttggtcatgtaataataggaatacgagaagcgggaataccaaccccgaagagcatggtatttgttgaagaatatatttggacttttcatgttcctttatttatgtttcttagtggatatgtatatagattgactggaggatggtaagcaaaaggaacaagaaaaaaatttcttttacataaattgcttaatataggcataccgtattttgtgttttcaagcatttatattctgattaatagtatcacttctggagttaataatagcagtagtattagtgatattttaatgctttggagaacacctatagcacagtattggtttttacatgcgttgttcattttatttgtgatctggtcaattatacctggggggggaaaactcttaatgtaattcttacaacgatttgtacgtttgtaagtattatgccgattaatttggggatttttgcttcaagtatgtggatgtcattatttttcggattaggaacagttgttaatataaaaaaaatcagggaatggccactaaaaattaaaaatttaataattataagtcaagtgcttggggcaatatttttcttgaatatcataagcgaaaacgctattacaagtcgcttttttgcagtacagggaattgtcatgagcattgtggctgttagtttgcttgataaatgtgactgcgtagaaaaatgtatgctagtgcttaacagatattcttttccaatatatctattacatacaatatttaccgctggatttagaatagtacttcttaaagtaggggtaagcaactatttattacatgttttacttgggataatagtggggataggaattccaattattggtatgaatgttataaagaactgtaaaatactgttatttatattctatccttcttccacaataatgcgcctcaggaaaaacaagtcgtattaaaaatactaatacaagattaccagtattgaagaggagtttagagtcaggaaaaagtcatggaaacaatagcaaagataaagccgctataattagagaaaaaatacttatattgacagataggagactttcaatgatacgaatcctgcaatgtgtaaatgatatgcatcgagctggtttggaaacaatgctaatgaattattatagaaatatcgatcgaagcgagatccaatttgattttctgacacatcgtcccaatagaagcgattatgatgacgagatagaatcacttggtggaaaagtatactatgctcctcggctttatccgcagaattacttgtcatattttaaatatatgaaagaattctatgcgactcatactgagtataaaattgtacattcgcatattgattctatgagttatctgcccctattagcggcgaagaaggcgaatataccaattcgtattgcacatagtcataatactgcaatagatagagattttaaatattttttaaaatcttatttcaaattgaaattgccagaggttgcaaattattattgtgcttgtggtaaagcagccggggaatttttgttcccgggaaagaagtatacatatattccaaacgcaattgaaatcgatagatttttgtatgatgaaaaagttagaataaaaaaaagagcagagttaggaattaaagatgaagtagtcattggtcatattggcagaatgtcttatcaaaaaaatcataaatttctaattgatattttcgcggagatattgaaaagcaaaaatgattgtgtacttctgttaataggtatgggcgaaaaactggatgatataaaaaaatatgtggagaaattgggtttgaacgatcacattagatttttaggcaatagagctgatgtgggggagttataccaagcgatggatgtatttgttatgccatcgttgtttgagggtttgccggttgtaggtgttgaagcgcagttttctggtttaccgtgcattttttcagacaaagtgccagaagaagttgaatttactaataaagtaaagtttgttccattaaatgatgagaaaaaagtctgggcaaatattgtgattgcagcagcacgtgataataccaatcgtgaaatgccggaattacggaatagtatttttaatattgagaaatcggctactctattaacggactattataaacaactgcttagtagagtttgatagcatgtggaaaggaaatcaaaatgaaaattattactttttatcttcctcagtttcatgaaataccagagaacaatgaatggtggggaaaaggatttacggaatgggtaaatgtcaaaaaagcacaacctttatatgagggacatgaacagcctcgagtacctttaaatgagaattactataatttattggatcccaacgttcaagtttggcaagctaaaatcgcaaaagagtacggtgtatatggcttttgttattatcattattggtttaatggaaaactacttcttgaaaaacctatggaaaatatgctgaagaatagagatattgatattccgttctgtgtttgctgggcgaatgaaccttggactcgtgcatgggtaggcgaaacaaaggtattaattccgcagctgtatggtgaaaaaagagaatggaaagagcattttgattacctattaccattttttaaagattctcgatatatttgtgatgatggaaaaccgctagtggtaatatatagacctgaagttattgaatgtctaaatgagatgttagattactggaatgagttggcaattcaagaaggatttgaggggctgacttatacatatcagaatattgacttcgatttgaaagcagataaggatgattcgcgttttaaatataatatcgaatttcaacctttatatgctagacatgatatgtttaagaataatcataaatatattaaagctcttagaagaaaagtagcagcatttgtagaaaaaaactttggtttcgatctaatgagatacggtgtcggattcttcaataaaagcaatcaaattagttatgatgaggcgtggaataaaattctcacaagaaagccagaaacagaaaagaacgttcctggtgcatttgttggatgggataataccccacgcaaaggagagcgtggagaaatatttgttggggatacacctgagaaatttgaaaaatatttaacacaacagattatcagagcaaagaatatttacagcaaagatatgatttttatgtatgcatggaatgaatgggcagaaggtggatatttggagcctgatacaagaagtggctataaaaatcttgaggcgattaagaatgctttgaaatcaacaaatgagtttccatggtaagtgtgtgaaacgaaagaaggtaaaaaatggaaggtaaaatatcagttatagttccaatctataatcaagaacggtatctgaataaatcgatatcatcaatcattaatcagaagtacactaatctagagattattttaattaatgatggatctaccgattcgagtatagaaataattgatgactttgctttaaaagatagtagaattagggttttttcaaagccaaatggtggattagtagatgctacgatttatggtattaatcaagcgacaggagagtatattgcatttcttgatcctgatgattatataggaccactgtatctttgggatttactgtctcaaatggacgatgatatcgattttgtagcatcaggtttttatagaaataataatggccaattcatcccggtcatattatctgaagacagtaaaattgttggagatcaatttcaaaaattaagggaccattatttgttggatggaaaaattgatttctccgacaaaatttttatctctaggtggaataagctttatcgcgcaaatgttgtgacaactgttgcggcgccctttttcaattatcgcgaagtcactcttggtgaagattcaatatttacatatctgatgttatctcattcaagagggtgtaagacgataaagggccctaaagactatttttataatgtgggcaatcaaaattctatgatggttagtaataccatagaacgtcatatggaaaaaagtaaattagcatataattctttgaaaaatctgctaataaatgaagacttatctacaaagcaagcatatgcattatatttttttgaagttgaatctgtttttgaacgattaatgaagactgactttgaacaatttcgtaagttgtattaccaccttcgaaaagatgaagtatatactacatctttaaaattgtttagggacttgtcgtattcggcaaaaacttggattcgcatttttggtagattatattttccagcttttctatattcatacattagattaaagttaaaatcagacttaagaacaataaagttgttccttggtaatacaagatttatacttaaatatcttgtcaagaatggcctggttaaaacacattatcaaattaaatttagaagaagacgagataataattttaaggaaattaacaaattcctcccaattattgattcgagagttaaagaaataattacttcatatacaggcggcaagacagagttgaatgagtgtcctgtatgtaataatatttttttattttggtgggatgggtttgatacggctcctgaattagttaaggcgtgtacggagacggtgtacaagtactatccagattgcgcgattcatctaattgataaaaataattatagaaaattcactgatattgataatattattctcactgattttgaaaaggggaaaatatccatacaagttttttcggatatattgagatttaatcttttaaaaaataatggaggaatttggattgattcaacgataatgttttttaataagatggatctgttgaaaaatctagataataagccaattgaatctttggaattttcttcgacaagatattttatgaaatatgaaaaatacaattgttcgtggtctggatatttttttgcttctagaaaaggctctctctttgtaaaagtcgttgatgaagtgtttagagaatattatttaaagtataaagactattcgacatattttttcattgatatggttttaatgatgtgtaaaaaatatggccttgatgataatgcattagataatattcattttgcagacggagatatgatgctgatgctgagaacattaggtgacgaatataataaatgctatttatctcagtatgaggcagtgcctcaaaagttagagtggagatatgagggaaaagggaagaaaaacacaaattactgtcattatattcaaaatggcattcaagatcggagaagcgaaacatgaatgatattaatatattaacattttggggagtgcaaaaatatggaacgtttgcacagacttatgcattacaagcaagtatgcaaaaagcttacccggagtatgatgtaaaacagattaactatctatgccagaaacactataaacaatattattctaaatatccgatagatcctatatggaaaaaaacttttataaatcactgggtaaatatttaaatccattttcggattatcataaacgacgtaaaaattttctagtaacaaatacttaaaagcattaagaaatattatttatgatggttgaaaacataaatgacataattgcagttcgaaatgaatttttatataaaaggtattattctaacaagagattcggactaatgtttttgccttttctttgaatatcaagtgcgatcaataatatccggggtggaatatatatataagcgttataattaggatttataattaggataatatatgcgaagatttttaacaataaaaatttagcagtcaatatgattgttggtattaataggtaataaagaatttcctctaaccggaagattaaattgactcaagggtgcgttacgtcgcatttttagtatatctttaattgagtttggttgacaaggggtgtaaaagggagatatgagggcttggcatttactaggcgaagaaggctgacagaatatactaaaaaggaagaggtataacaaattggaattggttgtaaaaaagcaaacagtattatatgttttgctaatatttcctattttaaaaattaattatttattgcattttccgctctttacactaatttatcagttgatattattgtttgatttggtatattgcgttattttgtatttgaaacggaaacaaactccagctgcgtttgtagttctttttcttttgcttgaaatatggctttatattcaaacttacattaatcaaggagacattccagaagtaatgagagtggctcatagtgtaatatatatcgctatgatttttgatttatttagcaacaatattagaagtttaatgaagtgtttatattactatttctttgtttttgcagtaataaatttattacttatgatattgtttcctaacggaatttattccgtgtattcagctgcctatagcacgaatactatagagtggctcttcggagttggcaatgtttcaatatcgtggtactatccagcggtggttgttgcttggatttattcgactttgttaggaaataagaagtacggatggtacatgagtgctgtcgcgctgatttcagatttgattgatggatcggcaacaacaatagttggaattttaattatacttattattcagaatatttctttttttaagaagattctgaagccaaagatagggtgtattttggtagctgctgcatttgttattgttgttgtgcaacagaagtttgattttttgcaaccatttattgtaggatttttaggaaaagatatgacttttactggtcgacttatgatatggaagaatgctattaatgcaattttgaaaaatccaatatcagggtatggtgttatgtatcctaaagatattcctagtttgctagggataatgcctgatgtggattatatatgggctggtgcaacacattgtcatgataattatcttcagatattatttaccggaggattggttgcaggtttaatatatttattgttgtacagatcggcgattaaacagttgactcaaaattgggaacaccctgttgcgaaagttatttcaggttgtttgttttctttttttgtgattcaaatttcagaggcgtttgataacagcataataatatatttggttatagtgttggctgtaaattcgaaacgactaattgaggcatatcaagagccggattatgaacatgtataaattgtattttggactgtacagaattgccatagcttaaagattttagtttagatgggtgtatagagcggaaatggagagcatctatgcatgaaaatataatatttgcggtcgaatatgctttgcgtatgcattacatagatttctagcaaggcctcctatgacattttgaagcaactgatgataaaggagagaatagaaagtcttcatattaaggagtgtaaaaggtgaaaattaatcgaacaaaaaacgcagcaagaaatatgatgatgggatttataaataaaatcattgtcttgcttttaccttttgtggttagaacggcatttatatacagtctaggagcggaatacttagggttaaatagtctgtttagttcaattttatctgttctgagcgtagcggaactaggatttagcagtgcagttgtttttagtatgtatgggcctatagcaaagaatcaacaggataaaatatgtgcacttcttaattattaccggtctatttatcgagtgataggaacggttgttttagctggtggaatagctttgatgccatttttgccgaggctaatcaatggggaatgtccagacgaacttaatatttatattctgtttgccatatatttgtttaatacagtttctagctattggttcatggcatataaaaaatcggttcttgaggcgtttcaaagaaatgactatatatctttgaatgatacaattaccacgggcttaacaaatattattcaattaattcttctgatagtatggaaaagcacctatgtatactatttttatgttgcaacgatgctggttttgactattataaataatattctcaatgcaagaattgtaggcaagaagtttccacagcttaaatgtgagggaaaggtaacatcaaaggacaaaagggaaattaaaaagcaagtatccggtttgatggtttcgaggctatgtttcatgacacgaaattcatttgatagtatttttgtttcagcttttattagcttgacgatgactactatttacaataattactattttatagtaaatgcaatcgttggagtgatgaacgtaatcacaagtgcgatgataggtggtattggtaatagtattgctgcagaatcgaaaaagaagaattataacgattttactgtgtttaattttatatacatgtggatttcaatttgggcgacagttactcttttttgcctttaccaaaattttatggttttgtgggttggtgaaaaattaaccttaccactcctggttccagttcttttctcaatctatttttatgctctaaaaatggctgatattagaatcacatatacatccgcagctggattatggtgggaaaatagatcccgtgcaatatgtgagacaattgcaaatctcatattgaattatcttttggtgcatatttggggtgtttatggtattgtgcttgccacaattattccattgattttaattaattttggattcggagcacaagtcctatttaaacattattttacagatgaaaaaatttccaaatattttattgataatttgggttatgctgtagttacaataatctcagtgatagttacgtttaaagttacgacttttataggtgaatacactgtggcgaatttgtttataagaggaatcgtttgttgcattctccccaatattttactttggtttgcatattttagaactttgaaatttaagatggcaaaggagtgggttcttacaaaaataaaaaggagacactaatcaaaagcttgttctaagaatatattattgtatagcaaaaaagttgcagtttttattcaaggtgaaggttatattactaacaatattccgaaatatcatgagtattagaaatggaggttattatgaattctaatcaaaaatctctgggggggcgacgcctttaagagataaaaatgtaattgttaaattattgctctggtgttcgctgtcagtatttataggactaagtgctatatcgcaaggaggcgtaacccgttttatacctggcattttagtctctacaacaatcttgttttatttgattgtaattcgagcaaatagtgtaacctatagtagcttgaagcagtttaatactaaaacaggggtgctcagcattgcttcgtcagctggaactttgtgttgtgtggctgatacaatttatcatatggtaatgaaatctggagcaattagtaagctgatgagtaaaggtatttctactacaactatacaagctgttgtagtaattgctttactcacaatgtcgtttattgcaatgtatggagtaagtgtgatttttaattacgttctttctaacgttgttgcattaatcgacacgattatcgataataagtatgaaattaataatatagttgctatcgttgtttgtgcattgtatttttttctgattgtttgggtttatagaaatactacagctttttatggatcaggatacaatgatgtgatttacggaagcgattcttacacattaactggttcaaatgtatggctatcactttttcaagggcaaaatgacttaaggcagcctttatatatgcttacggcggcaccttttatgggcattgcatatatactaggcattattttgaactgcttttatgtgaatggattggctattgcatatgcgtttgttcaggccttgttgcttgtgtggagtatttggctattaagtcatctgatttcagacaatgatatcattagatctttgattatactgattttaagcgtctcttatccagcaattgtattttctttatgcttggaacagtatgtctcttctttcttctggttgattatggctgtagtagccgttatgtatgaccagaaaaaggcagatttgatgatcataggggctgcaaatggattacttacatcagcttttatggttgtttggaaaaaagctaagtctttcatagaatggcttcaaagtgcattcaaatgcggaatgctgtttcttttaacattatttgcatttggtcgtgcggacatttttcttaatataaaagctaatctagcagaaatctttcagtatacaggtaaaaagctaacaattgttgacaaggcttatcagtattcaaaatttgttgtggattgttttgttggacaacctgctgttgaaaaggtacataaaagcggattcctaatttgggggtctagtgagtctaccacaattaatgttgctggagttattatcatagttttgatagtaatagccatttttttggatatgaatttgcaaatggtataggaaatgcccttgcaaattttatttgcattctctttgcttatgtaacaaatcgaacagcggttttttgcagcaaaagttcaggaattagtgcaattagagaaattgtgtgttttatagtatagctccaaatttagatgaattcaaattactatgcagaagaattaaaagatgttaaaatcaaagtttacacgagcgatttatttggtcgtgactaaacaacaattttggaggagaaattggaacaaaaaaaaaagagaaaaaataatatcttggtgataattatacctattttaatttttattacccttataggagcaggggcttatgccttacgagattcacttattcctactgatcatacgaaaaccaacagttcagatcaacctaccaaaacttcggcctctaacggttatgtagagcaaaaaggggaagaagctgctgtgggtagtatagcacttgtagatgatgctggtgtaccagaatgggttaaagttccctcaaaggtaaatctagataaatttactgatttatctacgaataatatcactatttatcgaattaataatccggaagtcttaaaaacagttaccaatcgtacagatcaacggatgaaaatgtcagaagttatagctaagtatcctaatgctttgattatgaatgcttccgcttttgatatgcagacaggacaagtagctggatttcaaattaataatggaaagttgattcaagactggagtccaggtacaacgactcaatatgcttttgttattaacaaagatggttcgtgtaaaatttatgattcaagtacacctgcttcaactattattaaaaatggagggcaacaagcctatgattttggtactgcaattatccgtgatggtaaaattcaaccaagtgatggctcagtagattggaagatccatatttttattgcgaatgataaagataataatctctatgctattttgagtgatacaaatgcaggttatgataatataatgaagtcagtgtcaaatttgaagctccaaaatatgttattacttgatagtggcggctcaagtcaactatctgtcaatggtaaaacgattgttgctagtcaagacgatcgagccgtaccggattatattgtgatgaaataaaaataaaagaacctcttggttcttttattttagagatttttcaaaaagggttttgactgagtctaattctgtttgagaaacgaccttagctccattttcatctgttgtatgtagattgagcttgctggtattctttagagccttattgtagctcataacgatcgttttagcatcattgaaacttatattggttttaacagtgtttgaaaaagcatagagaatttctcgatagtaattgaaactttcaagttttttcatatgagcaattttttgaatatttccgtagagttccattgagacattttgaattcgagtgattgaagcatccaaatcagtatcgtcaatttgtgtcatataggcttggacttgatcagaagtttgtaaattaacagttccttgtttaaactcataaccttcagcattgaatgcctttggattttgcatggtgattccaccagtggcctgtacaagtgatcccattttattaacatcgatctgaattactttgttaatggacacattcaataggtctttaaccatctggaaaattccatcatctccattcgtattataaacttcagtgattgttttttgattaggcattgtcgcaaaaactgggaagttcatgaaagtagtttgatttgtctttacattcgttgaagctaaaacagtagcataagctgtatttttagaattatttttaccagttgcaatgataagtgtggtgaatgttttagacttttttaagtcgatacttgttgttttagggaaattttcatacgatgttgaaaatgttgattcaacatttctataagcggcgtaggctatagaagcaacagcgataattactaatacaaaaataattgaaataacttttagtactgtgtgttttttcttacgataatgacgcctctttttttgattcatggtacctccatatatatattttccactcgtgatattgtttacaattgttgcattcttaactgttagaatcgtatccgtagaaatcgttccatttgagccgaaagctctggctgttccatcacttccaccaatactctgagccgttgtataattcgtgtcattatcaagatagagagtataattatttccgtttattgataaagatttcccactagaaacggtgttgccagagttcaaaatactatttccgggaacatttgccgttacattaagaaaaacagtattgcttgaggctgcatttggtgtcactcctttataagtatcaatcatatcttgccaattgctcacattatagtaagttgctcctgttatgcctgtcactgttcctgtcgtatcaactgttccacctacaatagctgctctagccttgggagctaaaccaaataggataattaaaaatcctaaagtcatgagaagaataaatctttttattttcaccttttctcccttctatggtcctgttacaagtgttgaggtaatcgttgctttataagaacctgtaacaattactctagttgtcccatctactgttagttgcgctgtcacagcaccactattcatcgttccattcgctcccgttccacttcgcaaaacaacaccattctgtttgaaaatgttgacgttggaacttccaataagttttccgtcagaactattcgctactgaaacataaaagccagtcgctggtaaaacgatagtgttagatactaaagtaaagtccgaaattgattgttgaagagaaaaacttgttgatgttccagataaattaacaattttaattgctgcatctcccgttgcattgctattgattactgaagagcttgctgtttgagtgccaaaattaaaatttggagcagtaagagaccaagtgtttgttgttggtgcagtcacattaatataggcattcgctactgaattttgactgtctatagcagtatctgctgagatgggcctttcgacaaataaaaggaaggaaatattaataaaaaagaaactaaaaatgaatatttttactttattttctctagtcattcacctaccctctttcaatattttgtcgtttataaattactaagtagtctatatatcttttataaccttttttctaactcaagtctaataaaacgctttctttaatacatatgtacgaatattaatacataattgaagtaatttttgttttttttatttaaaaataaaaaaagccccgtttgggacttctttattttttaaatatttttagttgtaaaactacgactttgcattacttttaaaattgcagcaacagtatctagtgatgtgaaaagtggaataccgcgactaattgcttcttgacgaatacggaaaccatcggtagccgttgttaatgaggcacgagtatttcccattgtgttcacaactgcttgaacgcgtccatgacgaatatcttcaactaatgttccttcttcatcttctccaccagctagtttttcaacttcacggacataaagtccattttccttaaagaatgctgcagttccttgagttgcaactaatgaataacctatttctgcgaaatctttagcaagtgctagcgtttcttctttatcttcatcagcaactgtgaataagaccgaaccataatctgccatgtgtagtttagcggcttcaaatgatttataaagtgctttttcaagggtcatatctgaacccattgcttcacctgttgatttcatttctggaccaagtaagctgtcaacttttgctagttttgtaaagctaaagactggtgctttcacgtgaaccatatcaggagtttctgctaagccttctgtgtagcctaaatccttcaagtttttccctaaaatcatttgtgtcgccaattgtgccattggaatgtttgtcactttagataaaaagggaacagtccgtgacgcgcgtggatttacctcaatgacataaacttgttcttcaaaaataacaaattgaatattcatcattccgatgcagttcaaaccaattgctaatcgtttagtgtaatcaacaattgtatcaataatttcttgtgaaaaagtttgtggtggatagacagccattgagtcacctgagtgaacccctgctcgttcaatatgttccataattcctggaagaagaacttctgtgccatcacagattgcatcgacttcacattcacgtccttgtaaataagaatcaacgagtactggatgttcaggtgaagcttttaccgcacgattcatgtaatcacgcaggtctttttcattattaatgatttccattgctcgaccgcccaaaacaaaagatgggcgaataaggactggataaccaattttgttggcgttagcaacggcttcttcttcatttgttgctgtagctcctggtggttgtggaatctctaaatcttgtaatgctttttcaaataaatctctgtcctcagcacggtctaaatcttcaacttgcgttcctaaaattttaaccccagctttagagagaggttccgctaaattgatagctgtttgtcctccaaattgaacaatcacaccttctggttgttctaagtcaatgatattcatcacatcttcaaaagttagtggttcaaaatagagcttatctgaaattgagaaatctgtcgaaacggtttctggattagagttgatgacaattgcttcttttccaagggcttgaagtgcttttacacagtgaactgtcgcataatcaaattcaactccttgtccaattcggatgggacctgagccgagtacaattattttctctttgcttgaacgtttagattcattttcccattcataagttgaatagaagtaaggtgttgagctttcaaattcagctgcgcaagtatcaaccattttgtaaactggaataatttgattttcttgtctacgacgtcttacttcttctggactaacgttccataatttggcaatctgacggtcagaaaatccatttttcttagccatttttaagagttctggttcaaatatatttacttttaattggtcttcaatttcgacgatatggagtaatttatcaagaaagaaaatatcaatcttggttaaatcagcaatttcttcaatcggaattccacgacgaatcgcttctgaaacatagaaaagtcggtcatcttgtgttttaaccattttttcatagaggatttcatcatctgcttcttgtgcttcttgtaaatcattatgaaaaacaccaatttcaagtgagcgtacagcttttagaagactctcttcgatgttacgtccaattgccatgacttcgcctgttgctttcatttgtgttcctaggtggcggtcaccattttcaaatttatcaaatgggaagcgagcgatttttgctacaacgtagtcaagtgctggttcaaacatggcataagttttattagtgactggattaatgatttcatctagtgtcatcccaatcgcaattttagcagacatttttgcaattggatatcctgttgctttagaggctaaggctgatgaacgacttactcgtgggttaacttcgattactcgatattcataagagtgtgggtcaagggcaagttgaacattacatcccccttcaatttttagggcacgaataatatttagtgaagcgtcacgaagcatttgatattcgttatctgagagcgtttggcttggtgcgaaaacgattgagtcacctgtgtgaactccaactgggtcaaaattttccatattgcagacaacaatcgcattgtcagcagaatcacgcataacttcatattcgatttctttataaccagcaattgattcttcaattaggcattgtgttactggagaaagttttagtccatttgccacaatctcacgaagttcttcttcggtatcacaaattcctccacctgttccacccatggtaaatgctggacggacgatgataggataaccaattttgtcagcaatttcaactgcttcatcaaccgttgttgcaatatcactggcacagagtggctcaccaattctttcacataattctttaaagagctcacggtcttctgcttggtcaatggcgcttaattttgttccaagaagttcaacattaagctcttcaagaattcctgttttggataattccattgccatgttaagtcctgtttgtccaccaagtgttggcaataaggcatcaggacgttccttacgcaaaattttactgacaaactctaaagtaattggttcaatatagacagtgtcagctatttctctgtcagtcatgattgttgccggatttgaattgactaaaacaacttcgtagccttcttctttaagtgcaagacaggcttgtgttcctgcataatcaaattctgcggcttgaccaataatgattggtccagaaccgataatcatgatttttttgatatcattgcgttttggcatttgttttctcctttgtagtaaagcataacttcgttgcaaatgattcacaacccgcttcgctccttgcgcactttattttcaacattaaaatgtcataaataaagcaaaaacatctgccagaaacctagcagatgtgtcctaaaatgccttagcaacttactgacagttctgtcagtaacttttaaggataatatttcttgttcacaaccttgctagcctctctggactagattaaaagttttattgtttattagtttagcaaaataattgagcttttacaagttttaaaacacttttccttaagaaattaattaaagtaatttttggatttcttcttccatttctttaggttccgtttttggcgcaaaacgttcaataacatttccttctcggtcaattaaaaattttgtgaaattccatttaatggtcccgctaagtgccccttttgcttcttttttcaaaaattgataaaggggatgtgcttctttaccattgactttaattttttgaaacatggggaaagtgactccataatttaactgacaaaattcattgatctccgaattttcgccagcgtcttgattagcaaattgattacagggaaaacctaaaatttccaatccttggtctttatagttttcatacaacttttcaagtccttcaaattgcggtgtaaagccacatttacttgcagtgttaaccacaattacaactttgcctttaaaatcagacattgaaacagtttcgccgttcattttaacggcactaaaatcataaaaattcatttgattgcctccatggcttttatttaattatttattgacaataccgattctgtcagtaaaaatttatggctgtcagtaaaattttactgacagaaattttatcgcttacttcttaactatttttagtataacaaatattgatttttaagccaagaacttgaattttatgttaaactatttttatgaaatataaaactcgacgaagaaaaccaaatcgacgtcaatccttgttaaaacagctcatctttattttcctagttattttaggaatcttagtctataataaaatttttaataaccaagcacaaaagccgtctgaagcacaacttcaagaaattaatgaacataaattcatcaaagaaattgctccactcgctcaaaaatcacaaaaagaaagtcaggtactcgcttctatcaccatcgctcaggcctgtcttgagtctaattttggcaaaagcgaacttgcaagcaaatatcataatctttttggtgtcaaagcatctggtgatgtgccaaaggtttcgcttgctacgcaagaatatgaaaatggtcagtgggtcactgtccaaggtgttttccgtgtttatccaaattttgctgactcagtttcggcacacacccagcttttcctttacggaacaacatggaattctaaacaatatgcttcggttcttagtgcaactgattataaaactgctgctaaagccgttcaaaattctggctatgcaacagaccccacttatgctgacaaacttatcaatatgattgaaacttatcatttaaatcaatatgataaaagttcaagtatttaaaaatcactgacagatttttgtcagtgatttttttttaaaattttaatgtttttcaaaaacacctttaattgacttgagaatttccatacagattacagcaattacggcaagccctgctgctacaatccattgagaccaaccaaaagcagctggaattgagaaaatttctctgaggaatggaagagtagtcaagctgtataaggcaagacagaaagtcacagccatcaaaacgtacttattcgttgtaaaaccaagttttaaaatattttgtgaatttgaacgtgcagcaaaagtttgcaaagtacgtgccaaaatcaaagttgtaaaggccatagccacacccatttcaggtgatgttttttgtccaacatattgtgaaataatcgccgcaatcccaatcaatgaaccacgaatcaaaataacccgcattaacccattggcaaagattccttcatttaactgacgaggagctttttccataacatctggttctgctttttccatccctaaggcaattgctgggacagagtcattgaccaagttaataaataaaagttgcaaagcagtgaaaggattgacccagcccacgaccaaagcaaagacaatcgcaataatcgctcctaagtttccagagaaaaggtaactaattgattttttgatattatcataaaccacacgaccaattgatacagcagaaacaattgatacgaaattatcatcagtcaaaatcatacttgacgcatcttttgctacatctgttcctgaacccattgcaatcccaatattagcttgtttcagggctggagcatcatttacaccatcaccagtcatcgcggttacttgatgctcattttgccaagcacgaacaatccgaattttattttcaggagaaacacgagcataaaccgaaatcttttctaagttttcacgaagttcatcctcagtcagtgcgtcaagttcttgaccagtgagcgccatatctccttcgttcatcaaaccaatatctttggcaatggcttgtgctgtcgttttgtggtcacccgtaatcataatcgttttaatgccggctttttttgcttcgacaatagaatcataaacagcttcacgaggtgggtcaatcattgctgacagaccaatcagaatcaaatcattttcgtcagtaagtgtgagttcagtcttatcatcactgacaggtttgtaagcataagccaatacacggagcgctttttgactgaaagcttcattttgagcttgaaatttctctttcaattcaggagtaaattcttgcacttttccatccaagaaaacttgattacagtgattaaagagtacatctgggccacctttaacaaaaattgttttctgaccttcaaaatcattaattgtactcatcaatttacgttctgaatcaaatggaaattcagccagacgtggtgatttttctcttaaatcttgatatggatagccgattttgtcactgtaagcaattaaagccacttcagtagggtcacccagtgcttgaccttcttgtgaaaatgatgaatcattacaaagcaccattgcattaagtaacaatttttggtctgcctgtgttaaatctgtcagttctttactgccttgcgttggcaagaaagaatcaacaacggtcattttgttttgagtcaaagttccggttttgtcagtacaaatgaccgaagttgaacccaatgtttctacagctggcaaattacgcataatcgcatgctgttttgccattttatttgttccaacagataaaacaattgtaacaactgatgaaagagcttcaggaattgcagcaaccgcaactgcaactgcaaacatgaatgaatcaagaacagccttttgcatatcagccgtttgatttgtcgtaaagagtctcaaaatttgaacagcaaaaattaaagcacagagcgctaaaattgcccaacctaattgtttaccaaatttttccaatttttgttgaagtggcgtttgtttagcttccgcagtttccaacatttgagcaattttaccaatctcggtttgctcagcaattgctgttacaagaaaatctgctcgtccataaacaacaagacttgaactgaagaccatattcttgcggtcaccaagtgcaacttctccctcaatgacatctgaaaatttttcaaccggttcagactcacctgtcagcattccttcttcgacacgtaagttttgaacatcaattaaacgtccatctgctggaataaaatcaccggcctcaagtgaaacaatatcgccaacaacaagctcacgcgcaggaattgatgttttctctccattacgtaaaactttagctgagggtgccgacatctgtctcaaagcatctagagaactttctgctcgtttagtttgcacgactgcgaccactgaattaatcatcaaaacaatgaaaataacaagtgattcaacaaattctcccaagaaaagttggacaaaagcaactaaaagtaagatgataaccattgggtctttcaaagtatcaataaaaagttcccaagttgaagtttttttcttttctttcaattcattgaaaccatctttagcttgacgattttcaacttcttttgggctcaaaccttcgaattgacttttagttttctctaaaacttcattgacggattgattgtaaggctgcataatgattctcctttatttctaacagatatcatgagaggttttacaaaaaaagacctctgccagatatcaaaactggcaaaggtcttgctaaacatacataagtatgtcaacaaagccggtgagaatctcacgaattgacgactttgtttcggtcttaccgacgctactcccctttggaatatttaagttaccctcattttattaaaaatgggctcttttgtcaagttattttcttattttttaaatacaaatctatgattatgattgatttctaataaatttaatagcttctcgattctgttcttttaaatcaatcccttgtgctttagcggcaaaaatacatccacaataacattgacgataaacatcgtattctttacacatctctaccgaacgtttatagccgttattcttcttaaaatcacttggaagataattcacatcataaatcttttgaatatcaagaccaatttcattaattaattggctattcttctttggtgataaagtcaaagcactaccaaaataatcaaaaccaagttctaaagctttctcagcaactatatccaatcgcatttcaaaacaagaggtgcaacgttttccaccctcaggttcattttctaaatgtttttgacgaaccatttgtaaaaagacatttggttcatattcggcagcaataaattgaacattatttcctgtccgttcattaaaatcgtttacaaattgttcttgaaccatttttcttcttgtatattcagttgacggatgaatatttgaattagcgaaataaatcgtcacatcagctgattttgtcaaatattctaaagaataagtgctacagggagcgcaacagctatgaagtaaaattttaggacgaacagaatctctttcccaactttcccgaactttttgaaaaacacgatcataatttattttttgattaggattcattttttcaatgatatttaaactattttccatcattacatccttatattctctctatttctgtcaattattatatcacattttgaaataaaaaatgacctctttcaagaggccactattggttattatatctgttaaatcaaattcttggaaatttgaaaaatctaagagatattggataagataattctacatattttcgagtttgctttcaataccatttattggtaacttttgttaatcacaaaaataatctactcactaaaataactaatttttcttctctctaaacttttccaatgaaatacttgcaaatggtggaagtggaacagtgggactttatcaagttttgccagacgggtctttctatctagtcactcgtgattcaactaacaacacctatataagatatcaataaaaagctaataagctctttctataacagagtttattagctttttttgctataattataagtatgaataaaagcagaatagaggcgcttactgacggaatatttgccgtagtaatgaccctaacagttttagaatttaaagttccagaagatggaaatcttttttcaccaaatgtattacttatgctccttatttatatcactacttttgttgcccttgcttccatttggaactcactgcaccatgtaatgacatttatcaaatcaaataaagttgatgagttaattctctggtctaatcattggattctacttattgtttgtctctttcccttttcaactgttgcacacgcagaacatccaaactctttgactgcaagtttagcctatgtttcaacctatttaattccttggattagtttgattgttttcagtcaaataatttataaacaatacaatgggagtgctactcttcgaaagagtaatctggaaagaattaaaatctttctagtctttttactacctggagctctgatatcacttgtttggttgtacgctctgccaatagtgactattttaatggcaataaattggggaagacatagcaattttgattaagcgtctaaacaacgcttttttattaccgttttgcgatttatagatttcttgactccaaacaatttatttctgaaatataaatgagtatttcctcaaaactgaccttacataaacgtaagttataccttttattttccatattaaaatagataagtaaaatatatttttgtgaggtacttttttgaaacaacgttttggtttatctggctatcaacttaaaataatagcaatcatattcatgctacttgaccatatttacctagaagttcttctaggacttcctgggatacccgatttttctatcttagatatgacatcccgattcgtctcccctctcttcttttttctaatgattgaagggttcttttatacccgaagtcgaaaaaaatatctaacacgccttctagttgctggagcagtcatggctctcggaaatttagtcatacattatctcatgaatgtctccataagcttttttaccatccttaatccaaatatctttctgagtttagcctgtggttttggtgctgtatggctccttgatactattatagaaaagaagaaaatattgctgatttttccgctcattttcgtttcagctctctcaatatttactgaagcaagtttagttgctctaatccttccatatttaatgtacgcatcacgtaaaagtggaaaagattggattctttatattggtacactacttttatcaatcttatttcttctacaggccttttcttttgagacttccatgtcgctttggcaaagtatttctcttaacccagaattcctaatcatcaccgttcttccttttatttacctatacaatggcaaaaagggtggtcgctcttcagcctttgaaaaatattttttctatggtttttatccaattcatatctggattttatttattattggtcacttactaaaccattaaataaatttgaaataaaaaaacgctaatcgcagcgcttttttatccttaaagaagttaattttaggttcaaagcgatagcaaaagaattattaaagttacaagtgccggtaaagcttgaacaaataatatttttttcgtcactgtcaaagcaccatagattccaactaaggtgacaaaaagcatcgcaataataaaaacggaagtagctgcattcattatggctagtactataatcatcaaaccaaaaccaagattataaatcccttgattggagagcgcaacctgcaatgtcttattttttaattcagattcatcaaaaccaaaagcgtcagcttgtaactttgttcctccaaacatctcaataaatccaaacaataaatgctctattcctacaataattattaaaataagtgatatcataaatttctcctcaactagattatatcagtataaattagatataaaaaataaaaagaactatcactaatgataggcctttttattataaactgattcttatccttgaacgatagttacaccacaaggtgcatgattgacaacataattcgtcgtagatcctgcaagtaatctatcaaacgctcctgctcctgttgcccccatgacaattaaatcaatatcgttttccttagcatattgaacaatttctcgttttggagaacccgataaaatttgcgttttgaatttagattctgctggaataatagagcctactttgagtaaaatatcatttgccaacttatccaatcctggagtctcaacaataccgtagttagcaatgccataatatcgcactaaatctttaacggtcaatacaattaactccgcttcagaccattgcgctaacatcactccttctcgaaccgcattataagcttggtcagaaccatcgacaggaactaatatttttttatactgtttcgccataataatacctccacctattcttataattttattataatactatcactaacaaaatgaaagcgataaacattatataataaatgaaaataaaaagctgaccgaaatcagttaaaacttatttattttttatatgctttaagttcttcttctttaaaatacaattgttgacttccgttaaacctaactaagattcctgctttattttcagcgattactgtaccgataattcctttatatcttgtatctggtaaatttactaattgtccgattttatacttcatttttactcctttttaatagataaaataaatcatttttcaatcattttaacttgtccttttattaaatctcttgtttttctaaactcagccaaaatttctgattctgtccctgtcgcacgagcagggtcttgtaagtcccagtgttcgtgattaactcctttaggaatcatcggacatttatcaagagcatctccacataaagtaattatcaaatcacattcattaaaataatctaaatcaattagctcagatttctgagaagaaatatctattccctcttctgccattactttaactgcacgggggtttaaaccatgcatttctatccctgcggaccgaacctcccacccttccaaaattttatgcccataaccttcggcaatttgagaacgacaagagttacctgtacaaagaaaatatacttttttcataataatgctccacttatttttattaacatattatataataatttatattttttctcttagttgactattccacctttcaacgatgagaagttgagggacagtaataacatgaaaaaaccaccattggtgggccatataaagaaatcttcaaataggaagatgatgaataagacaaccaatatacattggctgcctaaggaggatgtggggttcgaacccacgcacgctcttacacgcctgacggttttcaagaccgttcccttcagccaggcttgggtaatcctccattgattgataaagtatatcattaaggaatactatcattagttaataataggtaatagtaataggtaataatattagtgataaaatatttttagtttaataaagctagtcgagttagttttattgttactcatttacagggctctcattcttagcaagtttgagtcttttgttagcttttgttaacgacaagatattttatctagtgttataataatcatggccaaagaaaactattttattgacgatatttgctatttacacattatctttttataatcagaatccggccaattttgaaataatttcttctactattttgttgtctagtagaggttttttattttcttcatcaatatattgtgaactaaatttatattttgatgactagtatttgaatttccctatccttcttataattccaattattttgtaatcacaatgcttaaaaaatctcaatcaataaattagaaacagtgtctaagaacatgcatcgtatcatactaattttatgaaacttattattcgtttaagctagaattgatagaattataatgtaccattctaaaatatagaaatcatgatttatttttaacttaaaagatctggtacacatcaattccactagtttttaaaattctagcggtttttcttataaaaaagcgtctaaagtgatagacgactggaataaattcattacacacttcttttcttaatgaataataaaaagacgtctaataaatttaaacgtcttgctacacactgaaatatcttatagaataaaaaacttatagaataaattactttataagacagaaattggtgcatagataattcaattatatgaagttgtatagatattttcaagtaaaatggtcgattataaaaataaaaatggcagcagatgactgacattatatttatagttttagttttatttagattaaatcaaactttgtaagtagaactttatctgttcatttttacttatttatcgttgttttaatatgaattagtgtatttcataggtaacacggaataaactgcacagaaatattggtgaagtatagcagctatatttgattatagcaagtataatcccaattattctcatactttttgtttacacgatgatatctaataaatcgctagataacttatcttgcacaatcatttgtatattagttattgctttcgccacattgttataaaaaaataaaataaaaccctgaccgaagtcagggttatttttaataattcggttcagaatatgcgttaaatgcgataccatcatttttccatccggcttttattagataatttctctcataagaactcattgtaaagtgatgcgaacctacttttgcatttggattatataagcggtaaacaggtacaccagtattggccttagcaactgggaatgtaaagttttccccatcattgctccagccaaccgaaacaaggctcatgacttcaaaattacttgttgtataatgatgatctcctgcatttggattatataaacgttgtacaattggatagccactatatggaggtttgacctgagaagcataaaatgcgactccttcagctttccatccctctttctctaaaacaactatttcccaaccagaaggcgtgagtaagtgttcacctgtgttaggattgtaaattctaaaaattctagtatcaaatttttcttcggaaggctgttgtgctgtatcagcggaaacttgatgtgcattaataacccctcctgttatcaatgccattgctgctaaaattactaaaccaatttttttcataatatcctcctagatattctcctagacatcacatttatatatattaaacaagaatcctcaaatatattgtgtgtcttttaataattcaacgattagagtatatcactttaagctaaacattacaaaaataaaccaatttcgtaaccaagacaatacaataactaaaaatgcgtacataaaaagcgccataggtggtgattgaaagtatttattaaagaatttcttttggaaaaaattatttaaaaagtttttttattaaatgaataataaaaaaagtacctgggctagaggtacttaagaatgaatctataaaaagatttttttactataattattataccttttttaagctcattactgaaataaattttttacaaaaggagaatgctcagagggcaggtattagtttatcaatagattttatttgctataaaaagcactaagctcataagaaccaaactaatatcacgataaaaactatactcgttatttttatcgtgatattttccatttgttttaattcatcaaatttcagtttaagatattcaaagtaaaagagattaaacctatcagaattgacgcatttagacacattcatgctagcttcctttttgattcaggtatgacttttaaacaagtttaatatagattaggatattctgattaaaaaactactattaatgtttatacgcatatcacagaattcactaaagataatatcgaagataaattctctgcatacatcgacttttaacgagctaaaaagcgctagtttttctatacttttttgggtatggttctgctttttatccgattatattggattaagaaaaacaaaaatcactctattgagcgatttctaatactataggattctataaaatccattcaatggaggcgaggggagtttttaaaacgctattataaaagagttagcaagatttacccctctttttttcactctccatttatttatggttcttgctggactcgaaccagcgaccgaacggttagctaccaactgagctaaagaaccaaataataatctgcagcacatatcttggttattatattagatatatgtggatggaactgcagattatcaaagatactgtaaaagaaattaatttctcatccactaaatatattataacatactactataaataattgacaattgtctgaaaaattgataatatttaaattgttagtacttcttattttttgcataaactaaactttttctgaatttgtactaaccctcatcatcctctagttggactccttgaagtcatccagctagagctttttttatttgaaaaaagccactccgaagagcagcttaattttagaaataggatgaaatcccacaatcatcccgtctacattataacacaatatcattgacaattgttcataaaattgttaatattataacagttagtgcaagttaatctagttttatactatactatattattcataccttgctctaatcacgtttcggcactggcttatgctagtgcttttttgatataaaaaatgcctcataagggggaagaggcatttaagaaaaattttataacgaacttctcatggatgaagaaagctcaaggaaataaaatatcaggatgatttattatagcgctatcattattttttgtcaagaaaaaagcgccccagttaggagatggacgcttaggataaacttatgaaaagtttttttggaatagttatattatagcacttaattcttaaatcaaacaaaagaaaaatatgccaataacgcttagagcatttcttttgacaacgctctcttttattggtattcttaaactatcaattaagaaggaaacccgaaatggttgggagaatatttttatttagtgggttcaattcccacctccttcattattaaaatcatcctactagtccgctgctagtaggatttttttgcaaaagaaaaacgccccggagggcgaggggttattttattagaaaaaaagaacccgtagggcccccaaaagaaagcgacgtacttttcatacgcttaatatcaactatcgctggtttcttttgtactcagtgtgatgaataatatcacctgcaaaataatcttatcattagtatacgaaattgtcaagagttttgtcaaggcatatgtaaacatttatgattgacaaattcacgcaagttaggcttctttaatctaaaagagttccaaattctattggctaaaatatcacttgcttgtaccaatggatattttgaagaatcaacaaaagtaacgtcacatttaaccgatgaattaaacagcggagcatgcctcttattatattgaaaattagttattcctacttttacttcttcgtatatagtatctcttaatttataaaatccatctgttgaagtaggttgttcatcaacaaaaatatgaagagcaaccgaaccattaggattaattttttgctcaaaaatcaattcttttaatttttctttaactaacattttcaatacataatctttataacggtggattgattttttgttatctaaaatactactataaacacgctcgatgtcaaccgttaaacctacactctcttcttttgctaaaatttgatatagtctatttttattacgatttgacaagccaaatgcttttatttccccgtcgctttttatttcatctcttattttttgacaaactgccctgtatttccttatggcatcatcttttgattcttttccaataaaaacataaccagcataaacgaagtatctctctggagcatttgggtgaagaactcccgaatcgtcaaaataaaaatacacatgttgcacaacttattcagtcatttctttgaatttaataaagctattatatcatattttatctttacttcttgaatctataacaaaaaatacccgccgaggcggggtttaattttacacttttgttaatttttcaactcgctcttttattaaatctctagtttttctaaactcttctaaaatttcttcatttgttccttttgctcgagctggatcttgtaaatcccaatgttcgtggtttactcctttaggaatcattgggcatttatctaatgcatctccacatagagtaataattaaatcacaactattaaagtaatctatatcaataagttcagatttctgttgagaaatatcaatatcttcttctgccataacttgtacagctcttggatttaatccatgagtttctatacctgcagatttcacttcccaatcttttaataatttatgtccatatccttccgcaatttgtgagcggcaagagttcccagtacaaagaaagtaaatttttctcataatatattcccttactaaattttcttaatatattataccttaatttatgatttaccataacaaaaaagccctgaccggagtcagggttaacttattatttgctatttaattcagccaagataatcagacctacaactataatcagccatatccaccagtagtctaaaaatatttttacattaggcaactcaataattctttgaaaaaattctttaattatatttacctcgtattactataccctgaccgaagtcagggttttaatttacacatttttacgatatagtttttccatctgtgcttgatatagtggaataactggtgctttagggaatgctttttgataattagtccacatccctgggtctgtaatccatgaatacataccagcattaatcatatagattcgttttgtatcaactgtttgaataaagtgcatttcttcttcctcatattctattgtgttatttaaatttgtttcattagtgattgatgaattgtctgctccacttggactcgcaagtgctttccattgattggcattgatgtaagctagatttatatcaagattaccgttccaattggcaagtgagcctgctgaactatactggtggatagccgctgaactccaagcaccatatcctttcccgtcagtccatggttcagattgataacctgtagggttcatagaagcgtactgcgcaacccataaagggttagtatttgaaatcgtactccagttaaactggcgagtaacctctgctgacatgtaaatcattggataaacgcctgttttttcttttactcggttcaaaaattgacgagcgccaacatttccccatgcattgattgcaccagcttcaaaatctaaaacaagaactgctttaccaatataatctttgacaacgctgataaagaaatcagcttctgcgattggatttcctacactggcaaaatggtagaaacccagaagtttatttgtttgaattacttgtccagcttgctcttcccaagttggatttatatagttagttccctctgtagcctttataatgacgaaatctgagggaacaattccagcgtttaattctgcttgatagctggaaatgtcaattccgttcatatcattctccttgttctgttggttctgatttttctacttcttcaataattggaaaaacaatgtcagccgctttctgcgttgcttgagcaacttgactagtagcttcgactgctttttcagtaacctctttaacagttttaactgggtcagcagtaaaattctttttcaattgagccaaagaagcttcaatttgagcttcaatctgtgctggattcgttttgattttaagattcttagcttcttctgtcacatagttaatggcttcagataacttttcaggattctcattgaagtttttctgtgcccaacttaccgcttgattagccaatttggctaaagcatcgatattttttacattgctatgctttttagctgcctgtgagatgaagtaagacactactgttcctactaaagttaaaacaccgctaaagattgtcattaaattttgatccattttatttttcctctttttcttttctatatttttcataaatactatggaggtaatgatttcctcccatttcttcgtattcgtcaaaaatacttccaacaatttgcaatccataatctaaagttacggcttgcataaattcaattcgcttaatttcttgtcgcataactagcatttgctcttcttgcgccttatctcgctcatcttgccttttattaagctttcgataacctagagctacaattccacttgctgaaacgatagcaggccaataattaataatgtctcttataaaatagagagcatcatgaattagtacctccataacccctgctttctaatttattaagttgctttcagaatacttaaccgataagtctttagcgacatcaatagcctcatcaaatactttcagagcatcatttttaccatcttctgatgaaaaaaataatccgggattattgacattgcaagttaaaatcatagttccgtcttcttgtatttctgatgaaacgaatgcagctggtagctctcctattgtgatattcgctaaaatatttctactatttttttgttgaattgccatactttatctctcttttctatatttgatatgtgaattgaaatgtatattcttgattagctgctgcagaaagaattgtaacccctccactattttgttgatttaaaccgtttatttgtatatgtttatcgtttgcaacactagcagaccaagctaatgcagtacccataatgcttgcagcaggacaatctttaagcggaatagttccaatatagatattacctattgcacttgttttagctcctactactcgaatagttactactctcccatctcttcgataagctgcataacttccgattgttgtccaagagacatctacagaattcactatacctgttggtgtcacagaaacatatggttttttaatataaatcgagaaaaatgctttccctaagcgattttttatggtataatgttttgtaaggctgtgtaccagccaaattgttggaggaattttttttacaaatgaacgaatttgaaacattattaaacagcgttgaagacgttaaagtacgtgacgtcgttaaaggtgaaatcctttcagttgaaaacgggcaagcaactgttgccatcgtaggaactggtgttgagggtgtccttacacttcgcgaaatcactaacgataaagatgctgatatcaatacattcgttaaacctggagatgttcttgatttgcttgttatcaaacaaatcgttggtaaagaagccgaaggtgcaaacgtatatctcctttcattgaaacgtcttgaagctcgtaaagcttggactcaattggaaggcaaagaaggcgaaatcgtaacagttaaagttactaaagacgttaaaggcggactttcagtagactataacggtgttcgtggatttatccctgcatctatgattgacacttactttgttaaagatactaagaaatttgttggcgaagaaatcgaagctaaaattatcgaagttaacgcttcagaaaaccgcttcatccttagccgtcgtgcagttgttgaagctgaagcaatcgaaatgcgtaaagaagcttttgcacaacttcaagaaggcgatatcgttgaaggtacagtttcacgcgtaactaacttcggtgcattcgttgaccttggtggtattgacggattggttcacgtttctgaactttcacatagccgtatcaaacgtccatcagacgcagtaaaacctggcgatgttgttaacgttaagattttgaaactcgacccagaagctggacgtctttcactttcacttaaagctacacaacctggaccatgggaacaagttgaagaaaaagcaccagttggatcaactgttgaaggaactgttaaacgtttgacagacttcggtgcctttgttgaactttacccaggtgttgaaggacttgttcacgtttcacaaatttcatgggaacgtgttgaaaatccaaaagatgttcttaaagttggtcaagttgtgaacgtaaaagttcttgacgtgaaacctgctgaagaacgtatctcactttcaatcaaagcgcttgaagaagctccagctcgtccagctcgtaacaacgacaacgacggtgaaaaacgtgatcgcaaaccacgcgcaccacgtaaagcagctaaaccttcatacgatttgcctgaaacacaagaaggcttctcacttgctgatttcctcggggaagacttcgatattaacgatttgtaagaaaaattcaaaaatatcctctaaaagacccgctgggtctttttttgtttagaaatgtatcagattaatcatttgagataaatgggaaattcacagaaatctaacataaaaatgagtagttctcttggaaaactttttttataataagtatgtaaaagtaaaggagaactacaatatgaaaacaaaaaattcatttcggacatggaagtctggtaaaacatggctttattcatcattagtcttgggaactttactcctgagctcagggatatcagccaatcaaataaaagttctggctgatacaacaggaacgcaaagtagtcaaatgacatcgacttcagagattaccacgggactgcaagcaaatattaatgccacaactactgttactgcagcacaattggctaatgcaacagctccaggtccatttacagctggagtaaatcaggttattccttttgaagcttttggaggggacggaatgttgactcgtctcttacttaattccgcaagtaaagcaccatggtcggacaatggaacagctaaaaatgcagctttatcgccaatttcaggacttgaatctggaaaatatttctatgaagttgatttagccggtacaaatggggcaacaggccaaaatttacttgatgtattacgtgctaatggaacaaagagttatgaagcaacagtcaaagtttatgccgctaatacttcaggaacggcagacacaagtaaaacggttgctacaaaaatggtacaagttaatttgactggtttgactgataatattaatactacaactacagtatcggcatcagaattaaccaatgcaaaagtgccaggtccatttacagcaggagtaaatcaggttattccttttgaagcttttgggggagacggaatgttgactcgtctcttacttaattcctcaagcaaggcaccatggtcggataatggaacagcaaaaaatcctgccctatcaccaatttcaggtcttgaatctggaaaatatttctatgaagttgatttagccggtacaaatggagcaacaggtcaaaatttacttgatttattacgtgcaaatggaacaaagatttatgatgcaacggttaaaatttatgcagccaatgcttcaggcacggcgaatacaagcagaatagttgctacaaaaatgatacatgtaaacttaactaaacaacaaagcacgatttctagtcaatctgtctatcgtttgtacaataaagtgagtggagagcatctctataccacaagtaattatgagtataactcactcaacacaatgaacagtggttggttaggagaaggagtagcttggaaagcaccaaaatctggcaataatgtatatagagtttataatccaaactcaggtgaacacctttatacggaatcagcatatgaaatgaatagcctagtgcatcaaaacggttggaaatcagaaggagttgctttctattctgattcaaatagtggaaaaccagtttatcgtctctacaatcctaatgcaaaactgggagcccatttcttgacgatgagttcctatgaacgagatagtttggttaaagcgggttggaaatcagaaggaattgcattttatgcgacaaaatagtttaagacatagacttgtttagttttaggaaaagacttaaaaatattttttaagtcttttatgctatgaagatgaaatgtaatgtcagaaaattgatattttttaatattttttgatatactgtgaatatggaacaacgaatactaataattgaagatgaagaaagtctctctaatttattaaagactgaactttcctttgaaggatatgaaattaacactgcagctgatggaatttcaggattaaaaatttttgaacaagaacaattggatctggttatacttgactggatgattccaaaacttgatggtcttgaagttttacgacgtatgaaaaaaattaataaagaagttccagtaatatttgtaactgcgagagactatgtgggagataaagttgcaggtttggatgcaggggctgatgattacttaacaaaaccctttagcattgaggagctcatggctcggttgcgagtgatttttagaaaacatacacaaccaacgcaatatgcttatggtgagatttctcttagtcagagtgaacatattgttaaatatggtggaaaaccgattaatttaagccagagagagtttgctctattactttttttatttgaacatcagggggagattatctcaagggatgatatccttgatgaagtttggggaatgaactttggtggtcagctaaatactgtggatacttacatacgctatttacgaaaaaaattagataaaaatatgatagaaacaataagaggtttaggatatagacttaaaaaaaataaataataataaaaaaaagaaaatatatacaaatgaattattaattagaagaatttttcagcgcatctttcttttattattaacgtttagtgggttgacctttattacttatagcttgtttcaagtaagtgatagagagacaagtgctattatgacaggaatgaaaaatgtttcggaccttagtgacatgaactttcaagatataagtggcttccatgaggaagataattttattcgtgtaagttcagaatcgaaaaaaacaataatgagcaaaggaactgatagttttttagaaaatcggacttttcattttggtaaaattacggtatcaaatggaaaattatatgatactgtttataaaaaagaaaaaggaatcacctatgaaatttggctttctcttcaggatatatttgaagaaggtgaaaccttattgacaagtgcctttgttattctacttttaaattatttgattggtttactactaatacgtcattattccaagaaaataaatgggccaattcaaaaattggcttttgaggcaagtcagaataataatttattggaagttcctgattcaccaatggaaataagagaacttgcaataaattttaatgacttagttgaaagattacaagagaaaattgaatctgaaaaagaatttacgacaaatttatcccatgaattaagaacacctgtaatggcaatttctggctatatttcattgctcaaaagaagaagagttgagcatccagaaattgttgaaaatgcactggattatttggaaaaagaatcggagagactgaaaaaactaatagaagattttttaactttatcaagaaatggacagattaattatcaagaagagattttcacaattgagagtttactcttagaagttaaggctacttttgaatttgattcgtctaacgagatagatattgaaggaggtggagagctatacattaaaacgagtaaatttgctcttcgagaaattttgaccattttaattgaaaatgcaataaaatattctcccgatagaacaagagtttttattaaatataataaaaaagaaattcaaattattgatgaaggagttgggattactgatagtgaaaaaacaaaagtcttcaatcgtttttatcaagtagataaatcaaggggaagccatactggaaatggtattggcttagcaatagctcaacaatatgcagaaataataaaagctaaaattttcattactgacaatcttccagaaggttcaatctttcatattaattttgaagatgaaagtggagttagctaataatttaaaaaggtctatttagatcttttcttgtacataaagtcagtcaagtcgactttaaattgttcggaatatttggtataatttaattgttttatagataaggttcaactttttaaataaatagagggataaaaaaatggaaaaaggacaagcgcatattcaattaaagaaaaatgatgctagacttgatgcaattattgtcggtgatccagctcgaatagatcaggtcgcaaaatttttgaccgatgtaaaaaatttaaaatacaatcgagaatttcgctcaatctgtggaacttataaaggtaaggaactattagttttgtcaacaggtgtaggtgcaccgtcagctgctattgcgattgaagagcttcataatattggagttaagagaattatcagagtaggttctgcgggtgctttgcagttagggatcgatttaggaagtccaattattggagaaggagcagtacgagatgacggtttgacaaaaatgtatgtacccgaacaatatccagcagttccatctactgatttgttaaataaagcaaaagaaattgctcctgatgctatttatggaattattcgttctcatgacggtttttatatggataatcatgaagaaactcaagcatattggtctaaatttggaattgtgggcgaagatatggaatctggtgcattgtttacagtcggacgtttacgaggaatagaaactttatctattttgaataatgttgttgcttacggaggagatttacaagcgggagtcaatgatttagtttcaggaaatgataaagttaataaaggtgagcttcggacaattgagattgctctagaagttttaaatcgctaatataaatattacttgtaaattgattagagttgaaaaatagaactgaaattaccatcatattttaaattaataaagcggtaagcgatattcttgactgcatttaagcgttaggataaaaaggagaaaaaatgacaaaagattcttggctttttaagcaactttttgcaaattggaagaaatttgaaatcacatatatcttaattttattgttcttacaagtgattgtttatatcattgcccctgattctttcattggaatgatatctggtgtatttggtgtactttgtctcatttatgggatgaaaggtcgtaaaattaattttgcatttggtttagttcagaccttagcgatgactttaattgcttatcagactcactcatggatgagttttgttatgggaattttttatgttttatctcaacctgtggggtggtttttttggggacaggatgatgctatccatgaatttagaccaaaaactcgtcgtctaatttttctaggtgcttttattgcttggttggtcgtttggggcatagatgccctattaaatgggcaacttccttattttgatgctctaaatttaattattccactcattgcacaagtattgtatattttgaaatataaagaaaattggtcgctgtggattgtggttaacacggcagcagtaatttattggacaattttaacggtacaatttattatgggagtaaacacccaagggcagttaggaatgtatttatcgcaggttgccttacaaggagccctgctcttcaatgcaatctacgctaatcgagtttgggcaagtggtgaagctgataatgaaggtggaactaaataacaagtgaaaatgactcaagtaaatgggtcattttttgttttataaacgtccaaaacaagagcagctcctacatttttttgctataataaacaatatgaatcaaacgataaaagcaaagttagaactattaccagatagtcctggctgttatttacataaagataaaaatgggacagttatttatgtcggaaaggcaaagaatcttaaaaatcgagtgcgctcttattttcatggttctcataataccaagacagaattactagtttctgaaattgaagatttggaatggattgttgtaggttcaaatattgaatccttagttttggaaatcaatctcattcaacgttataagcctaaatataatattatgcttaaggatgataaatattatcctttcctaaaaataacaaatgaaaaatatcctcgtttgttggtcgtccgtaaagttcaaaaagatggtgcgacttattttggaccttatccagatgtcaaagctgccaatgaagttaaacgccttttagaccgaatttttccatttagaaaatgtggcttacacgagaaaaaagtatgtttctattttcatattcatcagtgcttatgtccagtagttaatcatgttgatcctcaagtttataaggatatgactcaagaagtgaaggaatttctgacaggttctgataaaaaaattgttaaagaacttgaagcaaaaatgatgatttcttctgataatatggaatttgagcaagctgctgagtatcgggatgtgattaaggcaattggaactttaagaacaaaacaacgggtgatgaatcaagatttgaaagaccgcgatgtttttggatattatgttgataaaggctggatgtgtgtccaagtattttttgtgcgccaaggaaaattgattcagcgtgatgtgaatatgtttccttactacaatgatgctgaagaggattttttaacttacattggacaattctatcaagataataatcatatgatgccaagggaaatttttattccgcaagacatcgataaggaatctgtggaagcagtagttgcagctagccaagagggaaatttattaactaaagctcaagctaaagaagtcgatgcaaaagtttttacggccaagacgcttaaattttctgatcaaaaagatgttgagcaatcaattgttaaacttgataaagaattatcagccgaaaaacgtttatcatcacttttagctaaaacacagattgttcaaccaagtcgtggtgagaaaaagcaattggttaatatggcaactaagaatgctcaaagtcaattacaattgaaatttgatgtggctgagcgtgatattttgaaaacgactaaagcagttgaaaacttgggtaaaattttgggaataccaaaacctgtaagaattgagtcttttgataattcaaatattatggggacttcaccagtatctgcaatggttgtttttattgatggaaaaccttcaaaaaaagattatcggaaatataaaattaaaacagtggttggtgctgatgactatgcttcaatgcgcgaggtgatgacgagacgttattcacgagctttaaaagaagaaacagctcttcctgatttgattgcaatggatggtggagctggtcaagttaacattgccaagcaagttttaaaagagcttgggctatcgattccggttgctgggatgcaaaaaaatgataagcaccaaacgtcagaattactttttggtgaccctttagacgtggttcccttgtcaagacaatctcaagaattctttttgctgacaagaattcaagatgaggttcaccgttttgcgattacattccatagacaactacgtggtaaaaatacattttcaagtaaattggacggtattgttggacttggtccaaaacgaaaacaaaagttactgacaactttcaaaaatttgaaagcaattgaagaggcaagtgtacaagaagtggcagaagctggcattccttatgaagtagcagaacgtgtgaaaacaactttgtctggaccaattcaagaaaatgaaaattgggaatcactcaaggataatgttcctcttttagaaggtaaaaaataaagtaatcaaaagaattgtcagtaaatctgtcagttcttttgattcttgaaaaaacataaaaattactgacagaaattctgtcagtaaaataaagtagttattgaaaatctgtcagtaaatatttactgacaaactaggaattaagaaagtaattggagaatcgatggactggtctaagaatcaaataaaggaatttcagcaagatttactttcttggtatgatgataataaaaagccactcccttggcgaaaaacaactgaaccttacaaaatatggatttcagaaatcatgtcccaacaaacacaggttgaaactgtcatgccatattatgaacgtttcatgaaaaaatatccgacgattgaaactttagctcaagctgatgatgctgaactgctaaaactttgggaaggcttgggctattattctcgcgctcgtaatctaaaaatcgcagcgcaagaagttgttgataaatatgatggaaaatttcctgacaatctagccgatatattatcattaaaaggaattggaccttatacagccgctgcaattgcttcaatttcttttggactcgctgagcctgcaattgatggaaatctaatgcgcgtgaccagtagagtttttgaattagattgtgatatttctaaaagcagttcaaggaaaatttttgatggctatctaagaaagctcatcagtaaaaaaagaccaggtgatttcaatcaggcgttgatggatttaggttctttagtttgtagcccaaagagtccaaaatgtgaagtttgtcccttactaaactattgtgcagcagcagcgtcaggaaaacaattaaattatccagtaaaaacaaaaaagataaaacaaaaagatttgtattttacagcctttgccttagaaaattcattaggtgaatattatttagaaaagcgtccatcaaaaggcttgttagcagacatgtggacatttccactgacagaattaccagcagcagattttgaaaaaatggttactgacggctctgtcagtaaaaatattgtcattccagaacttccggaaagtatttcaaaaatggaatatgtagctaattttactcacattttttctcatcaaaaatggcatttggcaatcattaaattaaaaccagaagagacttttgaagttgctgacgaattattatcagaagacaaaatgtgggttcattttgattcaaaagtactgacagaaaatggccaaccaaaagtaagtcgttcacaaattccacttgctgggccacaagtgaagatgtttgagattttagataagaagaataagaaaattgatctgctaaaatagtggagtaaccatcgaaaccaaatttttggtataatagataaatatactacttcaaggagaagattatgacaactattgattttaaagccgaagttgaaaagcgtaaagacgctttgatggaagatttatttagccttttgcgcattgattctgcaatggatatggaacatgcagatgctgaaaatccatttggtcctggtccaagaaaagcattggatgcattcttgaagattgctgaacgtgatggttatacaactaaaaattatgataattatgttggacattttgaatacgaaaatggtgcaagcgatgatgcagaagttcttggaattatcggtcacttagacgttgttcctgcaggttctggttgggactcaaatccatttgaaccagaaattcgtaatggaaatctttatgctcgtggagcatctgatgataaaggtccaactgttgcatgttactatgcccttaaaatcttgaaagaactcaatcttccattaagcaaaaaaatccgttttatcgttggaacaaacgaagaaactggttgggcagatatggattactattttgaacattgtgaattgccattgcctgactttggtttctcacctgatgctgaattcccaattatcaatggtgaaaaaggaaatattacagaatatctccattttgcaggtaaaaatgctggagaagttgttcttcacagttttaaagctggtcttgccgaaaatatggttccagaatctgcaactgcaataatttcaggtgctaaagatttacaaactgcacttgaaaaattcgtagctgaacatgcaagcaaaaatcttcgttttgaccttgaagaaagtgctggaaaagcgacaattacactttatggtaaatcagcacatggtgcgatgccagaaaaaggtgtaaatggagcaacttaccttactttattcttgaaccaatttaattttgctgatggtgctgctgctttcattaaagttggagctgaaaaacttcttgaagaccatgaaggtgaaaaattgggaacagcttatgttgatgaattaatgggtaatacttcaatgaacgctggtgtttggtcatttgatgagaattctgaaggtaaaatcgcgcttaacttccgtttcccacaaggaaatagtccagaacgtatgcaagaaattcttgctaaacttgatggtgttgttgaagttgaactttcaaaacatcttcatgttccacattatgttccaatgtcagacccacttgtatcaacattgattgatgtttatgaaaaacacacagacctcaaaggttatgaaacaatcattggtggtggaacttttggtcgtcttttagaacgtggtgttgcttatggtgcgatgtttgaaggggagcctgattcaatgcaccaagctaatgaaatgaaacctgttgaaaatatttataaagcggcagtaatttatgctgaagcaatttatgaacttacaaagtaatttataaaattaaagagtttagttactaaacttttaagggtttaaaaatctggcataatttgccagattttaaccttttattccataaatagaggtggaaaaatggtttttggaacaggtgttgataatgtagagctttctcgaattcaaaaagcactgacacgttctgaacgttttgtggaacaggttcttacggcagtggaattagaaaaatataatagttttcaatctaccgctcgtaaaactgaatttcttgcgggacgttgggcagcaaaagaagctttttctaaagcttacggtacgggatttggtaaggctttgggcatgcatgaccttgaaatcaaaaatgatgaattaggaaaacccttttttactaaacatccttttgatggacaggttcatttatctatctcgcatagtaatttagaagctgttgcttttgttgttttggaaaagaattaagaagtaataaaaatttttgcttaaactagaggaaggtttaaaagatgaaaacttctccacatcgcaatacgtcagccattgttgacttaaaggcgattagaaataatattgaaaaatttaaaaagcatattcaccctaacgcggagatttggccagcagtgaaagcagatgcttatggtcatggctcggttgaggtttctaaagcggtgagcgatttggtaggcggtttttgtgtatcaaaccttgatgaggcaattgaattacggaatcatttggtaactaaaccaattttagttttatcaggaattgttccagaagatgttgatattgcagctgctcttaatatcagtcttactgccccaagtttagaatggttaaaattggttgttcaagaagaagcagaactttcagatttaaaaattcatattggtgtagattctggtatggggcggattgggattcgggatgttgaagaagcgaatcagatgattgaacttgctgataaatatgcgattaattttgaagggattttcactcactttgcgaccgccgatatggctgatgatacaaaatttaaagatcaacaggcaagatttaacaaaattatggccggcttatcacgtataccaaaatttgttcactcaactaatacggccgccgcattatggcataaggaacaggttcaagctattgaacgcttaggtatttcaatgtacggcttgaatccaagtggtaaaactttggaacttcctttcgaaatcgaacctgctctctctttagtttctgaattgactcatattaaaaaaataacggcaggcgaaacagttggttacggtgcaacttatgaaacaagtgaagaaacatggattggaactgttccaattggttatgctgatggttggactcgtcaaatgcaaggcttcaaagtgttggtaaatggagaattttgtgagattgttggtcgagtttgtatggatcaaatgatgataaaacttgataaatcttatcctctaggaacaaaagttaccttgattggtcgtgataagactaatgaaatcacgacgacagatgttgctgattggcgtggaacgataaattatgaagtgctttgtttactttctgatagaatcaaacgaatttataaataaaatgaaagaaactgtatttttgcagtttttttcatttgggttaaaaataaattaatccctaatcttttcctcatgataccctttacaaattgtctttttatgtaaaatataattaagatataaatgagaaagccataagaaaaaaatgaggtgaacactatgataaaaatatacacagtagcatcttgtagctcttgtaaaaaagcaaaagaatggttggagaaacaaaatcttgcttaccaagaaataaatttggttacgagtcgaatttgtaaggaagatatattagaaattttagcattgactgaggaagggactggagatatcatttctagaagaagtcaagcttatcaacgattaaatattgattttgaaacgattaaattaaatgatttgattcaaataattgaagaaaatccaacgctcttacgtcgacctttaattgtcgatcataagcgactacaagttggttacaatgatgatgaaattagaaaatttttaccaagaaaaaagagagagattcaaattaaagtcgcaacagaagcttcttataatttggacattgaagaacaatttcatgaaggataattcagtagttaggctactgaattttttcgatataaagcaaaatagtttattattttagagaaaaaaagtagaattaagctaaagtgttgtatcatgagtacattttaaagatttattaataattaggaggctaaagaatgtttgattatattattattggtgccggacctggtggactaggattagcttatcgtttaaaaactaaagataacaaaatcggaattattgagaatgataaatggggaggaacttgtccaaactatggttgtgacccaacaaaaatgatgatggcagttgtcgaagccaaaagtcgtgtcgaacagttaaaagggcagggtatttctggtgaattaaacattgattggaaagggctgaaaagtcgtaaactaaatattactgacccttatgaaaaatcaacttttgctggtttgaaaaatgctgggatagaaacaatatatggcagtgccgcttttaatgaccaaggagagcttgaagttgaagggaaaacttatcaagctaaaacttacattatcgcaacaggaagccgtccacgtcttttagatattgctggaaaagaatttttaaaaacaagtaatgattttttagcgcttgaagaatttcccgctcaaatcagctttttagggagtgggccaatttcattagaactggctcaaattgctaaagcggctggaagcgatgttactattatttcacgtaaaaaagcgaaagttgctcattttgatgaagaaatggggcaagaatttattaattacctcaaagctcaaggtattaaatttatcgaggatatttctgtagataaagtcgaaaaagttgctgacggatttatactgactgacgggactgattttgaacataaaacagacttagtgattgcgggagtaggccgtcagccaaatagtgataagctaaatttagaaaaagtaggtgtcgaaacggatgctaaaggcattaaggtaaacgaatatttacaaacaagcaattctaaaatttatgcgatgggagatgtactttctaaaaatcaacctcatttgacgcctgtttcttcttttgaaggagcttatttaggtgaaactttagttaaggatgaaccgcaaaaaattgcttatccagcaattcctacaatcatttttggaacggcaaaactggctgaggttggccatttggcaggtgaggggattcatactaagactttagatttaagttcttggtatacttataaaagaattaatgaccccttggcaaaattaaaagttgcactcaatgaaaagcgagaaatcgtgggggcatcaacggtgagttcagtggctgatgaagtgattaatttaattaatattttaattcaacaaaaaatgactttggcggatgttgaaaaaatgattttcacttatccaacagtggctagtgacttagaatatttttactgacagaaaataaattactaccgacattataatagtagaaacaataagttacggcagaataaattttttactgacagactttattttcaagctgtcagtaaattttactgatagaaatgaggacattcatgattgaattccagaatgtgtccaaggcttttgctaacaaaaaaattcttgatcatgctaattttacaattaaagaccaagagttttttgtgttagtggggccgagtggaagtgggaaaacgaccactttaaaaatgattaatcaattagtcactcacagtgagggaaaaatattaatcaataatgaagaaatatcaacggcaaatttacgaaaattgcgcttatctgtgggctatgtgctgcagcaaattgctctctttcctaatttgactgtctcagaaaatattgctttaattcctgaaatgaaggggtgggataaagcaaaaattgctgacagaaccaacgagctacttgatttagttggtttgaatcctaaagattacgctcaacgccaacctagtgaattatcaggtggtgagcaacagagggtaggaattttacgagccattgccgcaaatcccaaaattgtcttaatggatgaacctttttcagcacttgacccaatttcacgacgtcagttacaaatatttatcaaagacttacagaaaaaaatgaatttaacagtggtctttgtgacacatgacttagatgaagcactctatttagctgacagagtcgctgtaatgaatgatggattaatccaacaaattgctgaaccagcagatatctatcaacatccggcaaatgatttcgttaaaacattttttaaagaataccgtcagaatttatcaacggtttctgttgaaaatttattactgacagagctgtcagtaaatccagaagcgcaagaagttgctgacaatacagctatttcggaaataattaatcgtctttctgataaggaagttttaaaatacaagggcaagtcgatttcctcagatgatattatatgctatatcgcaggaggtgacaaatgaatcagttaatttcaacttttcaaagccagcaaggccaattttggcaggcgcttttagaacatatccagatttcattaatatcaatttttattgcaattctgatttcgattcctttagctttattgttacgacgtcttcccaaaattgctgaaccagttttgcaagtcactggaatttttcaaactatacctagtttggcactgctaggactcttgattccattcatcggaattggaagtttaccagcaattgtcgcccttgtcgtttatgcgattttccccattgttcaaaatacttatactggtttagagcaaattgaaccttctttaatcgaagctgcaacagcatttgggatgaatcgaagagaacgattgatgaaatttgagctctcattagcgatgccctttatcatggcaggaattcggacgagtacagttatggtcattggtaccgcaacactagctgctttgattggtgctggaggcttagggaactttattctgctcgggatcaatatgaatgatgtttcattgattttaattggagcaatttcgtcagcacttttagcgattattttcagtagtcttttaaaatttttagaaaaagccaagataaaaacaattctcatcagttttttcattggcttactcgttcttggaggctcttattatagacctcaaacttctaatcatccacaaattacaattgctggtaaattgggagcagaacctgatgttttgattaacatgtataaactaatgattgaaaaagatagtaatattcgcgtgaacttaaaatctaattttggcgatacgactttcttatacaatgccttgaaagcaggaaaaattgatttatatcctgaattcacaggaaccattacttcaacatttttgaaagatccagtgagttcaactgatcctaatgtcgtttggcaaaaggcagaagaaggaataaaaaaacttaatcaatttacatatctgtccccaatgaaatttcaagatacatatgcaattgccgtcaaatctgattttgctaaagagcatcagctcaccaaaatttctgatttagccaatgtttcaggtttaactgcaggctttgacgttgagtttgctaatcgttcagatggaaatattggtttgagaaagctttatggtcttgatttaaatgtcaaaaccatgcaaaatagtttaatttataaagcactaaattctggtgctgtgaatgtcgctgaggtttattctactgatagtcaaatcaagcaatataatctgactgtcctgaaagatgataaaaatcttttcccaccttaccaagcagcaccattgatgaaagaaagtttattaaaaaaatatcctgaactcaaaaagattctcaataaactgtcaggaaaaattactgaccaagagatgattgagatgaattatgatgttaatgtcaaacaagaagatgctgcaaaagtagcagaaagatatttgaaagctaaaggattgatttaaaagaaaaagtcattttataatggcttttttgctttagatgataagaaaatctaaaagcgcgtgtaaaagtgcaagaatatgatgttttggtgctttagtgaaatagtagcctaccacttttgtaggctttttttgtattctaaaagtcttatttttaaattaagttaaaatgacaataccacttattgttgatcttaaactagcggaatttattcgtcggcaactttattattgttcaccaaaatggttgaaacttcaggaaaaatattaccaaagaggtgaaaatttgttgaatttgacttttgaacgttcttttattgcacctttggggttgaacttacttgaagtttttgatgatgaaatccctttacataaatttactcaaattaagcagaatattaatctctattatgaaaactttttaataaattttcagcaaaatagctttaaggcagtctatcctccccgtttctatgctataatgaaaaagcagaagaaggatatgaatgaatgaaattctgctaataagtttttaatgtgaataaaaattattttgaataaaaaggagtgagcttcatggctaagaatagaaatgaaattcctgaaaaattaacttgggatttgacaacaatttataaaacagataaagaatgggaagcagagctaactagaataaaaagcgaactttcactcgttgaagagacagaccctggtcatttacttgattcagctgaaagtcttctgacaattaccgaaaaaatgctatccatttctcaacaagttgaaaaactatatgtttatgcttcaatgaaaaatgatcaagataccagagaggctaaatatcaggagtatcaatcaaaagcaacagccctctatgtgaaattcggagaggtctatgccttctatgaacctgaatttttgaaaatttcaaaagaagtttataacaaatggttgggggagcttcaaaaattaaaaaactatgaccatatgtttgagcgcctttttgcaaaaaaagcgcatattcttagtcaaaaagaggaaaagttattggctgcggctggtgaaatttttgaaagtccttcagaaacttttgaaatttttgataatgcggatattaagttacctatggtcaaaaatgaatctgatgagatgatccaactcacgcatggaaattactcttccttaatggaaagtaagaataggggagtacgaaaagcagcctacaaagcactttatagtaattatgaacaatatcagcatacttatgcaaagaccttacagactaatgtaaaagtccataatcttaaagcccaaatccgctcttatgattcagcccgtcaagctgctctggctaataattttgttccagaaaaagtttacgatgttttgatggaggccattcatcaacatttgccacttttacatcgttatattgaactacgcaagaaaattttaggaattactgatttaaagatgtatgatatctatactccattatctaatttagattataaatttaactatgaagatggagtgaaaaaagcagaagaagttttagcgatatttggtaaagaatataaaggaaaagttaaagcagcttttgaacaaagatggattgatgtcgaagaaaatatcggaaaacgttcgggtgcttattcaggtggatcttatgataccaatgcttttatgcttctaaattggcaagaaacgttagatgatctttttactttagttcatgaaatggggcactcaatgcatagtgctttcacgcgtgaaaaccaaccatatgtttatggggattatccaatctttttagctgaaattgcctcaactacaaatgaaaatattttaactgaaactttattaaaggaaagtaaagatgataaggagcgcttcgcccttttgaaccactggcttgatagtttccgtggaactgttttccgtcagagtcaatttgccgaatttgaacaaaaaattcatgaagcagatgctgccggtgaagtgttaacaagtgaatacttaaactcactttatggcgaaataaatgaaaaatactataatttagcagtcaaagaaaatccagaaattcagtatgaatgggctagaattccgcatttttattataatttctatgtttttcaatacgcaacaggttttgctgcggcaactttcttggctgaaaaagttgttcatggttcaactgaggatcgtcaaaaatatcttgaatatttaaaggctggttcctcagcttatcctttagaagtaattgccaaagctggagttgatatggaatctaccgattatttagatgctgcctttgagctttttgaaaatcgattgagtgaattagaaaaattagttgaaaaaggagtccatctttaaaaatggttgaaacatataaacgtacaagtaaccccatgatgaatcgaccagttgtcaaagcagagttagtagaatggatgcgttcaagtcaaacacaaataaccggagaacttgcttcattagcttctgtaccagttttaacccgactttttccccttgtttaagtagaagatgatgaattttaggagcaccatagattcctcggttagcattgaagagttgagaaattttgagtgacaggtattgtctccttaattgagttttagatggatgtcggttaatccgttcataataacttgattcaggaacatcaaggagttgacagcttagtctgacattgagtgctaaagtttgtatggtttgagccatatccgcagcactcacttctttttctcggcgaatatggtcaatactttttttaagatgtctcgttcttccttaactttagccagttgtctttttaattctagaaaatcagctttagagacggagctttcattagatttagagtagaggtctatccatttataaattgttgcaggggccacgtcgtattctttagacagctgggtgacggattgaccagaatgatagaaggcgataagggtttctttaaattcttttgagtagcgtttttgcatgtttttgtcctttgtctaaattatacaatagtgactctaagatttaaggataacatcactcacaacttagggttattaatagaggtcaaaatatgaaaattgggtatgcacgtgtcagtacttttgaacaaaaattagaatctcaaattgaagttctgaaagaagcaggagcagaagaagttttccaagaaaagtttactggaactacagtcgaacgtccacaatttaatctagtatttaaaaagttaaaggatggtgacactttaattgtgacaaagttagaccgattagccaggaacactagagaagttttagaaattgttcaatcgttatttaatagaggaattaaggttcatatattaaatattggtcttattgataatacacctactggtcagctgatttttaccatcttcagtgcttttgcgcagtttgaacgagaccttattgtaaccaggactcaggaaggaaaaaattttgctaagcttcatgatccaagttttaggaaagggcgtcctcaaaaatttaccgaagaacaaattcaatttgcttatgagttaaaacagcaaggaatgacttacaagatgattgagcgaaaaactggtatcagtattgcgactcaaaaacgaagatttataaaagcaaaaaatcaagctattgacaaagactattgaaatgttataatttagttaacgaagatttgtgggagtggtatctcacaataggaactgaggaactgcgaattcctcagttttttgtacaaaaaacgcccagttctgcgaaactgagcgaatgtggattaatggcgcttacgtcggtattttaaccaatccttgaccagctcaaggattactccaaccacaataggagcgactactgatacgaagatttgcagaagcattatctcaccccctccctaaggcatttctgcattggtaaggtacgccactaaaaagtataccataaaaagggaatagatatgttcgtagtaggagatatccaattatcaagaaaactccaattttttggaaagttaaataatgtgtacatattttcgacaaaccatacattagaaataataaaaaaacaccgtagaattgtttgattcatacggtgctttttttatgtctaattatttaagagtagtccaatatttttataagtcataattctagtccgcttttaaaatagtagtgtactggctaaattcctctaagtgttgagggctaatctggttatctgtaatgatggtatcgagttgatctagattgtagaagttaaagaaatcgtatcgatcgaatttagtactgtctactaataagaatttttctacagcattgtttagggcaagttgttgaatcacaccttccttgtcactatatgtagcaatagaattatgggtaacagcatttgcactaacaaaagctttggcaaatctcattgcttctaaatttgtcgaagccattgaacctacaaaagctccagttatttctctatattcaccgccaagaagcaataaatcaatggtttcgctatcatttagaatcaagaacacagggagactatttgtaatgacacgaattttataacctttacgacctttcaattctaatgccagttgtacaagtgtagttccgggtccaataaaaatagtatcgccatctttgattaaagagcaggcttttttagcaatgtcaattttttcttttgtatttagacttttcttctcgatatgtgtcttttcaagtggctttttagaggaaagcaattgtgcaccaccatgagtacgtgttaaaagtccatcagcttctagagcatcaaggtctctacgggctgtcatatcggaaatatctagttcatctattatttcttttatggttatggtcccatcaatctttaacatatctaaaattttttctaatcgtcgttttttgttcatatgaagacttttctttcataaagtaatttttttccaaagataactctcttttaattgtatcataaaagataatattttcaaggtaaaacaaacaatttcaaacaaaaacaaacgttagatggtgaaataagaacagaggattgacgtatattagcttaggtcagattttgtataagacgaaaacaaagtaggacctcttaatcagtaagttatagaaagtaaaagacttttgtaatacctgaatagatatttcacgtccattttgtgatggattaaatgaacaataatttaacggtgttatctattttttaaaaaaacaaataaaaaaaacaaaaaattaacaaaaatagttgctttttgtttgaatgtttgatatcatataaacaaagaaatgatgaaaacgttatcttgaacattttgcaaaatattttctacttctacgtagcatttctttttaaaatttaggaggtagtccaaatggctattgttgttggtgcagatctcaaaggtacgagattaaaagatgttgtgaaaaattttcttgtagaagaaggttttgaggtaattgatgtgactaaggacggacaagattttgttgatgttaccttggcagttgcctctgaagtaaataaagatgagcaaaacttaggtattgtaattgatgcttatggagctggtccattcatggtagcaactaaaattaaaggtatggttgcagcagaagtttcagatgaacgctcagcttatatgacacgtggacataacaatgcacgaatgattacggttggcgctgaaatcgtcggtgatgagcttgctaaaaacatcgctaaagctttcgtcaatggtaaatatgatggcggacgtcatcaagtccgagtagatatgcttaacaagatgtgttaagaaaaggagttaaaaaatgaaaatcgcaattggatgtgaccacattgtcacagatgtaaaaatggcagtatcagaattcttgaaatcaaaaggacatgaggtccttgatttcgggacatatgaccacgtacgtactcactaccctatctatggtaaaaaagtcggtgaagcagtagtaagtggtcaagcagacttgggagtatgtatctgtggtacaggtgtcggcattaacaatgcagtcaataaagttccaggtgttcgctcagcgttggttcgtgatatgacgtcagctctatatgctaaggaagaacttaatgcgaatgttatcggttttggtggaatgattactggtggtcttcttatgaatgacatcattgaagctttcattgaagctgagtacaaaccaacagaagaaaataaaaaattgattgcaaaaatcgaacacgttgaaacacataatgcacatcaagcagatggggatttctttacagaattccttgaaaaatgggaccgtggtgagtaccacgattaaggtataaccaatgattctgacagtcacactaaatccttcagtagacatctcttatcctctagaaacattgaaaattgatacagtgaatagggtgaaagatgttagtaagacagctggtggaaaaggcttaaatgttactagagtcttgtatgaatctggtgataaagttactgctacaggtttcttaggtggtaaaattggtgaatttattgaaagcgaattagaacaatctcctgttagtccagctttttataaaatctcaggaaacactagaaactgtattgctatcttacacgagggtaaccaaacagaaattttggaacaaggaccaacaatttctcatgaagaagcagaaggctttcttgaccactatagcaatcttattaagcaatcagaagttgtcacaatttcaggaagtttgccttcaggacttcccaacgattattatgaaaaacttatccaacttgcttcggatgaaggagtagcagtcgttttggattgttcaggtgcaccacttgaaacagttctaaaatcgtcggctaaacctactgccatcaaacctaataatgaggaactttcacagttgcttggaaaagaagtaacaaaagatattgaagaactcaaagacgttcttaaagagtcactttttagtggtatcgaatggatagtggtctcattaggtcgaaacggtgcctttgcaaaacatggtgatgttttctataaagtagatattcctgatatcccagttgttaatccagtcggatcaggggactcaacggtagctggtattgcatcagctttaaatagtaaaaaaagtgacgctgacttattaaaacatgcgatgacattgggtatgttaaatgctcaagaaacaatgacagggcatgtgaatatgactaattacgaaacactaaactcacaaattggagtaaaagaggtataaaaatggtacttacagaacagaaacgcaaatctttggaaaaactttcagataaaaacggttttatctcagctttggcatttgaccaacgtggtgctttgaaacgtttgatggcacagtatcaagatacagaaccaactgtagctcaaatggaagaactaaaggttttggttgctgatgaacttacaaaatacgcttcttcaatgttgcttgaccctgaatatggacttccagcaacaaaagcattggataaagaagcaggtcttcttcttgcctatgaaaaaacaggttatgatacatcaagtacaaaacgtttgcctgactgcttggatgtttggtctgcaaagcgtatcaaagagcaaggcgctgatgccgttaagttcttgctttactatgatgtagacagctcagatgaacttaaccaacaaaaacaagcttatattgaacgtgttggttctgaatgtgtcgctgaagatattcctttcttcttggaaatccttgcttatgatgaagaaatctcagatgcaggttccgttgaatatgcaaaagtgaaacctcgcaaagttattgaagcgatgaaagttttctctgatccacgctttaacattgatgttcttaaagtagaagtaccagttaacgttaaatatgtcgaaggttttgctgatggtgaagtggtttacagtaaagctgaagctgctgacttctttaaagcacaagaagaagcgactaaccttccatacatctacctaagtgcaggtgtatctgctaaattgttccaagaaacattgcaatttgctcacgactcaggtgccaagtttaatggggtgctttgtggacgtgctacttgggcaggatctgtagaaccttacatcaaagaaggtgaaaaagcagcacgtgaatggttgcgtactactggattcgaaaatattgatgaacttaacaaagttcttgttaaaacagctagtccatggactgataaagtatagtaaaaacataaaacggaggatattggtgtgaacagagaagagatgactctcttagggtttgaaattgttgcttatgctggagatgctcgctctaagcttttagaagcgcttaaagcggctgaaaatggtgatttcgctaaggcagatagtcttgtagtagaagcaggaagctgtattgcagaggctcacagttctcagacaggtatgttggctcgagaagcttctggagaggaacttccatacagtgttactatgatgcatggtcaggatcacttgatgactacgatcttattaaaagatgtgattcatcacctcatcgaactttataaaagaggagcaaagtaattaatgcataaactcattgaacttattgagaaagggaaaccattctttgagaaaatctctcgaaacatctatcttcgtgctattcgtgatggatttattgctggtatgccagtcatccttttctcatctatctttatccttattgcctatgtcccaaatgcttggggattccactggtcaaaagacattgagaccttcttgatgactccttatagctattcgatgggtatcctagcattctttgttggtggtactaccgctaaagctttgacggactcaaagaaccgggacctacctgcgaccaatcagattaacttcttatctacgatgctagcgtctatggtagggttccttttgatggcagctgagcctgcaaaagaaggaggcttcttgacagccttcatgggaacaaaaggccttttgacagcatttatcgcagcctttgtgacagttaatgtttataaagtctgtgtaaaaaataatgttaccattcgtatgcctgaagatgttccaccaaatatctctcaagtatttaaggacttgattccgttcaccgtctcagttgttctcctatatggacttgaactccttgttaagggaactcttggtgtaactgttgcagaatcaatcggtacccttattgctcctcttttctcagctgcagatggttaccttggaattacacttatctttggtgcttatgccttcttctggtttgttggtattcacggtccttcaattgtcgaaccagcaatcgctgctatcacttatgccaatatcgatgtcaacttgcatcttatccaagctggacaacatgcagataaagttatcacttctggtactcaaatgtttattgctaccatgggtggaacaggagctacattgattgttccattcttgttcatgtggatttgtaaatcagatcgtaaccgtgccatcggacgtgcctcagttgttccaacattctttggggttaatgagccaatcttatttggtgcaccaatcgtattgaatccgattttctttgtaccgttcattttcactccgattgtcaacgtttggatctttaaattctttgttgacacattgaacatgaactcattctctgccaaccttccatgggttactcctggtccgttgggaattgtactcggtactaacttccaagttctatcatttatcttagccggactcttggtagttgttgatactatcatttattacccatttgttaaggtatatgatgaacaaattcttgaagaagaacgttctggtaaaacaaacgatgctcttaaagaaaaagtagctgcaaacttcaatactgctaaagcagatgccgttcttggaaaagcaggcgttgctaaagaagatgtagcagcaaacaataatatcacaaaagaaactaatgtccttgttctttgtgcaggtggaggtacaagtggcttgcttgccaatgccttgaacaaagcagcagcagaatacaatgttccagtcaaggcggcagcgggtggttacggtgctcaccgtgaaatgttgccagagtttgacttggtaatcttggctccacaggtcgcttcaaacttcgatgatatgaaggctgaaacagataaattgggcattaaacttgtaaaaactgaaggagctcaatatatcaaattgacacgtgacggaaaaggtgctcttgcatttgttcaacaacagtttgattaataaatttgtaaaagttatttgagacgagatcactcattccatttccttggttttcagaacacagaatctcgtctcaaatgctttttttgaaaggacttacacttatgactaaaacacttcctaaagattttatttttggtggtgctacagctgcttatcaagcagaaggtgcaactcacacagatggtaagggcccagtagcatgggataagtatcttgcagacaattattggtatacagcagaacctgcaagtgatttttaccataaatacccagttgatttagaattagctgaagaatatggtgttaatggtattcgtatttctattgcctggtctcgtattttcccaacgggttacggtgaagtaaatgaaaaaggtgttgaattctaccataaactatttgctgaatgccacaagcgtcatgttgaaccatttgtgactttgcatcattttgacacaccagaagctcttcattcaaatggagatttcttaaaccgcgaaaatatagaacactttatagattatgccgctttctgttttgaagagtttccagaagtaaactactggacaactttcaatgaaattggcccaattggtgatggtcaatacttggttggtaaattccctccaggcattaaatatgatcttgccaaagtcttccaatcacaccacaacatgatggtctctcatgcacgtgctgtaaaattgtataaggataaaggttataaaggtgaaattggtgttgttcatgctttaccaactaaatacccttatgatccggaaaatccagcagatgttcgtgctgctgaacttgaagacatcatccataacaaatttatcttggatgcaacctatcttgggcactattcagataaaacgatggaaggtgtcaaccatatcctagctgagaatggtggagaacttgatcttcgtgatgaagacttccaagctcttgacgcagctaaagatttgaatgatttccttggtatcaactattacatgagtgattggatgcaagcttttgatggtgagactgaaatcattcacaatggtaagggtgaaaaaggaagctctaagtaccaaattaagggtgttggtcgtcgagtagctcctgactatgttccgcgcacagactgggattggattatttatcctgaaggcttgtatgaccaaatcatgcgagtgaaaaatgattatccgaattacaagaagatttacatcactgaaaacggtctcggatacaaagatgagtttgtagataatactgtttatgatgatggtcgtattgattacgtgaagcaacacttggaagttttatcagacgcgattgcggatggtgcaaatgttaaaggttacttcatttggtcacttatggacgttttctcatggtcaaatggttatgaaaaacgttatggattgttctatgtagactttgatacgcaagaacgctatcctaagaaatcagcacattggtataagaaattagcagaaactcaagtgatagagtaatatcacctgagaatgtaataatttgttatctgatttttagatcaggctttgaaaaggtatatattattaatttcgaagattgtcctataattcctgagcttgaagctacctcactacaaaatgtagtaactggtatgtttcacctggaaaagaatggatttgccattctgatttagcattatccgaatttgaatgggaagttttacaattactcgatgtagcaatatgtgagactgttcacttcgaggtagattatttgcctttccaataacaaaaagaaaggaattgactgtgactatcgaattaaaaaacgagtatcttacggttcagtttaaaacacttggtggtcaactgacttcgattaaagacaaagatgggttagaatatctctggcaagctgatccagagtattggaatggacaggcaccaattctatttcctatctgtggtagtttacgtaatgattgggctatttatagacctcaagaaagacctttttttacaggtctaattcgtagacatggttttgttcgaaaagaagaatttactcttgaagaagttaatgaaaatagcgtgactttcagtattaaaccaaatgctgagatgcttgataattacctttatcagtttgaactaagagttgtttataccttaaatgggaaatccattagaaccgagtttcaggtaacgaacttggaaactgaaaaaacgatgccttacttcattggagcccatccagcattcaattgtcctttagtagaaggcgaaaagtatgaggactattctcttgaatttagtgaggttgagtcttgttcgataccaaagagtttccctgagacagggttattagatttacaagatcggacgccatttttggaaaaccaaaagtctcttgatttggattactcacttttttctcatgacgccattacacttgaccgactgaaatctcgcagcgtgacacttcgctcgagaaagtctggtaaaggtcttcgagttgattttgatgattttccaaacttgattctgtggtctacaaccaataaaagtccattcattgccttagaaccttggagtgggctttccacttcacttgaagaaggtaatattttagaagataaacgacaggtaacgaaagttttacctctagatacttctaaaaagtcctatgacattacgatccttaattaaaatctgttataattttagccttaaataaaatttgaatacgtttgccttgtggttatagattggtcttcttcgtgccaatcttacatcgcaaggtttttaagttttttatgggtctatgtcaactgtagtgtgtgacgaaaagctaatgatgtaaaaaagatgatcaatagcgtacaagatgaaaccaaaaaggacatcagacagctacaaaaacaaatcagaaaatagtttgggtacggaggaaatcataatgttaagagaatttaaaaattttattctacgaggaaatgtattagacttagcagttggggtaattattgggtccgcatttactggattagtaacttctttggttaataatctcattaacgccttaataggaatgtttgttcaaagtacagccttggctaacttctacttttatattgataaaataaaattcacttatggagcctttttaaatgataccattaactttgttattactgcatttgttgttttcataataataaagtttgttaacagattaattccacataaagagaaagaaaagcaagaaaatcaaaataaagaattggacactctgattgagatacgtgacttattaaaaataaaatctaagtaaaaaagcttagaaaattatcataaattgattttggtagttaactatggtattattttactgtactaatcaaaaactgctcttcttaatctaagcgcagacgctaaaaactgatcattatgtgctgtgatcagtttttttgttttaattttctcctttttataaatattgataaagattcatttatattttattggactacaatcaaatatctaaacacaaaatgaacaatatctttcgaaaataatttttgagttcagttttaaataaatatttccatcaaaaatctcagtcattaattttaaaatctccatagtaaaatttacttctgactgaaagagatttctcattataaaaaagaaaaaatttttaaaagggaatttaatgattttcactctagaaataataagtttcgaaaaaattattgtttttccgaaacttataatcaacataaaacgcatggttaagcggttttagtttttcaaaggtttacaaaagcaaaaaaagcacctattatggcaactttatgagagtatgagagtgtttttaattagccttaacatagtgcaaaaaggatattctgatttttaacacgattcgtcagagtatcctttttttattgattatttttgtgcgtccattttaagtaatgtgttataatcgttttatattttagatatccctaaaatatattcctttctatcgagctgccttccttttggaactccgaaggcagttttttaaaatagaggaagtgacaaaaaaaagaagttgtgataaaataaaggtaaagaaaaaagagcttgcactaacaagctctaatgtagccgttttaagaacggtagcactacatacatcaaaatggcctactgcgtgctaagctgaacggtcattttttattacttgtatttatcacaagaatcatcaaggtcgcaaaagcaatcatgagactcaatgcctgaaatacagtcaaaaaattttcacctttcatgttttgtgagggtttgcccacgaaataatcataagcaccacctccaatcaggctaccgttcataaactctacaaacattattataacaaaaaaagccccgtaagtcatagacttacagggcttttgaaatattcattaaaaccttgggccggcaaaggttaaagtcatttcagggtgggatttataatgtcccacaacatcaactctccattctcctctcaggatttgacacataatagggaaggcctttttaaagcgaacgagttcatcattataagttgctgaagcaaatggtcgtgcctggtctaaggtcatcaagaaacgagggtctggagtatcgcaaatcaggtcatgacaataaaactgattgaagccgtcaatgacgaagtatccactatttattttttcaaaggagtccttacaaaaggctgactttttataatagtgccagccttcttgtttgaaatatttttcagcggcacttttatttgttgcccacaggggaagttcaaattcaaagccatcagggtcggtatatgtttttccgtctgaaaattgacttaacgtcagcagtttttagtatgattactgcttttattatttactccaaaactgttgttttacctttgtgtcggtagattgtcgttcttttgtcgtctatctgtcgtgtacatgtttaaaaaaatagtttattatatattcatacccgaattgctagttaatttcattggaaaataaataagtcgtgctatcctaatctaaaagaaaatgtaattttggggtttattattttaccttttggatattgtatgagagaatttacaaattttctaggtataaatttaatacaaaaaaacacttccatatggaagtgttttaaacgttgatatatgaataatattaacgttttgagaattgtgatgctttacgggcttttttgagacctggttttttacgttcaaccatacgggcgtcacgtgtaaggagtccagcgcgtttcaaagcactacggaagtctgggtctacttggagcaatgcacgagcgattccgtgacggatagctcctgcttgacctgatacaccaccaccatttacgtttacgagtgtatcgtagctaccttctgtttgtgtagctgcaaatggttggttgataacgagacgcatgtctgcgtgtgggatgtagctttctacttcacgtccgttaactgtgattttaccagtaccaggtacgagacgtacgcgtgctactgcatttttacgacggcctgtgccggcatattgtacttgtgccattatgttcgttccttcctgattaaatcaaacctgtgatgtcaaggacttcaggtttttgagctgtatgtgtgtgttctgcgccaacaaacactttaagtttcatgccttgagcacgtccaagtgtgttgtgtggaagcataccttttactgatttttcaatcaaacgtacagcatttttttcacggagttcaccagcagtaactgatttcaatccacctgggtgaagtgagtgtgagtaatatactttatcagttgcttttttaccagtcaatttgattttttcagcgttaacaacgattacgaaatcacctgtatcagtatgtggtgtgtatgttggtttgttttttccgcgaagtacgcttgcgacaactgcagaaagacgtccaagaggaacatcagttgcatcgacgacgtaccatttacggtcaacgttttgagcgttagccatgaatgtagttttcatcattttggttattttccttttactagaatttgtttacagcaggtgtaagagtcctgcaaagtatttttgggtttccggggccacaaaaatggggtaaacaataccgtttatcatcatatcatattattcctgggtttgtcaagacattttagggattatatcccctttatttacttcttttcgtggattatgtattttttagttttatatcttttcaaatgtttctttgtggtttttgctacaagcattatggtagcacttccatttgaactatgatagacttttttaaaaggggtttatataatacaagtccttttattcagttagccctcggaaatttgggggatttatatagaaaataggagctcaatgatgtttttagcaattaatgaaattaaacattcaaaattaagatatgctctcgtaattggtgtcatgtttttgatttcctatcttgtgtttttcttatctggtttggcctatggtttggctcaagaaaatagaatggcagctgataaatggaaagcaactgatatttttttatctgagaaagccaatgattctctcaatatgtcaatgattgattcagatattgccagtcaggtgaaggcgaaagaaaaggcagttctcgctcaaactgttgggattatttatgatgccaataatgaaaataaaaaaaataatgtcagtttttttggaattaattcaaatgaatttttaaatcccaatattcttgaagggagggattttaaaaataagggcgaggtagtagctgatattagttttaaaaatcaatatgattataaacttggtgataaaattaaattagcaaccaataatgaagtattgactattgttggctttacagataatgctaaattcaatatttcacctgtgctttatacttctttagatactttccaacaaattcgttatggttcaaattccaattttcaacctaaaactacttacaatgctatcgtcacgcgcggaaaaattagccaacagcctaaagggctccaaaaattatctatcagtaaatttatagataaacttcctggttatagtgcacaagtgttgacctttggtttcatgattggctttctagtggttattgctgcggttgtcattggaatctttatttatgttctgacaatgcaaaaaatagcgatttttggtgtaatgaaggctcagggaatttccagtcgctttattagtaattctgtcatcgctcaaacttttattttagcttttagtggggtattaattggtttgttagccactttaggttctgcgttaattttaccggaagctgttccttttcaaacaaatctcctcttctttggagtgattacccttttaatgattgtggttgcaattgtgggcgctttgttctctgtcagagcaattgtcaaaattgatccactaaaagcgattggataggagaaataatgaaagctattgaattaaaaaatgtcaaaaaatcttttaaggatggggatgaaacaatagaggctttaaaagaaactaatttctctgttgataagggtgagtttgcggcaatcattggcccctcaggttctgggaaaagtaccttacttactattgccggcggactgcaaagtccttcttctggggaaatttggattaatggccgagctttaaatgaaaaaaaggagaaagcacgcgctaaggttcgttttgaagaaattggttttattttacaagcttctaatctcgtgccattcctaacagttaagaaacaacttcaattggttgacaaggtaaataaggcaaaagaaaatagagcaggcttagacttactcaaccgtttggggcttgaaaaattggtggataaatatcctgaggaactttctggtggggaacggcaacgggtagctattgttcgtgctttatataatgaccctacaatcattttggctgatgaaccgaccgcaagtttggatactgaaaaagcttatgaagtggttaaaatattagctaaggaagcaaaagaaaaaaataaggcaacaattatggtcactcatgatttacgtttggttgattattgtgacaaagtttatctgatggaagatgggcgtttaagtgagaaagttgactaactttgaggtcttcgtatttagaatatgaagacttttttcattattttacaacatgtttgctataatagattctaataagaaattatttttaataaatggtcggattcttattctagaatagctaatttatggtagaatgttcttatgaatattgttctaaaattagagactaaagaacgccaacagctcgctgagaaatacaaatcctatgagcaagtttccaaaaatccttacatcactttttttgccaaggttgggaaaacttctatctcggtttatacttctggaaaagttgtttttcaaggaaacgaggctgaaaaattagcgagtgactttggtcatattgctcaagtcgttcctcaaaaacaaacaaatcttattgggactgacgaggtgggcaacgggtcatattttggtggtttaatggttactgctagttttgtcagtgaagaaaacttgaattttctaaaggaaattggagtcgctgattctaaaaaattaactgacgaaaaaatttgtcaaattgctccaaaattgattgatagaattccacatgttgctttagtggttgaacctgccaagtataatgaggtgattgcttctggttataatgctgtcagcattaaagttgctctccataatcaagccatttatcttcttgaaaaacaattaggtcataagcctgaaaatattgttattgatgctttcacaacggaagcaaattataaaaaatatgttaataaagagcaaaatcatccgctgacaaaggtaactttactgacaaaagctgaagatcagtttctggctgttgctgtcagttcaattatttctcgttatctttttttagaaaatctaaaaaaattatctaaagaatcaggtttcacgttacccagtggggcaggaaatttatctgacaaaattgcagcacaaattatcaaaagtcagggagttgatgctctgaatcagttagcaaaacttcattttgctaatacacaaaaagcgattaaaatcgctcaattatagaaagtaaaattatgatgaaatttttaaaagagtggggattgtttctctttataattgtcgctattcttctctcacgtgtctttctttggtcacttgttgttgtggatggtcattcaatggacccaactttagctgacaaagaacgtctggttattgtaagaaaatcaactattaatcgttttgatattgttgttgccaaagaagaaacagccgatggttcaactaaagatatcgtgaaacgtgtcattggaatgcccggagatactataaaattcgaccatgaccaactcacaatcaataacaaagtttatccagaaaattatctcaaagattatcaaaaacaacttgctgacggtcagttggaaaaaacttacggtaagtatcctttaacaaatgcactcagtgaacaaaaccgcagtttgtttgttagtttagctcaaagcaccaaagcatttaccactgacagcactggtaatccaacctttacagtaaaagttcctgagggacaatacttcctgatgggagataatcgggtagtttctcaagatagtcgcgcagttggaactttcaagcgttcagcaattgttggtgaagcgaaattacgagtgtggccactcaacaaaatttctttcttttaagtgaataaatagaaaaagttactgacagaatatcctgtcagtaactttttttatttgtcattaaatatatttcccaattgaacatcaattgaacggttagcaatgtcaattcgatcaactttcaagattgatttgtaatcatcaatcaatcgctcacctttaaatggtccttcaagaaaaacggcaacaccggcaagtaaacaatcaaattcatgaacaagacttctcattccattgattgttcctgcgcctttcatgaagtcgtcaacgatcaaaacattttgaccaattgaaagactccgtttggataaagtcatattttcaacacgagagcttgagcctgacatataatttacattaagcgttgctccttcggtcactttagggtcacgacgaacaattacgaaaggaacatctagaatctcagcaactgactgagcaattggaatcccttttgtggcaatagtcatgacgacatcaacttgcttttcatgatactcatgagcaataatttgaccaattttacgaagatttgatggagtgcctaaaatatctgacagataaatatatcctccaggtaaaattcgattttcttcacgtaaaagttcagcaatttcctgactcatttccaacgaacgttcgtcagtaatgtaaggcgtaaaccgaactcctccaaggctacctgggaaagtttcaaccagacctactccttggttttcaaaaacacgtttgataaatactaaatcttctgagatagatgatttggctacctcataatgtttacttaattcatttaaatttagcatttgattgggatgattaattaaaaaatttgtaaaatcaactaaacgttcgtttcttttcatttattatctcatctcctatttgataagcttattatagcatggcatttccgaacattcaagtttcacatgaaacaattttactgacagatttcagattcataaaatatttttctgtcagtaacgtttcattttaaaatgaaaataaaaaaagcagtatcacttagatactgctttttcacttttaggagtaaagttatgaaaaaatttttttggaataaatatattatagcttcactgacttaatggttcattaagtcaagataaagtgaaactaaaccaaagaaaatcttgtcagtaaaaaaataacctgtcagtactgacaggttatctcatattattaaaattaaaacttagtcagcgttacggccgtttttagcaataatttcttcttgtactgatttaggtacgtctgaatagtggtcaaataccatcatgaaagtaccacgtccttgtgtagatgaacggagagtagttgcgtaaccgaacatttcagcaagtggaacgaaagcattaacgatttgtgatttaccatgagcttccattgagttaacttgaccacgacgagcagtcacgtgacccatgatatctccaaggttttcttcaggaacagtgattgtaactttcatcattggttcaagaattgctggtttagcagttttagcagcttctttcattgcaagagaagcggcaaccttgaaggcagtttctgatgaatcgacatcatggtatgaaccatcataaagtttagctttaatgtcaaccattgggtatccagcaaggacaccgttagccatagtttctaccaaacctttttcaacggctggtacgaattcacgaggaacgacaccaccgacgatagcattttcaaattcaaatccagcgccttcttcgttaggtgtgaattcgatccatacgtcaccatattgacctttaccacctgattgacgtttgaagaatccacgtgctgaagttccagcgcggaatgtttcacggtaagcaacttgaggcgcaccaacgtttgcttcaactttgaattcacgtttcatacggtcaacaagaacgtccaagtgaagttcacccataccagagataactgtttcaccagtttctgggtttgtttcaacacggaaagttggatcttcttcagccaatttttgaagggcaacacccattttatcttggtcagctttagttttaggttcaaccatcaattggataactggttctggaacttcaattgattcaaggatgattttagctttttcatctgtcaatgagtcaccagttgttgtatttttcaaaccaacagcagcggcgatatccccagcataaactgtttggatttctttacgagtgttagcgtgcatttgaagaatacgtccgatacgttcacgtttaccttttgaagtattcaaaacgtatgaaccagcatcaagtgtacctgagtaaacgcggaagaatgaaagacgtccaacaaatgggtcagtcatgattttgaaagcaagagctgcaaatggttcttcatctgaagctgggcgttcgtcttcttcgtctgtatctgggttaacaccttggattgcagggatatcaagtgggcttggaaggtagtcaataactgcatcaagcatcatttgaacacctttgttcttgaaggctgaaccagcaagcattgggtagaagtcaacattgattgttgctttacggatagcagctttaagttctgcttctggaatttcttcaccagcaaaatatttttccatgatatcttcatcgaaatcagcaattgcttcgatgagtttttcacgccattcgtttgcaagttctgtgtattcttcagcattgaaatccaaagctgccaattcagcgttaaattcgtctgaacctacaacagtttctttaatatctgtaccaaggtcgttagtatagatttcagatttcatagttaccaagtcaatgataccgatgaagtcatcttctgcaccaattggaatttggattggatgagcattagcacccaaacgatctcccaaagtagaaagtgagtagtagaaatcagcaccgattttgtccattttgttagcaaaaacgatacgtggaacaccgtattcagtcgcttgacgccatacagtttctgtttgtggttcaacacctgattgagcatcaagaacggtaacagcaccatcaagaacacggagtgaacgttgtacttcgattgtgaagtccacgtgacctggtgtgtcaatgatatttacgcggttacctttccattcagcagttgttgctgcagatgtgattgtgataccacgttcttgttcttgctccatccagtccatttgtgatgcaccttcgtgagtttcaccgattttatggattttaccagtgtagtaaagaacacgttcagttgttgttgttttaccagcatcgacgtgggccatgataccgatattacgtgtattagcaagtgaaaattcgcgagccattttgttctcctatttgattttagtcatgagaatttctcattagttttattgtatcaaatttatgttaaaaaattaaaacaaaaccgagcaggcgaggagcccaagcccggtaatgttcgtttttttacatcaattcgatgttactttacaatctttaagactgatcgtaaaatttatttgctaagcagaagcgagaaagaaggttccgaagcgtactagagtacgcgagggttcttctgacgaagcagctgcaacgcaaatagattttaccagcggaagtgagcgaacgcacggttagcttcagccattttgtgagtatcttcacgttttttgactgctgcacctgtgttgttagctgcatccaagatttcttttgcaagacgatcttgcattgtgtgttcaccacggttacgagcgattgttaccaaccaacgaagtccaagagttgtacgacgttctggacgaacttcaactgggacttgatagttagaaccaccgacacgacgagcgcgaacttcaagaactggcatgatgttttccatagcagtttcgaagacttcgagtgggttgtttccagtagcttcttcaatttgtttgaaggcaccgtaaacgatttgagacgcaacaccacgtttaccatcaagcataacgcggttgataagacgagttacgacgattgagttgtacattggatctgccaaaacttcacgttttggggcacgatttttacgcattcttacttatctcccttcttaagcttttggttttttagcaccgtatttagaacggctttgtttacggtcagcgacacctgctgtatcaagtgcaccacgaacgatatggtaacgtacccctggaaggtcttttacacgtccaccacgaagaagtacaacactgtgttcttggaggttgtgtccgatacctgggatgtacgctgttacttccataaggtttgaaagacgtacacgcgcgaatttacgaagcgctgagttaggttttttaggagtcatagtaccaacacgagttgctactccacgtttttgtgggcttgcaagtttagtttgtacttttttacggctgttgtagccaacgttcattgctggtgatttagatttagtcacttgagcacgacgtggtttgcgtaccaattggttaattgtaggcattttactgtctgctttttgtatttttccacatttttatgcgaagcgatgagaaatacaaaagcattcctttctttttattggatggcgaatcgccaattttttagtcagtatatggtcgcttaagccaagttctgacaagaagtttagcaacttatacaagttctcctgagagtccaaagtaaaaagtaccgtttaatataatatcattttttataacaattgtcaatctattttttagaattgactttgaaaaaataaaactatttaattatctatcaagttttgaatctattgtaccttacgaatagactatggtataatcgagtcatgaaaaaaattgcaattattttttgtagtttcctgattagtctgtcagtcctttcgggcttttctgtcagtgctgctacgactccaacgacaaatgattttacagttgctgctaaatcagcaattgctattgatgcctcaagtggtaaaattttatacgcgcaaaatgctgatgatgcaagcactcggatcgcctctatcactaaattactgacagcctatttagtttacaaaaatgtagctgaaaataaattgacttggaatactaaagttcctatttcagattatgcttatgaattaactcaaaattctaatgcttccaatattccccttgctcaaaatggtcaatatactgtcaaagatttattgaatgctttacttcttccgtcagcaaattctgctgctgtcgctttagctgaaaaaattgctggttcagaaccaaaatttgttgatatgatgacaaaacaaatgaaagactggggaattactgacagccatctcgtcaatgcttctggcttaccaaatgatgatttaaacggtcatatttatccagggtctggtgcttcagcaacaaacacaatgagcgcaaaggctgtagcaacacttagttatcatcttattcaagattttccagaaattcttcaaatcactaaaaaaacagaaattccttttgataccggcaatgaagcaaagatgaccttaactaatacaaatcaaatgcttagtggtttttctacttcaagaactggtgttgatggcttgaaaacaggttcaacaagttttcaaattgactgttttgctggaacaacaaatcaaaacggttttagaatcattacggttgttttagaagctacagatcctgctgctgacaactcaactcctttcactctcacaaatcaactgatgaactatgtttatggtcattggcgtacgaccagtcttgtgcaaaaaaatcaatccttagatgattttaaagaaattactgtgactgatggaaaagaaaaatctgttcaactcgttgctccacaaaatatcactcccgttgttccttacgctacagatggtagtgcagatacaaaatcactgacagtcaaattcagtaaggaaaaaacagcctccgttgaagcaactgtgactaaaaaccaaaaacttgtcactctttctactacagtaaaggatagtttaggctatcttccaaattgtaccgcagaacaaattccattggttgctaagaaaactgtcccccgtagtagcgctccaaaggttttttggaatcattttgtaaatttcgttaatgaaaaactctaaaattttactgacaaaaaagctgtaagtaaattagcttataaaaaaaagccgtcaatttactgacagcttttttattatcctttagattttacaattgcaagtaaaattgcacctgttacgaatagaacaatcccaattccaacataaaccaattcttttttggttttcttttcaccaaggaagagaattcctccaatagttgaaatgatgacacctaattgcgagaatgaaaaggcaattgcgttaccagcagcgcttgcagccataagcataaagatattacctacaccccacattgctccaacaatcatattttgataaacatatttttccattttaattttgaaacgacccattacaagtgctccaaaaatcattccaactgacattggcaagataattgtcagtgcatcaaaatgaacattgaaccaaagtactgctaagttattgaaaagaataacatagataacatatcccaaagttgagtaagttaaagcagtcaatcctttagtataattacgtccttcttcaacaactgcattttctgggtcacgtttagctgagaaatagaacccaactaccaaaacagccatcgcaataaatccgagaataaattgaatttgttttgtccattcgtggaaagcaaaaaccccaatcaagccaccaattactaattgactccctgatgaaagcggacttgctactgaaacacccatgtatttcattgaattaaactgaccaaattgtccaattgcccaaagcaatccaccaataaatccaattaagaaaatttgccatgtcaacgttggcatgcggaataagaaaacaataagtgcaaaaacaaaagcgcccaaagtcattccaagtgtttgttgtttagcatcaccaccaaatttattagctacaaatccgatagaaccccaagcaaacattggaacaagcgcgagaagaactccttgcatgtgtatatttacctctttaaaataattttttacttaaaaaattaagcatttctctattttactcttttttttggaaaaaacaagagataaaagaatacataagattcacaactgttcaagtaaatttattttcttttttcgattaggactaaaattggcggcgtatgaatttggttaagaggtgcataagaagtcacttcccagtccttttgtggcaaactagaagtccacttaataacggcatctttttcttccattcccccctcgtgaccgtaataaatcataatcgcaattcttccacctacaactaactgattagtcaaagcatctagagcagtcaaagtggtatcagcctttgtaaccacacttttatcagttttgggtaagtatccaagattaaaaatagctgctttgattggctctttgacatattcagaaagcttttcatgaccagacaaaactagatttactaacggctctgtcagtaaattcgagagatttttttcaaatatttgattctttattccagcatcatctaaacgtttttcagttgcatttagcgcttcttcttgcacatcaaaagcatatacattcgcccctaattccgctaaaaattgagtatcataaccattccccatcgttgcatccaccacaacatcattagttttgatgatatctttcaacatccagtgagccatttctaactgttttaacatttatttcctcatcactttctaattatttttatataccaatttcagttttactgacagattttcaatttctttcctattataacaccaaattcaataaaaaagagatgaataaaaattcacctcctgtcagttaaaatgtaattagatcactaagccgaacatctttacaaccttgaacacttcctcgccgttccatttcagcatcaatactattcaaaacttcccacttttttaaagaccacataggtccaataattaaatcccgcggagcatctcctgttaaacgatgaataacaatttcttttggaatcatctctaattggtcacaaatcacttttacatattcttcttgcgacatcagctgtaattttccttcatgataatcacgttgcaaacgagtttgcttcatcaaatgaagtaaatgtaatttcacaccttgaatatcagaatctaaaaccattcgacgaacattttctaacatcatctcactagtttcaccaggtaaaccattgattaagtgagtacaaacattaatattatgaagcctcaatctcttcaccgcatctacataggtttcataatcatgagctcgattaatcaaatctgatgtttcttcataagtagtctgcaaacccaaatcaatccaaacttccattcgacgatttaattctgccaagtaatccacaacgtcatctggtaaacagtcaggacgagtaccaattgaaatacctacaacatctggttggtttaccgcttgttcaaaacgctctctcagtacttcaacaggcgcgtgagtattagtgaaattttggaaataaacaatatatttcttcactccaggccactttttatgaaattgagccacttcggcagcaaattggtccgcaattggagcttctggctccaaaatcatgtcccctgaaccagatactgtacaaaaagtacatccaccatgagcaaccgtaccatcccgattagggcagtcaaaaccagcatcaataggaactttaaatattttttcaccaaaattggttcgcaaatattcattccaagttgtatatctcttttgcattctatatcatctctccgtttatcaaattatatcaaaatttcttaaacattttctgtatttataataaaaaaagagacccgtaggtctcttaaaagctgcggatgtcagactcgaactgacgacatcatgattaacagtcatgcgctactaccaactgagctaatccgcaataacataaaactcggttccccgagttttaataatatagtccgtacgggattcgaacccgtgttaccgccgtgaaaaggcggtgtcttaaccccttgaccaacggaccatactttcagtccaattcactggtaccctatttggtttaatcaattcattttcgtcttttagattacgttgtttaggcgcctctatgaatgttgcatcaacaatctgtcctttatgagcgatcatcccttgtgattcaagtttttcttgaaaggcagaaaaaagccagtttcctctattagattttgatagctgatttctaaagttccagatagtctttgcgtctggtaccttgtcatcaatcttaaggaatcttctaaacgaaatccggtcaatcatttgatattccattgcatcatcagatagattgtataagcgttgtaaaattagaattttcaacattaaaacaaggtcatagggcggtctaccactaagagttgggcgaaaacactcgaaatcaaccactttttctagccgctcaagagggtctccttttaaacttaatttttcaagatagtcgctatctccaaataaattcatcttcaatacctcgttagcttatttttaatctattatacctcttttcatacgtttttagaggtgccctaaataatatatgttaaatgccagatgacctagattaacacctctttaataaccatactttaaaaaaataatatgaagatgattttcagtattgaaggtctttttaggaatgggtgaatctattttatccgtttggtatacttattgcatttacagaagttgacaatttaaacatatctaatgtttttcttttcaattttccatgatgtgttccgtattatttaatttttcgtctctatatgggtattaaccctaataaccagagcacaaatctcccacctctaatattttataactaatgtgctttttatttagcaacagataatgtgtatcggtttcattctttcgttattcaataacacatacattccatcctaacaattcaagatttgtgatggaatctttgtcaactttatcttttggaatggctatacacaataaccctcgcgctcttgtcatagctacataatggcactttagtctagctatatcacgcacacccggtttctttttaggaggagtaccaaatatgaaaggcagtatagaggtaatgttatggttatatgagaacgtctctaaaactaaagtggataaatgagtttggcctttaacggagtggatacttcctaaagtaatatctacacttctgccactttcatctgaatacctaaatacatttttaggacacaatccgtcactatcattagaagttgtaatattgatattattactccattccataaagtcagaatttccatagtctacatcaaaaagacttaaaattgaggagattacactttttatttctacccattcagtttctagaaaagaagttttattcaatatcaacaataatttttctctaaaaatattttgtttctcattatctagcttatttaaaaatgaattgatcaatgaagttttattttcaataatagtcgtattagcaaccttattgattaaaattcttaatccttttaatacccattctacttgaagatacgcttcgccagttagatccagttcatttctacctaacataaaatattcaactaaatactctggagctgtatttatagagattgacttgtgattataatcgtgccaatagtcaaaaatgccttttgggagctgctcaggcttggtctcttctttctttatatgaaccataccaatcccatgacagccgtctaactggtattttttcaattcttcgtctgtgaatgttgataaaataagtttggagtactcctctagtacagtatcaattttatcagtagtgaaaagaaatatagtattcttacaatcaaacgtcctattcatcccaatcatctctgcattagatatcgctaaaggatttgctaatttagatatattattattgaacctcttactctccggtagaatcaatgggttcgctctaggaaatatatcagttccgttttcgccaacatagttgtaaattgcttgattttcgtcaccgaacccttgtcgtatagagtctggaaaagtagagttgattaaatcccactggaaggaattggtatcttgcgcttcatcaatgaatagaatcggaaaccttttctggacataaactactatttcgggattattcgacacggcttcttgagcaaacaacaaagtttctccgaaagtgaaatagccttttttttgagaatttttaacgattgttttgacagttttgtaggtttgggtgttctcaccaagattacccagatcgattttctctaactcatctttgaaacaaagatccatatgagtctttctcctactaagtaagggcgtatgagaccataatggcaagtttttccatctatcagcacatacaaaatctgtatccacaatttcaacagcattaccttttgaccttatccaaggaagccctatgaaagaattgaaaaaagaatgaacagtaccaatgaagtgaggataccttagaagttcggcgccaatttccgtgttgcctaatcttttctcaatttcctctcttgctacatttgtatgggaaagaacacaaattccagaagtagtggaagtccacttctttgctaaaattgctaattttgccacaagaatagtggttttcccactcccaggaaaggcctggatatctattgattccagatttttaattatatttcttctaggctggtcgaatttaatattaccatcaagtatgccttcaacccaatctatatctacatcggttatcgttatttcatcaataaagtccataagtctcaccttaattttttgtgacaaacaaaatagcattcactaaatatggcggtagtatatcttttaattcttcttttccagagaaatctgtctcaagttctagtgctaactgttgagagaattcagccttagaagtattcctttttgcaaaaaaactataaaaacacgaagctttttcttctatactagctcgtgcgtctagagctgttgatatctcagtagttttacttatccaattaacttgcgcataggtagttttcactatagccttaattaaagaattcttcatagctacattatttaatccatgatatgctagatcgtattccagggtccacttatctgacacaaacgttttgacattctgaccgttagctttgccctctatgtcatttagatgtatagctttttgagtatcatcaaaatcactttcaactctccattttcggtttttttcttcaggccagtttgttttatcatcctttaattttttatcaaggcaaatactcggcgcacaatttggcatgatatctctatccgtaacgcaagcaacattaaccttaagccagtcggctgagtactttggattatctttatcttttctttgaaatattttggaataccgtctcaacccagtacttcgaacatctactaaagatacaccgaagtccacaaaatctctacctagtaatcgagagagagtcggcagtaaaagtgcttcacctggtccttcaacaatcattacgttccgagcaaaaaataaatttgctttcgtagcgtctagatatctttcaagaaaaatatagtcatcttccttcaaactagtctcacttttagaaagtggataagcgtttccatttttaattaaaattatgttctccaacttgactgctgatgctaacagaggagagtgtgtagttaaaataatttgctgtgaattaacttccgcctcattctgaagagatttgactaatttcatttgtctctgggcatggatatgagcttctggttcttctataagtagtagttgacacgcctcttgtgagtttctccttaataataactcacaagccatactcataatattgcttgttcccagtccgggaactcctttgagtgaagtagtgtctttgtcaatcgttaagtctaatttttccaataaggttgtaagttttttcatatcagcagtgtcagagcccgtgacttcgaatctagtggctaagttatcaccatctagcaacatttgattctttaatatacctgtcatttgatccttaactgtttttaaggcaggatagtcagccaataacttattagataaattgaagatgccaaccaaggataaatctttaagttctactccttcttttaggtcatcctcaccttcacttatggcaggaacattctgaacaacttgagacaaccttgagtttcttccagactgcatatcactatacgcgtctctcaaggctcgtagataagtgacccttaacatctcacgagattccggtgataggactgggccatcaccatttttaccagtagtcatagaacttaccggcctaggtggtttaaacgactgcatatatctgcagttccaatgtagatatagcgagggaatctttctcttgctgtcatcgtcttcgtatgttaaatactccaaaaacgcagaagtttctatcggagataagtcagtaaacttgcaagaaatttctatttcgagtgagctatcttcattataaaaatcggaagcattaattctgtaccagttaaaatcggttgtccctaaaacaatacggatagcatctaaaatagcagacttaccagagtcgttttctccaactaaaaccgtgagccccttgttgaactttatctcatgactcgcagagccgaacgatctaaaattcttcaacttaagcgatgataaatacatatttcactaaccaccttatcttttattaccaaaaattatttaaacacattgtatctactattatatcctattagcatataaaacaaccattgaattaaaaatgtattgtctgtctacttacttgaataaataatgagtaccggatacttacaaatgatgagcatttttttagatatgtctaaaaatagattaaattttcgattcttaacgcatattttgccaattgcaccgtcatcaattataaagtaggagataaaaaataaagaagtggattcgataaagcaaataattttactcctaatgatatgtaaaataagacttcttaatttggaagtcttattttttgtagtggttaacttggtttgtaaaagcttcatctccactgaatttaaaattttattattaagggcacctctaataactactaattaattcacctctaaatgaaattagaaaaaaaaacacagaaaactaagcatagtctactgtgtttttctttatgttacagacgccacttgactgtttattcttattttagacagattaccgccatgttttgagatttaaacgtttaacttgttcgtacctcaataagttataagtcagatttgtaaggtcagtatttaaaacagctcgatcgaatccaatagaacgtaaactagaaccatgcattgaattttcaacaaagccaaatacatgttcaacacggacacgtattttcgaaatgattttattaaacattttatcgtctgccttaagagatttagaacgtgtgtttttaatacaggtaaaaagttcagcacctttaggtgttgcttgattttgataagctgagtctgctaaggtgatctcatcgggatcaacaagaacgcctattacttgagaatcatggacatttgcaggcgttgtttgataattctttacgaattttgatttggtatctatagcaatatgatttttgtagccatagtgtctctcattacctttaattgtccagcgagcagctgtatccttctgtgctcttttgttcttcatccaattcactggtaccctatttgctttaatcaattcattttcgtcttttggattacgttgtttaggcggctctatgaatgttgcatcaacaatctgtcctttatgagcgatcatcccttgtgattcaattttttcttgaaaggcagaaaaaagccagtttcctctattagatcttaattttctcagtacatttgattgtcaaaattttcttctttttcacttttaatctgaagtattatattttatttcaaaagtaaaaataactacaaacgaaataaacattatgatgcttattccaatataagttttatagcttaaggaatctataaaattagaaaataagagacttcccaggggttgtgcaccatcaaatgctagaaaagctaatccgaaaactctccctaagtatttgctatctgtctctttttgaataaatgtcggtatactcccaaataattgagcttggacaaatccaaatacggcaaccattcctaaccaagtatattgattaaaataagaaactactcccaataatattagtgaaaatattactaactcaagatatatttttgaactgttgatacttttagtttgtcttgcaagatttacgcctcctgccaatcctcctaatgacattaatagtaaagctatactatatatactaacattgctttgaaaatagtttttagctaagtatggaatcaataatataaatcctgagtaacataaattaaaaattcccattgcagagattaataatataagttttctagttctcctaatatactgaaacccctcaataagattctctataaactttccgcttatatttattgaataggacttaggatgtcaagggccatctaaaaatgttggttttgggtcattgaaaatgtaggaaatgggccacccaaattgttggttttgggcccatcactttatttactttttggggttttggttttcttctcactatagtctttcattctataagattttccagtaatagaaatgactttagaatgatgaaccaagcggtccaataaagcattcgttaatttcttatcttgaagaaactcagaccattgagaaagtgggatattcgtagtaatcaacgtggatttcttttcatatctcatattaatcagttgaaagagaagactcgctccatctcttgaaaagggcagataacccacttcatcaataacaagtacatcataattggcatactgttttaatactcgctctaaagttcctttttgattggctcttaataaacggtccactaattcagtactcatacaaaagtaagagctataacctttctctagggcttctaaagtgatagaaatagctaaatgtgtcttacctacgccactattgccaatgaagagaagattctcatgcttatctaaaaaacgtaaggtatgtaaatctaaaatctctgctttattaattttcggttgaaactgaaaatcaaagtccatcacacgcttttcataaggcagatgggctttttttaatcgtctttcctgaaggagcgcttctcgttcacgaagttcttcactcaagagttcatgaaggccctctactaaggaaatatccgcatgctcatctaagaactctggtaagagctgacgcacacgatcgagttttaaatggtccaattggttgagtaattgatgataagttgtcataagcgctcccttcacaataaatcgtaggcttgaagattctcatccacataagcctctagttcgtcttcttcaagatgtttgaagacatctgatttaagaatttcaacgtaatcttcacggcgataattaaagggacggtcgcttaaaggatgacgagcaatcaagcgttggtcacaatagactttaaggtcctcttgttctttttcacaggttacggtctgtccaatatatttaaccggcactgaatatttacgcccttcaaagatcacaagtgcctctttagagacttttcgagtcaaaggaacactcaattgactataaactttgagaagctctaaatcaaaagccttgagattcaacgcctcttggtcaagacgttcagaaggtgaggttccaatcgcttgagagatttctttatgattcaaatcttccatcaattgttggaccagtgcttgtaattcttcaaggtcttcaaactcattgttaaagacaagcaggcggtcaacagttctcgcaagcgcttctactttacctttggtttgaggtctgaatggccgacaagcaatgggtttaaatccagcatcttttgcatactgcctgaatcgttcattgaaaacaacatttgagaattgacttttagaatggtccaccactgttttcatattgtcaaaccaaatttcttcagggacacctccgaatttctcaaaagcgtgattgagacactcaaagagtgtgggttggagacggtcgacggtcaattgaagatacttcatccgagagtagccaagaatatacagaaagatattaatcgtaaacacttcaccattgcgtgagatcagttttaaattttctttccagtcgacttgagcagaaagtccaggcgttgtttcaattcgaatcgttgctttatgtttgcaggattctcgaatcaatctggcatagcgtttgacggtcgtatatgagccttgatagccttttagttggatgaagtagtaaattgagcgcacagagcagccaagcttgagtttatcttcaatgattgatttatagttctcaataagtgacggtgggacccttcgttttgaagcttcttcaagggtcttttcttttccgaggtcataataacgtttgaccgtccgatagtcacaattatagcgtctggcaatatcagcgaaattaggtttaattccagtcataagatgttcggttatactttctaggatgtcttttctcataaggaaaagcctatcacaattttaaagttaacctacattttcaatggcccgtttcctacattttagcatggccctttacagtcttttgattacctttaggagctcgaactattcataggttgttttttcttccatacatccatcgaataaacgaaaactcgttgctgagatggagaagaggtggtataatataacgatacgaggtgaaagaaatgatactagaaacttatctgaaaaacaataatacaaatattagacagatgcatattgtatcgggcattccagaaacaacagtaagaggaatcagcaaacgcgaattttcgaaatggagcattacttattttgatgcgattgccaggacggttggtaaggagcggcatgttgttatgcaagaattggaagctttgaaagaacaagcggataatttggcacctctaggtagatataacctagaaaaccgaaggtatattggaaataaaaataagttattaacttggattagtgatctaattgatgagcacactgaaggtaaatcattttttgatgtttttgctggaacaggagtggtatcaaaagagatgcttgggaaatatgattctttcattatgaacgattttctgttttccaataatatcatctataaagctttctttagcaatgattcgtttgattcaaataagttgctctctcgtcaagaggagttcaatggcataattacgaacaaagaggatgacgattacttttctgataattttggcgggaaatttttcagtgttcatgacgcaaagattataggtgagatacgaacaagaattgaaaaagataaatcattgaatgaaatagaacgggcaatactgatagcatcacttatttactcgagcgataaaatagcaaataccgttggacattacgatgcttatagaaaaaaagtacaaatagctgataggtttaaatttgagctggtaaatcctcttgatacctcgagtaaagatatacagattttcagagaagattcaaatgagttagttcgaaaaatatcagcggatgtggcgtttatcgatccaccatacaattctagacaatactctcgcttttaccatgttttagagggaatcgcgaaatgggacaagccagaattaggcggtgttgcaatgaagccacctgctgaaaatatgagcgattatagccgttcttcagcacccaaagtatttgatgatttaattcaaaatcttgatgttaagtatattgttgttacgtataacaatacttataaatcaaaaagttctagttcaaaaaataagattacacatgatgaaatattggaatctttgaacaaggttggaaaaactaaatctttcgagatgccttttcaattctttaatgcaggaaagacagatctaaaggatcataaagagttcgtctttataacggaggtaggaaaataatgcaaacgacattgtttccaactgacacactcgaggttgttgcgcccatgaaaaaaagaggaaaagctattcgttcaccattattctatgtgggtgataagtataaattgatgccgcagttgaaagagcatttccctaaaaatatcaacaattattatgatgtgttttctggagggggaagtgcttcaatcaatgtcatagctgataaaattattatgaatgatattgacgaaaaggtagttgagctccatagatttttacaagagcaatcctgtgacattgagttatttattgagaatatgtacgagcttattagagaatacgaattgagtctttcagaactagggaaaaacagtgaaattgaagagttgaaaaaggagtttaagaaaacatattttgccaaatacaataagcaggcttacttaaaactcagggatgactacaataaagatcagtctaacactaagcttttgtatctccttctcatttatggtttcaaccacatgatacgttttaatggtcagggacagttcaatcttcccgtcggtaatgttgactggaataaaaatgtttcaaccgcacttagaaactattcccaatggtataacaacaataacattgagatttcaagtggaatggactttgaggattttgtaaatttttatgatttaaagaatggtgatttcctttatttcgatccgccgtatctgatcacctttagcgactacaataaaatttggggagaagatgaagagcggaggttatacaagcttttggatgaacttgattcgaaggggataaagtgggggctttccaatatgtataatcacaaggggaagactaatgaaattttgctcgaatggggtaaaaaatacaatgagtatgacatcaaaagtaattacatctcccgattcgataatacgataaaaaaagatagtaaagagatttatataacaaattacatcaatgagtaatttagattttttaaattcaggaatagagtgtcacacatttgatgtggcctcttcctcattgtttaatatctatttggtaagaaggagaagagtgtatgacaagagtacgaagaagaaagccaatatcatttgatacaacgttaagaaacccaggtaggataccgcaatttatctcggttctaagtgaatttgagggacaagttatagatgataaggtagctctagagttggaaggagaaataattcggcaaaagatttttgaaccaactaaggcgaccctaggtacatatatgaaggaatacaataaaaagtttccttttgttgctgctgatcaatccaaagaggctgctgctaaggtcgaagaaatatatgatcagtgggaaaacggtgcacctgggagtgttcctctagaaaaaataatatatctgttggaaaatacaatcacagcccataaagatcgtgggtggaaaggtggttgggaatccagaattcatacccaatttaactttttaaatgagcttggttttgttcgagttgtcaaaggggaaaagatagttatttcgaaaaatgggaaattaatgattcatgaatattcaaatggatatccaatcgaagatagctatgatgaatcatttgaacagtcagcgttcttgaacgcgttttcgaaatatcaagttaacaatccgtatagaagcaatactatcgaggtaaactttttcccattggtattgaatgtaataaattatttggatgaaaaataccaacgtcccggtatctcgaaacaagatctaccatttattattacttggggaaacgatgactatcaaacattagcagaatatatttaccagttcagaaataagtttagctatagcacttcagatgaattggtttatgaatatgctatgaatctattagatgattctacgccaaatgatactattgcaccagcgactaaagctttcatagagcagaaaaagagagattataaatttgataagatcatttcggaaactccagacgaagttattcgaaagctcagattgaccatgttaatttctttgcgtggagcgggacgttttattgatattaataaaaatgaattagcaaaaatcaagcatgttctcgctacctatagctcaaatatcgagtttgacgatgatgttcaaaaataccttgaatacatgggagagattgataattcccttatgttcgtgtcggatgctccagaatcacaagaagccaaggatgctaaagaagttacaatagaaaaatgggcaaaagagtatgattggacgttcttaaaagaagaaatggttaatagtgttgaaaaacgtccttcaagtcatttaatcttaaaatatgtgaaggaaaccgctagattggaattcctttcagctattgtaattaaaaaagccttaccaaaattgaaggttgtagccaattataaagcagatgatcagggaataccatttaacaccgcatctggtgggaagaagaaccaaattggtgcggatattgatgttttcgaagaaaacattcacgctattttagagccaaccatttctaaacaaagaagtttccaagttgaacatgaactcccttcgattcgtaatcacgtactaggtattgcaaataaagatgttgaagaaggtaataattttaaagaatggttcagcttgtttattgcatccaacataacgcgtgatgttggggatcaagtagcattgattaaacagactaatggtgtcgaaatttatccttgggatatcaaagatttcgttgaatactctgaaggtgttagcactataagagattataaaaaaatcagggattatgtaaaaccacaaagcatgcctgttttttaggttgaataaagaaaattagtgtctactcacacctatttagaggctgtgagtagacgcttttttactataagaaagggttagctgcgtttgatttgatattagagagtactttatcgatatccgatataagattaataggagctacatagtagtcaccagtgagactcccatgttttgtaaatgtactattttttgttagtggtttgtgataattcatgttaattagtttttgtccgtccatgaatccaattaagtaaaagggctcatctttggtaatgaaacgatttttcacatcatacttcctaccctcgaacaaaacacgaacataggcgtctttgggtggctcatattgtgttttataagattgttggtagtaaggccccaacacatcaaaatatgttttttgggtacgccgctctacgttaaacaagccgaaccgaagacctttatttacgaatgatgatctaacctcgagtgttagcgaatgaccaagataattccacaataaatcaatttgattggcagtattattgacggcaggtctcgttgcagagttggggatgatttgatttaagaaatctaaggtggcaaactccgctaggattcctgcataagcatcgttaagtttcgtcatttggtcccttacattaccactgtttgcagcgccattattagcatttgatgcaagggcctcggcatcacgaataattgttttttgtgtttgaacaccgaaatcagaaaatcgaaattcgcaaatcacatagactctttgcaccccattactagttggatttattggttctgttgcaaagttttccctatgattatttcgtgggcaaaccctcacaaaacatgaaaggcaaaaattttttgactgtatttcaggcattgaatctcatgattgcgttcgcgaccttgatgattcttgtcataaatacgaataacaaaaaatgaccgttcagcttagcagagctattggtcattgattaactagtatttgctaccgttcttaaaacggctacattggacttgtgtcgagcaagtcctttttctttacctttattttatcacaacttcttttttttgtcacttcttcaagtaaaaatcagattactatgtctatttactagttaaataactaaagagtcaatattttctttttttgatataggcattttcagccttattaaagcctatttttggataataatccattgcagtatctgaagctaataaaattaaagatacttcatctccaagttctttttctacatgttcaatcagtgttgctccaacttttctactttgatagtctctatgcacagctaaatctgacaaataacaacaataactgaaatctgtcacacagcgagcgataccaattagttggtcttcattccatgctgtgtagattaaatctgaatttaaaatcatttctttgattctagaaggttgactaaatggtcgaacaattccagatgattcaaacaatctaatcacatcaattgtattcaactcagttctttttccatatgttatcatactggtctctccttttttgtcacttgttctagccataataaaaatctgttctcggaattgtaagaggaggacagattgtaaatagaaaggtatatattttaggggtaactaaaatataaaaatattatatcataattaaaaagaatattgttcaaaatttagaaaaaaaattatattctgacgaatcgtgttttaagttcagaatatactttttgcttttgtttaagacactttaaaaatagcataatattttatatcaacaactaaaatcacttgcaatttataagcgcttttttgattaaaaatatcctcatactctcataaagttgccataaaaatcgttttttatggtttttaaaacttttgaaaaactaaaccgcttaaccatgcgttttatgacgattataagttttggaataacaaaaatttttccaaaacttattatttctagagtgaaaatcattaaattcccttttaaaaaattttttttataatgagaaatctctttcagtcagaagtaaattttactatggagattttaaaattaatgactgagatttttgatggaaatatttatttaaaactgaactcaaaaattattttcgaacaatattgttcattttgtgtttaaatatttgattgtagtccaattgtaagtatatataatgagttacgaagaaaaaaaaaaaatagagtatatttttcaaactagaaagacaaaaagcaccttttgaaaggcgcttttctaattcaatcgttttcataaacaataagttcagtacactccccttgttttaaatagatttttgttttaacgcaatttgaagtccggttgaaactcgtgcatatccgatattcatttttttccttcattttaatttattgtatcataacttagaaatgtgtatataaataaacatagaataaattacgggttaatgaacaagaaatgtaaatgatttttgagagtttttataacaaaagaagagtgtccataaaatgaccattttctgaacacaatataaaaaaagaaaaacaattattaacgcttttcttttttatgtctaattatttgataatagtccatacgtttgttactctaaaaactagacttaacgtcaatcattagtgtaagattttattattattaaaataccaggagataaacatgaggaataatgttgagaagaaaaaaataaaaaaacaaaacgtgatgcagaaatatgatttgataactaaagaacctatttttcaaaaatttaaaacaaataacaaacaactttataaacaaaatattgatttaagaaatgctgttttgagaaaaccactaaaaaagttaattacatcagatgaaatgatggttgagcaaaacaatcagttttacggtattacgattaatgatactttagtcgcaacattttcaagttatccaaaagattctgatatggttcgattagtatcctttgctgttgatgctcaacatcaacaacagggactgggatcgcgtttgttaagctgggcaattgatgattttcgtaagcaaggatattatcgagtgagcttgtcagcacgggcttcggctcacaatttttatttgaaacaaggatttaaagatactagagaaccacaaataaatcactatctgaatgtagtagactttgaaatgcagtatattattccaacacggaactaaaatgtgaggacataaattttaactaattaaagcaaatctaccaatattgttaaaagtgatttaattagttagttctattcacggataatctacatggttctgttgcaaagttttccaaaaaatctattttagttcaaattgaagaaaaaatacagatagctgagatagataagttatcttaaaactacaaattctgttatatttcaaaaagaaaagcatttatataaatgctttattttttataaatttgtaaaaaacagcccctataattatatattttaagtataagggctgtttttgcttaatttcttaggggttattatataattatagaccctaaacaaacatcttttgtaaaaagccttttttctgttctttcaacaaatctaacttacgttgatgaagagcgatagtttcatctaattgttggaagaatgagcctattttttgttgctcttctaattttggaatatttaaaatcatattttgtaatttatttaaatacatatatgttcgagaaccaccttgtttttgcaaaagagaaaaacgtctaaattcagatccttcgttcaactgatattgtaaatatttagagtttaattgctcatttgtggtgaaaacaggatataaagtactaacaataccatagtcagctagatcgtttatattaaatttaaaaacaagatcatctgacatatgcctatatgtgaagtatcccctgggaacaatgttatatccgatattgtcttcggatgcaatttgattccctttatagtaatccttctgaaaaaataatccattcctagaggaggtgaaaacaggatattgattattctgtttagttttttcactatactgaatgatataatcacccaacttatgctcttcccaatcgtcagcaaaccccgcaaatctcaattcaggaatttttgaaccatttttggggaacattttttgtaagtaaccttttttctgttctttcaacaaatctaacttacgttgatgaagagcgatagtgtcgtctaatcgttcaaagaacatccctatcttattttgttcaatggtactagggatactaatatctgtatctaaaatgtttttattatatagccgtttaatcgtacttccttctaatccttgccacttaacaatcgaataaaactgctttaaaaacttattattcaagcgatcatcatgctttaaccaaactatattgctatcttgaaaatattcatcttccccttgatatacaacagttctacctatgcttccagaagcagatattaaaatatcccctatttctggatatggatatttcaatttatattcttcaaacaattcacgagagataaaagcatctggtttgcttccaaaagtaccgattttaaaaaatgggacttcttcgttttctgaagtttgatctttgaaaatccttctattcatcgctacagaacctaattcccctaacttacgttcttcccaatcatccgtaaatcctttaaatcgcaattctggaactttctttttaactgaatcatctattttcgccatagtccccaccattttcttggtttttcttgttcttctatccttttttgaactttgatttgttcctgcaaattttccaacttctctttaagagcgttcacttcatctttatattgattgtctaagtgtttgaattctgtctcctgtgaaggcattttaagggcttttaagctatcattctctgccttgtattcttccagtagctttttatcctgcaaggctaggcgctgttgttggtctaaaagattttgagtttgtttttgtacgtctactaaactttttatctgttcgtctttaacagatatttgattatctttattctttatttgctcttttagataattgattcgttcatttttttcatcaattaaacttgtatttacggtgtctaatttggtatctaaatactgtctattttggacaccaacactatctaatttagttttagggacatatccaatattgcctttaatcacttttatagcagcgttgttaagatagatagtaccgtctaatctttgtatcaaattactatctaatttagatacttgataatgaattttcttttttgatacacccaactcatccgcaagctctttgatcgtttttagattctcactcatgacaaatcctcactattaactttataggtggtttttaccatgtaagctccgtatcccattttaattaaaccatcaataataaaaatggtttctatttggtttgaataaaaacatagtcctaaaatagtgttaactgtcaataaaaccacgaaaattacttgggcttgccactttttattttcattagcaggaatgaaaaataaaaagtgcagacctacaaaaaataatatcaatatccataaaatatttaagttgccaagtaattttaaacctatcaaaatactaaaccaacatgttattcctagaaacacaaatgctctatttacccatttcttattttcagtagacctgttgccttttcttatttttttcattaaaaaaagttgaataataatagctataacatatatagatccaaatagtattggctttttatagttacctcctaacaaagtaaacatcgccataccaattacaaaaataaatcctcctgaaattgtttgattagtcattttatctttcatttcaaacctctccttacaaattttgacgttttacagttggcaagtattgatcaatcgcctttttaagatacttggcaatgttcctttttgagtaaggttcttgcttatcatgaacatacgagaggtgtttttttactccctcaaatccccttaattctttgagttcatcatattttggataaacatttttctgtaagccaaccatgattgaccgatctgtcatttcataaggcgataaaagaaaattttcaagcaataacttagtatatttactctccattgctcttgcagatagtaataattcttgttcttctttttcgactattgattccttgtatgtcttgtcctctagcttataactgttatcgtctgctcgacgttttttcgtgatatgaaagacaatagagtcaattgaacgtccttttttaatcttgtcataggtcacattaaagtgtgtatgagcgttgatttctttcaacgaattttgcaaaacgtaactttcaaattttgtaaaacgttcataaagatttaaagtatctgttattgttcttaattctttcactggaatagatggattgcggtaggcttccacttgctccgctcgccgtccgcctttaacactgtaatgctcgtattggttatattgcatagataaccatttgtagaggataatggagtatttgctgtttaattctacaaggtcagataaagcgtattgcgtgaaagattgttttaagtcaatcaaatagggcataatcgcttggtcaaaacgaatcagcactttatcgtcatagtccgtccatgctacttctggtattggcaaaattcttctaaacttaaatcctttatttttttcttctcttacttcaaaaaaagcttgttcttgcatttttgctatcgcttctttaaaacgactgtgtttattgctatcgtccaccttaaaaaaagaaaagagttcggcttttgaaagataaatggtattgttttttggtggattttccgtatcaatgcacgataccgccaattcaaaaatctttaagggcgttttatccatttttgctacggatgttatcaagtcattatgttcaacaatttttcgtttctcaatttctttcaaagaacacactgtcctttcattgctgtttcggtctttttttgttataatttccatgagaagttgctccttatgagtaattttggttaagcatagagaaactgattttgccgtcgatttctctatgcttttattatatcacaacacaacacaatttcatgttttttttgggctatatacatagtttttttgggctatatacatagtttttttgggctatatacatagtttttttgggctatttaatttctataaatggcgttaccattgacttttcccccacgcaaaagaataaaagattaaaatatataagataaatatataataggcttcgcctattttttatttttttcaaaaatttaaaaccaaaggtcaaagtcatcaaaaaaaggagtgagcgaaaacctcgctcacattttacttgcagcattcacttcgttcactcgctaaaagaaaagatcaaaaccacttttaggaatttattggattccctctaattgctcatataagctgttttaactgtttgactagctaaatactcatatcatgcaatcaagcgtcttacagacggtcagggcaagccctaacaacccttaaatggaaaaccgatactttgtttaacttgtttttttacaacttacaacaagctattcaattcaaaatcaatttaaacccacttaaaagctcgtttaagcattcttaatgctccctttgaacaaatagacagtttcgaattaaagtcgcttaaatcgaattttagaacgttttaaaatagaatgatgaaaaactaaaaagtttcaaacgctggtcggcttgtttcgtaaaaaaagagtgcaatgcgcacttacacatccctctaaaaacgagtgatgtaatggctaaaaatcgtgtatcagaagttgcttatcgcaacaacaaaatttcatgatagtagcatctcttaaatgagtgagtctttgtttaaatttgtgatacatttttctgatccatcaagaacttcctcaaagataaaatgcctcagcgctcattcctcaatcgccctttgtcattgattttgtaataagcattgcgccctattcggttacaatcctcacaacaaaatagaaaatataaacccataaatactgcaagctatcacattgtaatacaaattacttcgttcttgtattacaatgtggcttgaaaagggggaagtttcactttccccttttatcccctttggattgtgtcgatttgctttacgcaaacgccacctacccattttataaaaataaaatgggcaaaagatctttctttttgtcatacaaaaagaagaaaaagagggacgattttcttcttccgaaatcgtccctctttttggatgaacgaacaaaaaatctctcgtattttgtttgttcatccactaaaaatatgcgaacagtatggcttcattcaattctgttcttacaagtcaaaagcatcgaatcgtccttggacgattcaacaaaaaaagtagtcgtttttggacgactactaagttctaaacattcattacccaaaatcaatttggtctaacatcgtttctcgactagcttgatctaatccaagatacgttaaggtcatggcttcacttgaatggtttaataaatgcatcactaaaccaatattatagtttgactgggtatagacctgataagcgcctgttttacgcatggtatgcgttcctagatagttaattcctacttattgtcggcggagctggacgcttctttcacaacctctatcctcgatctttttggtcatacacttctttgacgttgataaattgatcaagtattggattttctccttttaggtcagcttcgaaacggataccgtcaatattgattctggcgttacggtagtagtcagttcctagttgtccccatgcaggagttgaggcatcgacattgcagaagatatcaaatccttgttgtttcaagtaagcaaatttttgatttgcttcagaataaggttgccaatcgctgatgtcagcgccaaatgggtagatcaaaatatttgttttgcctaaaataggtgcaacttcattttgccaacgttcattatcttgttggatatcggctaaagaagcttgtgtcatattcaagtgtccccaagtatgagaagcaaaactccaaccatctttctttaattgatcagcaacttttttggctgcttcgatttctttgtttgttttttcgttatcaccatattctgattttgatgtacggtaacctaatacaccattatagcctgttaaagctaatgttcctttggcgccttgataagaaaaatcgggatgttttttaatgaatgaatcgatcaatggaaccatatcatagtcaccaacagtttccttcttattgtcgatataaatattcttgatttggttctgtttatcgacaatcaacttacttggaaatcctgaattgtccatgtattcataatagctgacatcgtcttgcgaaagaattaacggtttctttccttctggaagagaaacacctgtaaaggtcagttttccatctgttccttttttgactaatccatttagattaacaagaacatagttatttttatataactgatcaatggttttattgaattcggaaatagtgaccatataatccttatacccttgtgcttgctgggtatgaaaagccttagctggatcaacaatcagactatgaaagaagacgtgtgagattttggtcgggtcttcccattttaccaaggattctttttcttttttcaaagttgctaacaattgttgcgcttctttggcgtcgtctttttcaagtaaggcgatggcttcatcataatgataacttgcagcaagctgttttgcttgatcaagctgtttcgtcgtttgtttatcttcaacaggttttgagctgctgcttgagtgttgagttgtttgactagtgttttctaatttattgtttgttactgcttgtgtaacaaaaaagatacttacacctagaataataacagtgcatacagaagtgacagccaatatgattttgtgtgtatgtttcattttatcgtcccctactactttttgatttcaaaaacccccgtaagcttttcttaaccttttgaaaaacttcccataaccattgtaacgaatatagggttccgttgcaaagttttaaatctactatcaaataaggtagaatggttctgttgcaaagttttctgataagtctattttagtataaaatgaataaaaatgacagcgagggattttaaaaaaagaaaattgggactccttagagtcccttttaattattttatattatatattttgtcttttgttcttttgcgaaaaaaaaaatatagtgtttgcaaggggtaacaggattatagtcctacaaaaaactgtgcatagtcctacaaaaaactgtgtatagtcctacaaaaaactgtgtatagtcctacaaatcatttgtgtttgtaggtgctttgtgttattatttatttaaatcataaaaggagtggattatgcaagagatagacacaggagaaagaaataaacaaatacaggaaataagttcaaggaaggtggcagagcataacgatttaattagctcagttgcaaaaatggataagacaccattaaaaatgtttgagctagctgtttcatgtatagatactgatgctcctcctaaagataatatagtattcttgtcaaaaaaggaattatttactttttttgatgtttctgataatgataaacatcgtcgttttaaggaagctgttgaaaaaatgcaagaacaagcttttttcagaataaaggagaaaaagaatagagggttcaagtttaaacggatagtacctataccttatgttgagtggaatgattataatgataaagttttgatacgttttgatcaagctattatgccttatctcatagatttaaaaaataattttacgcaatatgccatatcagatattatggaactgaatagcaagtacagtattattttatataaatggttctctatgtcttataatcaatttgagcattaccaatataaacctaatagaacgaagaaacaattggaagattacaagagtcctaggataataattagtgacttaagagaattaacagatactgttgatgactatagtagatttgataattttgaaaaaagagtcataaaagatgcaattaaagaaataaattcttttactcattttaatgttgagtataaaaaaataaaaaaaggacgttcaatcgattcaatacagtttcatatagttaagaaagcaaattggaaagatgagaactataaacgtaatgatgtacaagcacaattaactgaagaacaaaatcaagctcaaaatcaggttaattatgcagtagcagttgcaaatccttttaccatgaaacttataaattcctctttgttgtatgcaactgatatagcaaaccaggacacgattttagagcttgctgagagtgtttatcctgtgtatgataaacttgtaaaagaactcggagaagatgccttagaaacgcatatggactatgtacgaagaaagatggtagattattcaaatgataaaaagaatatcgtaaagtatttaagtatatcagcaaaacaatatcttaattcaaggttgagtaaacagcaaatgaaagagtaaggaagaagttaacacaaaagaaagaaaaaggtcgtgcaaaggtatgacttttttcttgactttatcttacgcaagtgttaagatataggtatgacttaagtaatacctacggaatactaaagtagttgaaagaggagaataaggtatgcaagtaattagttttatggcaattaaaggtggtgtaggaaagactacaatggctttccaatttgcaaaatatttgcaagaaaataataaaagtacattattaattgatttggattcacaaaaaagtttaactggtacatttgagacaaaagattttaattttaaagataaacacaatatttcagaaattctcagcaatccccaaattggaatcattgctactacggttgaaaaaaatattgatgtaattccttcaactagtaatttagaagaaatcgcagataacttggcaactaaacctaataaagaattattgttatttatgtggtttgtaaaaaattcaaaagaactaaatcaaaaatatgattatattattttagacttaccacctgcatggaatttattaaccaaaaatggtgtggcagttgcggataaggtaatatcaccaatggaaccaagtcgttttggatacgaaagtcataccaaggtattacaaagcgtttcaactttaaaaaatgaagttgttgatcctgtcagtggtaaatcatatgttagcgcaaaaatctattttttaggaaatagagttaaacacaatactaattcatctaaagaatttttagaagcgttaaaaagtataaatgatgtaatcggaattgtacctgaaaaagaagctattaatacaagtatgcttcttaaaaagggaatatttgattatttagaagagacagggcaaactcatacacaaaataaattcattgcatcattaaaaaaagtattcaaccaaatagaaacaaaggggatagagtaaaatggcaaacaagtttgaagatatgacctttgataataatgattatcaagtagtaaaaaaaatttcggaagataataacataaatttgggttgggagaaaaaaatcaaaactagtttttcaataaaaaaaagtaattcagaaaaactagatgaattagtaaaaaaatttaatgctaaatcaaggtcagtaattattgacatgctaattgaaaaaagtgaactataaaaagtattactaaagtaatacttttatcttgctaaggtgtgcctttggtatttaattggtaagaacatgatagtacctcataggttattctttgaattatgaaagaggtttaaatagatgatagtttaaaagagttagaagaatagtttattaatttaagtaggtagtaaacgaagagtaatagcatttataatcaaagatgatgttaagaaaaaaggtattactttacgaatacttttctcttgataaagtaatactgctttagggaaaacaggcaaaaaagactagcaattttgcaactagtcttgtcatagatcagattttacttttattttatatttaagaaatatttataatctgttcaatggatataaggtaaattttatctgttgattttattctcaaacgaagaagtagataacatttctcagattatggaaagcaacacaaattacgtagtgcttccaatacaaggatgcactactacactgtttattactatttttaaaaaatttccacatatagatataattcatatagctggacatactgataattcaagaagaaatgttatgctaaaatttgtggactcaaatatgaggtttgaagcattcaagagagctactcattcacatcaatattctcttgcagtacttaattgttgttcaacattcgaatttgcattaggaaataaaatacctaatgcatcaacctgtattcttcatcaagacttagtccttagagatgttgcatataactttatggaatgcttttttcaaacgtttgagcatactaaagatgttcatccctcttgggattatgcggttcaaaattcaaatgaaaatcctccaagatattattgtattcttcctaatttgaatagttgacgtacgcaaagacaaaaaaatataagtttcaggaaaagttgtctttttcggatagatatatactataaatattggtgaaaaattttctttattcctgaatatattcaataattgtcgattgccgcccaacaactactatcacatcattctctctaaaatgctcctctggctcagggacaacatttacagaaccactgttctttattgcaataatatttaatcctaattttcttcgaaggttgagttccgttaatgagttaccaatccagtgctttgggacgtccatctctataatagaataatcttggttcaactctaaatatgatttcattgaataacccgtatgatatttcagggaaagtttttctgcaagctctttttctggatatataatttcgtcagctcctatttttttcaaaagatctgactgtaaatcacttccggtttttaccacagtgtaccttgctcccaatttttttaaaagcatggttattgttatagaagcttcaaaattctcaccgatcgtgacaaaacaaatatcaaaatctgtaatacctaaagattttaaaacctcttcatttgtacagtctccaataaatatatcatcaattttagttgcaagtttttgactttctgcttcctctttatctacgaccataacttgattaccaagctcttgcatttttaatgctaaataccttccaaacttacccagaccaatgataagtatagattttttagactttttagatttcatattcttctattctccaattctatccaacaatgatttcttctgaaactctacttattggcgcttgttgatttctaccaacaatggcaaaaattaataacatccagcccactcgacctacaaacattaaaactactaaagttattttagacagtgctcctaaattaggagtaataccaagtgtaattcccactgttcctaaagccgagaacacttcaaaaataatttcttccaaagtagaggaattaagagaacttaatatgagagctccaacgcttccaataattaagtaaaaagtaaacattgcgctagcttgtttgattgtattatcggaaaatctccgtttcaatatagaagatgttggtctccgcctcgaattatcaaaagcgctgaaaaacaaaacagcaacagtagtaacttttaaaccacccgctgttgatccggatgaacctccaacaatcattaaaaggatcgttaaaaaaatactagcattggtaagcattggtaaatctacagcattgaaacccgctgttctaggggagatagacaaaaataaactggatagtatttttccctttactcccacctctttaaaaatatgattattttcaataagaaggaataaaatacttccaactaaagtgaaggcaattgaagtaataagcactatttttgtatgcaaagagtattttttaaaatttagtttatagcgtaaaatatcatcccagacaataaaacctaggcctcctaaaaatatcagaatactaactgttaatattactaatgaatcagtactatagggagttaaggagctatattttccaaatcggcccatgaggtcaaatccagcattacaaaatgccgaaattgaatgaaataccccatagtaaattcccgtttttataccaaattctggaataaaacgtattgaaagtaaggctgctccaatggcttctatcattattacgaaaatcgtgatacgctttactaaaaatgagagatttgcggaatgtaaaagtcctgatgattcaaccaatagttgtcgctcatgtaaaccgattttatgtcctaatcccgtagatatactgataataactgtcatgaaaccaatcccaccaacctgaattagacatagaattaccaactgtcccaaaaaagaccaatgagtaaaggtatcataaacagtcaatcctgtgacacatagtgcactaattgaagtaaataagctatcaagtagtggagtccagttacctgttttggatgaaataggcaatgccaataaaatggttcctatcaatcctaatagaataaatcccaaaactattttttgagaataagtcaacgtcttgaaaagcaccatattcctcgatttctaattatatattccttgcactatctttttttattaccattttaattagaaatggagctaatagtgtcgtcaaaataatgacaatgactaattctgaatagatatttttattaatgatagctccacttaatccaatttgtgcaactataagtgacatttctcctcttgataccattcctgtaccaataagaagtgactcacttttttgtaggttacacgccttaccagaataatatgcaggaagaaatttagtcaaaatggctagtaaggtaaataaaataacaataaatggatgttcaaacaaaacatcaaaacttatagaaattgctattgaaacaaagaaaattggaataaaaatgacataaccgattgcagaaacatactcttcaattatctcagaaacttctgtttgactaattgcaatccctgcaaaaaaacttccgattacagctgacataccaactttatcggcaagtaaacttaaacccaagcatattattaatgctgatgtcgtatttttggcataaattggcagtttatttataaatttccaaactttagggataaacttatgtacaaaaaataaaaatacaaaaaataatatttccattgaaaactgcacaattaaatttccttcaccattcttaaagcttttaaacacggaaagaatcaatatagctaaaatatcgtcaacaactgcagcacctagtataatattccccgcttttgttgaaagataaccatactcctgcagtactttaactgtaatagatacagacgttgctgcaaatactataccataaaaaagactagtagagatagatcttcccgaatagaaagcaactattccaaagatagttattggaataataacgcctgataatgcaaccagaattgagggtttcagattttttttaagaacttctaaatcactttcaagtcctgctagaaacattaagaggataactccaatttctgacattacttctatagtatgtcctccattaattaaacccagtactgatggggcaagaattattcctatcaacatctgaccaacaacttccggaatttttaatttctttgaaagcaacgtagctaacatagagaagaaaagtataattgtaatttgaaaaatatcttccatttttgagttccttcgatttctttattgaataatattaattataacatccaggatactgatttttttaaattaatttagaataatattttctattgattaattttatcaaaataattagtttgcttctcagcataaaacctattatcaatattagtttcggaaaaattttaatttttccgaaagttatagatgtctcgttcttccttaactttagccagttgtctttttaattctagaaaatcagctttagagacggagctttcattagatttagagtagaggtctatccatttataaattgttgcaggggccacgtcgtaattaccttttcaaaagagggacaaaatgataaggaagaagattcagaaggaattacagttaagaatacctattcttacactattgccctattaatgaggcaaaatgataatgaggtctcgccagatttaaagctaaagacggtcagccctagtcaaattaatggacgaaatgtgattaatgttaatctgcaaaatccaacgatgacttatatcaatacgatgaacgtaaaagcaacgataagtggtataagtaatacagatataaaatatacttattcaaattcaatgatgcaaatggccccaaatacaagttttgatttacctataccaactagtaatcaaagtgcggctacaagggtatcagaacctctaaaacctgggaaatatcgccttcaacttgtcgttaatgccagaacggatgatcaaggaaaatatgaggtgcaggttgataataaaacgacacgatataagtatcaatggacctttgatcgagagtttacgatttctgatgatcaagctcaaaaactgaatgatagtgacccaaccgttaaaaaagaaaaagactggacatggctattatttatcatcggtatattactacttgtcttattcttcattatcttattatggaaacgtagaaaaaaatctcaaaaggaggaagaagaaaagcaagcacttagagaaaaaatagaagcccaagaaaaaataattgatgatttgaataaaaagtgatccctatttacttcaaaataaaaatccttccattttaaacggaaggttttgttattattatttgattagtgctgatatcattaaagattaaacatttcataggctcataatgaggtcctaaaactccaattcaaaagtaagattagtcagaagtactcttgttttttataagtaagtgcgcgtgccttattagtatggaaattaatgcaccaactaagttcatcaataatagccaaaggacaaactaaaactttgtttgtaagctaataataattttttttggtaaaataattaatagaaatagatttgagaaagatgaacttttgcaaaaaaattatgattatattatttaataaaccttatgatgtactaacaaaatttactgacggagagggtcggaaaactttaaaagattatattaaaataccaaatgtttatgctgctggaagattggataaagatagtgaaggtctacttttactgacagatgatggaaagctcaatcatttactgacagacccaaaatcaaaatcttacaagacttatttggttcaagtggagggagaattttcatcagaagcagcgcaaaagttgcaaaaaggtcttttattaaaagatggaaaaacattgcctgcgaaagtaaaattaattgatgaacctgattggctttgggaacggactccaccaattcgtgaacgaaaggcaattccgacaagctgggttgaaatttcaatcaaagaaggaaaaaatcggcaaattagaagaatgacggcagcggttggctttccgacgcttcgattaattcgttggtcaattggtcaatattcactgggaaatctaaaatctggggaatataaaattattcaaaaataaaaaggaatcattttgtgattcctttttatttagaaagaacgtccgccaccagaaccgtcactgaaattattgttatcagaagaaggacgagggataattcttgtagttataaatgtgttgactaaaatatcttcacgttgatggagttctaaattaccatttcggccgtaatcgtagcgccatacggcatgagcgtctttcatttgataacgacgatagatggtccaaacgaagccaccagctgcaatcaaagaaatgataagagcaatcaaaattgataagggttgaaagctgcgatggaaagttacagctcctgtttcggaattgatagaatactttcttgatgttggaattcctgcttggtaatatttagaaacttggtcaaaaaatccactgacagcctgataataattattgtcagtcaattcgggttggacaatgtctaaggttttttcaattcgacttgaaggcaggtagtatttaagatttcctgttgcccaaatataaactttacgtaagttcatgttaatgaccaaaacgacaccgttgtttttagcgcctactttatcagctagataagtttttgccatttgactagcaggggtagagctatctgtcgtgacaacataaacacccgcttttgtttcattggccaatttctgagcttcttgttcaaggagggttacatttccacctaaaagctgaagattatcttcaagacctgacgagaacgtcgccgctgatgtttttggtgcaatgagtaaaaagaagaagcttaagaaaaataaagaaagaataactaatttttttctcatgatagcaaataccccacaataattccaagaagaagcactagaataaagattccaatggcaactgtccaaagttttttcttatcaatgggtagaagaccggctactttaccagtttgaccattcatcgcgtaataaaagagacggtcattgccagcttctttataagtaaccagccagattgggagtaaaacgtaatcttcatcgatatttttaatctgctgattactttgtaaattactgacagaagtataaccgacaattgttgattccattaatccgtcagcatattgacgaaattcccgttcaacattttctttcatatcagggaactcaatatctcgtttttcagttaaaaagccagaaagatattgatttttaaaaggaatagcagcagtcatatcaaaaggttgaacggcgccaaccattttgtctgacagattttttttcaaggcatttttgattaaatccttaaattttgtctctccgccccgctgaatttcatattgagaatgctcagtgtactcggtatcgccaaccatccaaacgcgtaaattggtggcttgcgccgaaataccgccagataattcagcatcaacagcccaataggggaaataaacgcctgatagattttgaatttgttttttgtcaaaaaaggccttgggaacaaattttttcttgccgacccaatttaaaaattgttcttcagccgcttttctctcaatttgaaaggggagaattttttcgggaagaaatttacccgacaatcgctcggtcagaacaactggattatgacaataatagcaccaagttgaagcagttgtcgcatcagtgacgatttctgcaccacaagatggacagagaaatagtccaatttcttcgtcagtgttttcgtcagctcttctttggtcgctgtcagtaattttttccttttcgtcagtcgtttcatcgttactgacagagctgataggactgtcagtaacttttgctgcctcttgcttggcctcgaaatcagaaacttcttgttccgtaaatcttgaaccacaatattcacagtgaaatttttgatttttgggttcaaaaagcagtgggcctccacaattgggacatttatgtgtaagaacttggctttcgctcatcgttactccttacttttaagttatgaaatctgcttatttagcaggggaaattcagttagaaactaaaagaattttcatcagaaataaattcttaaaaatacgcaaagacaagcagccctaatttagaactactttatcttaaatcattatttacatgtcttagagcgctttggcaacaaaaggcttaccacattcaggacagaatttaggaacaccattcgccaaattaacgaccgctccacactcgttacaagccatatttaattcaggcataacaggagttgctgagggtttcgcttgcccacaatttgaacagaacttaccggtatttttagtattacactcaggacaagtccaagtatcggccttgttctctgcttgggcttgcatttgagcttggttagtttgtgaaaaaccagctagattttgtccacccatattcattcccataaaggcatttgtcgcaccaccagtgtttgaaccagcagcctcaagaccacgagcaacagctccttggacaaaaccttcacggatagaagggtcaccaagcattgcgccttgattacgcatgttaatcaatttttgactgtcatcagtgtaagaaatgctagcgacagcaacggaaacaatttccattcctcgcaactgtttccaatcttcatcaagaacagaggccatgtatttgctgagctccatactttttgaagttaaaaatgaaacccgttcgccctgagcagaatattggttaattgacgtatttaaagccgttaaaaattcagccaaatattggtcattaatttcttgaatttcgacatggtcagcatttttagggatgacgtttgcgtaaaaagcaagagggtcagtgatttttattgaataagttccatgtgtacgcaagaaaagttccgcattgtaaaaattatcaaagtattgtagaggtgtcgctgttccaaatttaatgcctttaatttcttgaagattgacataataaacttcttgtttttgaggagttgttccaccaaatttgaaacggaagaagctttcttgaattgaatcccgcaaatcaccattaaaaagacttggcgcagtgtcgtttttgacagtataatatccaggttcagcggtgtaatcaataattttaccaccatccacaagaatcatcatcatgttttcataaacgtgaacgatagaaccgtcagtaattacgtcttcggttcctttacgattagaaccacgttttgcatcttttcttactttaattcccttagtgaaaactgtttggtctgacatttcatttggctcaatgacctcaagccattggtcagccaacgccccaccgagtgaacctgttgcagctttaataattcccatgtattcttttacaaacaaattcaattcaaaacaaaattttagagaatgaatttgccttcctttcctttagtgaatagctcagctatttgacttaattatatcaaatttctctgacgaaacctatcaattatttgaaaatttactaaaatcagactaaagtcggaatttattgattctctcctgtttctttaaataaatttttatatcataggattaacaagttaaggcttgcattttatcagatttatagatataatagacaagttataactttcgtacagataacataaattatgttgaattatacagaggcgaaattattattttaggataataatttcgtctctttttgtttagttttaggagattttattgcatgaataaaaacaaccatttccacttattgggggcagtgattgctacagggattttgtcattttctggcgttttgattgaaacggcgatgaatgtgactttcccaacgctaattaatgagtttggactttctacttcaaaaatacaatgggtaacgacgatttatctgcttgtgattgctattacgattccgctctcttcttattttaatgagcgattttcagcaagaaaactttttttggtcgctaatcttatctttttagttggggttttgaccaactgtttctcaccaaattttgccatgctattatttggccgacttttacaaggggtgggaactgggattggtttacctctgatgttccacctgattttgactaaagcaccacttcataaaagaggaatgatgatggggattgggactttaacgacttccatcgctccggctattggcccaacttatggaggaattatttctaattcgcttgattggcgttatatctatattttccttttacctttggtggtaatttctttagtgcttggtttggcttgtcttccaagagaaggggcaaaaacgtccaagaaattggcgcttcgcccagttattgcattatcaatcatgttctttgctttcatttcggctctaagtgcagagcatttaatgaccttcgccttactctttattgtaggattggtcggagctttcttgtttgttcgattcaaccgcaaagaaagtttaattgatttaggaattttgcaaaatcaccgatttgtggcgctgatttttagccttttggtatatcaagctttgctattaggtctatcttttgttttaccaagttttattcaagtttctgctggatttagttcatcagtggcgggactttttatgtttcctggagctttgattggtgcagttttagcaccaatttctgggaaagttttggaccaaattggtgccagaaaaccaattacgactggtttgattttagcagcccttggtcttgctttgctcttcgtctttttaccaacaaaaagccttgctttgctcttggtggcacacattgtcttgatgttaggtcttgggatttcatatagtaacttaatgacttgtagcttgagcactttagctactgaccaactttctgatggaaatgctttggtcaatactttgcaacaatttattggtgcggtggcaacggcagttgtcgcaacgacactttcaattttccaaggactcaatggcttcaaagttggaacgagtcatggaacttcaattattttagctctatttttcatcttgattatcgtgagtttaattgtcagtttcccaaatttgaaaaaaattagggccaatcattaaaaaaatctttgacgaatgacacttttttcgttataatattttaaaacctttaactaagtccagagaggcttgcaaggatacggaaaatttaatttggtttactgacagcttaaagatgaacttctctttagcccatttattctgtcagtaaattaccagttttttagtacacttgtaagttctcttacaagtgtttttttgtgtcaattaaagagttgtcagtaaatacgcactttctgtcagtaaaatgcgattaacatgagcattttatcgatgaataaaagaaggttcagcaagctgaactttctgagatttaaatatattaatgtttaaattgcttgactgtttgcataatctatggtattcttatattaaagaaaagcaattaatacgaattagtggatataatttgtacccgtctgtgggctcttgtttagagttaaataatagcagaactaccgtcccttgaggtaagatagggcatatctagcgtgaggtgaaactcaatacgtggaaaagagggatagcccctcttttttttgttaggagaaaagaattatggagtacgatttagagtttcttaaaaatttcgatgggaatattctcccctctcaaattaatatatcagacctggtaaacgttactgagaagcatgtttctcaatttcgttacttttacagtagcgataaatctgaattcccagaaataattattgaatttaaaaacctgcatatccctcatttactcggtttgtcaaaagatcaccatcttaatctttctacctatcaagcaagagaaataattaataatttaaaacgtgactggaatttagagtacttaaaaagtagtgatgaacaatggtttgctgaaaataaagacaagttagtaggggtgcttcttctctatcagctactacatgttcaaaactgtagagtgttaacacctttatacattataaattcaaattttggtcgaagatttaaacgagataatgtatattttgtaattcttagatcaactaataataaagaatacacgatagaactagctccaatgaaaaatcatgacaatgtatttattccaaaaagtttgaagattaatgatactcatgtgcataaatgtagtgaaatcagtctaactttcttgagatctgaaagaataaaatatgataaaaaaagaggaaagggcagaaaataagctctttttttttgaaaaattcagtttatcaaaaccaatttactactttttctgatattttgtgttgaattatacctatttttagagtataatatcacttaaacagatattttgtgtttgatatactactggaggtgcaaatggggatacaaatactaaatagatattttgactactcacttgaacctcatcgagctatcttttttgaagatgttaagtctaattacgcttcaattgaatgtattgaacgtggcttaaatcctctcactacttctctttgtgtaatgagtagggctgataattcaaatggcttgatacttgctgctagtccaactttcaagaaagtatttggaatgtctaatgtcagtcattccaaagaacttccgttcctggtacataaccgtaaatttaactaccatctgtggcacaaaaagcatacagatatttttggacaaacggttgaacctgatccaaaatatattgctgaagttgaacgttgggcaagacaaacttatattgttcctcctcaaatgctgctatatatccaaaagaatttagaagtaatcaatattttgagagaaattacctctatagatgaaatccatgcttactcgatagatgaatcctgtttagatgttaccgaatctttggacttcttctttcctgaaattactgataaatacgaacaaatggataagttagctcaaatgctgcagcgtaaaatttatcatcaaactggcttatacgtaactattggtatgggagataatccattactggctaaacttgcaatggataattatgctaaacataactccaacatgagagcgttgattcgctatgaagatgttccctctaaggtgtggtcaatatcggatatgactgacttttgggggattaatgtaagaactgaagcacgtttaaataaattggggattcattcaataaaagaacttgctcatgctgaccctgatatgttaaagcgtgagttaggagtgattgggcttcaacaattttttcatgctaacggaattgatgaaacacgtttaactgacaagtataaaaggaaatctgtcagtttctcaaatagtcaaaccctacctagagattatacacgtaaatcggaaataggattgataataaatgaaatggctgaacaagttgctgtgagactaagaaaatcaaagaaaaaagcgacaaatttttcgctctttgtgggattttcaatggctgattataaaaagtcactctcagtttctagaaagattgaaccaactagctctactaaagatttacaagaaattgctaccagactttttaatgaaaaatatgatgaaggcgcagttagacggattggggttagtgcaaataatctcatagatgaaccttatcaactcatttcactctttgattctgatgaagaaaacgaagaaacaattaaacaaaaaaaggacgaagctgttcaagaagcacttgactcgattcgtcaaaaatatcactttgtttctgttcaaaaagcaactgttcttaagaaaggttcacgtgcagttgcaagaagcaaaatggtaggaggacactctgcaggtggattggagggcttgaattgagtcgtgttgacaggtcttatagtaaatatgaatcaataagaacgtatgaagatagagggaaaatgaaatggaatccttttgcgactgctgaacttgcttcagctcatcgtgattatcataaagaatttacctttgaagagccagatttttctttggaacaagatgagattcttaccatgatttctttcgcaaagagccttcagcttgaaattaatatagagtaccaggtaggtaagaatttaaaaaatgtagatggaatcattgtagattggaaagataaaacaggaataatcctaaaaaaaatagatggacattatttagaactggaatttagctccatcgttaaattaactgataaacaatattttgattcctacctcaaacaatattgaaaggagaaatcatggaacaacctcaatataattcttataaagtaagaaaattagatgatccagaagaaaagaaattagctattctcaaagcaacacaatcgattgaaaaaaagtttggctctaataccattttgaatgaggaagggaaagcttcacaacatgttcaggcactaccttcaggtattctgtcattagattgcgcaattggtatcggtggttatcctaaaggacgactcattgagctatttggagcagaatcctctggaaaaacaactgtagcgctccaagcagtagctgaaacacaaaaaaacgggggttatgtagcttatattgatgctgaaaactcacttgatatagaatatgctgaaaacctcggtgtcaaatcagatagtctaatatttgctcaacctgatacaggagaagaggctttctatatgattaatgaatttgttagaacaggagcttttgacttaattgtagtggattcagttgcagcactcactcctgcttctgagatagatggtgttaaaatgcctggtcaacaagctaaaatgatgtctgagcaactttcacagttagtaggtaaagttaaccaaacaaagacagtaatcatcttcatcaaccaaatacgctctaccatgagtggcttgttcttaaataaagaaaccaccccaggtggttcggctctaaaattctactcatctgttcgtatcgaagtgaaatctggagaaaaaattaaagatggaatagataccattggtaaaaaaacaacacttcatacagtcaaaaataaggtttcatcgccctataaaaagccaactgttattaatatttttggagacggattttctcaagaaattgatgtcgttacaactgctattcaacttggagtagtaaagaagctaggcgaatggtattcatttaatggacaaaaattaggacgtggaattttcggagtaaaagaatatctctctcatcatccttcggtttttattgcactagataacttaactcgtgaagctttgcaattttcataataaaaggggactaaaattagcccccttttttccatctcaattaacttaacgtcaaagagcaacttcattttttattaaaattgactctaatatatttttttcaatttttctccctctcccaataaacctttttagattttatcaaagctttatttattaatccattataatagtcaactgcctctaaaatagaattctttacttcttgctctgataaacctgtatctttataagcataatcaattgctcttgaacatgttatgatggctcctaaaccattattatcaaacgctgcgtctaatagtttcacatctcctccttgataaccaactcctgggattagaaataaggtttttggtaagagtctcctatacttagttaaatcttcgggatatgttgctccaatgacagctccaatatctgaaaatccataattcccaactttattcgtgcttttaataatataatcacatacaacttcagagatagttttattttcagaatccagtattttatcttgcaattctcctgaagaaggattgcttgttttcactaaaataatagagcccttatcattttcttctcctaattttataaatgggtctaatccatcacttcccaagtatggattaattgttactgcatctacagataaagtagagctccactcatcagctgtattcttataaaaagtttctgcatatgcctgagaagtacttccgatatctcctctcttagcatccgcaataacgataagtctctttttcttagcataatccacagttttccaaaaagcttctattccataataatcatacttctcatagtaagcaagttgaggttttacagctggtactttatctgccactatatcaataatcattttattaaattcaaaaatagcgtagcctgctcctctaggagtctttccatagatgctctctgccttttttaaaatatagctaggaaaattctctaaaatgggatctaacccaacacatagatgagattttgtattgactactttttgtatatatctatcagaaaacatcatttatccattacctcgcttacaaaattagttattatttgatgaactttgtcaatccctaaagttgaatcaacaattaaagcatttttaggtaaaacatcaagaaaattttgtcttacttggttaaatactaactcatttttttcttcatactttatatcttctccatccctttgacgaactctctctaaagcacgctctggaggaacatctaaaaatactgtaacatctggagtaggaacacctttattaatcattagaatttctttgtagtctatcccacgagctttaaagaacgctagtgaactgtataagtatctatcacatataatgttgctttcagatattttggggaaaatttctgaagttatctgataagttctatcagctgcagccaataaagcaatcgaatacatattgggggcaataccattatccaaataatctctaactcttttatcatttctatagtaatctgttggttgttttgttgtaaaaactttaagttttttattttcaaaccattgatgtaacatatcaatttgagttgtttttcctgaaccgtcaagtccttcaaaaactattaataaatttttcatagcattcctccattgatagtattgtaccataacttgaaagcacttatataaattaacatagaataaattacgggttaatgaacaataaatgcaaatgattttaataattttaataagaaaagaagagtgttcagaaaatgaccattttctgaacatctgataaaaaaggaaaaacgattagaacgcttttcttttttatgtctatttatttgataatagtccaaaaacactaaacaggcttttagtgatccttgccttcaatcgtttcgatatcgcctttgccgtcacgggacacgatggccttgatagcggcagtgatgcctaaaacatcatcatccaatgacaacgctggtgtttccggacgagtgacaacctgttccggcaaaaatggaatatgcatgaagccggccttaatatcgggaaacatcttatcccgcatatactgtacctgataaaaaatgtggttgcagacgtaagtgcctgctgtgttggagactgctgacggaacaccagcttcccgaatggctttggccatggccttaattggtaactgggtaaagtaggcattctcgccatcgccatgaatcgtgtgattaagtggctgatacccggcattatcttgaatccgaccgtcatccaagttaatcgcaactcgctccggcgtgagttcaaaccggccaccagcctgaccaatgctcaacacatagtcaggcttttctttggcaatagcatctttaacgacatcggctgaaacattaaactttgtcggaatttccaatttaacgatttgtgccccagcaatttcatccggcaaacgtttcacggcttcaatcgcaggattaattttatcgtcgccaaagggatcaaatccggtaacaagaattttcatgagaagatttcctttctaaaatgccaagaagtacagaagctatcgagaagtgtatcttgtaccatctttaagacgttggagtctttgatgggtaggacaatttgttgcgccatgatttatatatacctttctgaaattaaataattaaaaaaagtgttaaaattcttgtcagagggggaaatcacgatgaaaaactatacggactatttctttgatgagccagcgtttgatctccacgatggcggatacgtgccgcttgaggtcagtgatgcgcctgagaagcccttaaatgtgccgccgttgttgaaaccggataaagagacggcgaccgacgtttattacacggtgacagcagaggctggggaaacgcaactgttacctggggcgaagaccaagacgtggggctataataccagtctgttaggtcagacgattgtgtatcgccgtggtcagcatacgcatgtgacactgaaaaacaccctgcctgagttgaccacttttcattggcatggggctaatgtcagtggcccttatgttgatggcggatgccatgcgccggtttatccgggtgaaagtaagcatatcgacttcacattggaacaacctgcgacgactttgtggctgcatgcgcatccgtgcccatccacagccgagcaggtttggcatggtttggctgccatggtgattgtcaaagacgaccatgaagccagcctgccattgccaaggaactatggcgttgacgatattccggtcattttgcaagaccggtgttttcatgagaacaaccagtgggactaccgggctgattatgatcctgacggtgttgctgggccaactgcaatgattaacggtacaatcaatccctattttgatgtcaccacgcaaaaggtccggttgcgttttctggatggtgctaatcgccgtgaatggcggttgcatttttccgatgacctgccatttacgcaaattggcggggatggctcactgttaccggagccggtcaaatttacccatttgatgctgacttgtgctgagcgtgccgaagtgatcgttgattttggccaataccatgaaggcgacgaggtcaccttatatacggatgatgtgccattgctaaagttccgcattcatgcgttcaaaccggatcagactaccttgcctgataagttgttcgatgtgaaggcaccagtggttgacctggctttgccagttcgccacgttgtgatgcaggggatggacgaaggtgttgcgattgatggtaaaaagtttgccatgcagcggattgatgccacgcaaccaattggcaaagcccagtactgggatgttaccaatagcaatgatgcgcctggaatggttcatccattccatgtgcatggaacccaattcttagtcttgtcgcggaatgggcatgcgccgtatccaaatgaacatggtttcaaagataccgttggcgtgaatcctggtgaaacggttcggctgctggttcgctttgatttgccaggggtttatatgtatcactgccatatcattgagcacgaagatggcggcatgatggcacagattgaaacattcgatccagccaagccaaagcaagaatataaattgatggatatggatacgttaatgatggccttggctaaagaacgtggcgtcaaaccatctgagatttggatgggcggtatgcagtcttatgaaaaaatgggaatgaaaatgtaaacgtcccacaatactaatatagaaaaagatgattttaatatgcactctccaacgatcaaacatcgcggggcttttgtcgccacgttactgacaggtaccttttcgatgtcaatttctcagtcttctttaagcaccgcttatcctgcttttatgaaagcttttggtttaggagcggatacagttgcttggctgacaaccggctttatgttggtgatgaccttgatgattccggttagcccatggctgttgcataatgttactttccgacggcttttccaagcgattgaactcatttttgccattgggacaggcttatgtatctgggcaccgagttttaccgtgctcatgattggccggttgcttgaagcgattgcggtcgggattattttcccgagtttccagaccgtgttgctgacgattacgccgcatagtgagcgtggtcgggtgatgggcacggcgggattggtcatgggctcagccttggcagtcggtccgattatttccggtgttttgctgacatggttcccttggcaggctttattcttgttcttcttggtcgtttcgctgcttgtgctggccgtttcaacggtgaccattgcgtctgtcatgccattgcaaccgacgcaactggactgggtgtccttccttttatccgcaagttttccaattctactttatgccttgggtgctttgtcgaaaaaaggcttaactgttggcgtggttggtttgttgattttaggcgttctggcagctggtattttcgttgttcggcaattgaatcgccaaccaccaatgttgcaaatgcgagtttttgccactggtatgtttactaaagcggtgtttctgaccggaatttcatacgtcggtttgattgtcaccactatcctgatgccgctttactttcaaacgctacttggtttgtcaccgttgatttctggcttgtctttagtgccagctgcggtgttgctgagtattttaaatccaattagcgggcgcctactggatcgctttggaccgcgtgttgtggccatgattggcatgttgttgattactggcggctttggtctgttagcagtctttgcccatcatttaccgctgattggggcaattatgttggcgatggcgactgaagccggcaatgcctttgtgatgatgccttcagtgacggctggcgcgaatgctttgccgaatgagctcgtggcagacggcactgcggttacaacgacggctcgtcagttattcggttctgccggtgtcatgttcgccacagtgttgttggatggcatgcaaaccacgctgcgaagtcatgctggcggttttgctgttaccttcgctgtgtttgctggcgtgggcctgattggcttgctgttggcgttgacgttaccaaaggaagtcgcgaagaaagcggtatagctgcgaattcgtgatttgcatctacaaaaatgatcgcctaccaggttctgttgcaaagtttaaaaatcaaatacaaggtttataatccttgtatttgatttttaaactttgcaacagaacctatgatatactatttatgtacacaaatattagtttttaaggagagaagaaaatgaaaaaaatctattgaattttcagacaataaagaaaggaaggaaataaatgattgttgaagcagtagaaacattagatggatggtattcacttcatctcacgtatcaaatggattgggcagcttggaatcaagtagcacaaccaaaaaaacaagcggttgtagcggaattaatcgcattgttgactgaatgggaggaaattgaacaagccaaaaaagggagtcattatgtctggaatgtgactggtcataaaggcgatattggtttttttgttttacgtccggaattaaaagatgtaaatgctgaagaaaatcgttggcatcagctagcattatttgattacttaacaccgttacatagctatgtatcagtgattgagctgggaacatatagtgggaaaccgacaacagaaaaagccatggagagaacgacgcaacatctttatccaaaattaccaaaggatgacgaatatatttgcttttatcctatgaataaagttcgttcgggtgatattaattggtataccttgccttatgaaaaacggcgagaattaatgaaagaacacggtatgattggtcgtaaatatgcggggaaaattcatcaatttattaccggatcgattgggttagatgatcatgaatggggagtaaccttatttgcaaatgatccattagagtttaaaaaaattatttatgaaatgcgtttttctgaagcaagtagtgtttattcggattttccttattttatcgtgggcgtatcattaaatagccaagaaaaaataacaaattatttcaagtaagaatagaggagtctttatagtggatgtaccagtaagtcagtcgaaaaacagaatcaatttattattactgattagtttatttattacgcaacttgattcaggtatcatgagtacgaatttgtcttctatttcacgtacctttgcgctcagtcctcaagagaaaagctgggtggtagcagtttataccttaggtttactttttgcgacgcccattatggggagttttattgatcggtttggataccgtactgtttttttaatggaattaggcttttattttataggagttgtggggattgcgactagttcatcattcacggcattattagtagcacgtattattcaatcatttggcagtagctctattttgacactcgcattatctcgagtatttatgatacatacacataaagttagtggcaaagtaggaaatgttggagctttagtcgcattggctacgattgtggccccaattatcagtgttgtcagtttggctaaaacacaggattggcgcgctatttatcttgtattagcggcaatgattttccttattttccttgtggcatgggtcatgataccaaaagaaattttatcgagcacggaaacatttgacgtaaagggcaacaccctctttgtcttggccttagttgcgtttaatttattgttaagccgattatttattagtggtaatttagtcgaattacttgcttatggaattctattttgtcttacgattggtagttttttagtgattgaagcacgccgcgaagcaaatcaagaaaaagtagtattttcgcgtaaattatggacgatagcgaaatatcggatgagtttaattggagggattgtaacggggttaagtatgtctttatttgcgtttttcccatcgatgattgaagtgacatttcaattaaacgcgcgtaaagcgggctcatttatgacgattatggccattggaacattaattggctcaaaattagcaggttattggactgggaaaaaaagtgcgtatcatgccactcgcgatagtatgattgcagtgattatcagcttaattatcctgtatttctcggttgcttccttaccactttttttaatggcactatttttatttggtattgcaatcgggatgattatgaccgtaccgttacaggtcttaattgtggaagcttcaccgcaagatcggaatacttccttaagtcttttatctgttagtaaaaaattagggatgacaataggcattacattaatgagtatttttgctcatttcacacaagcaactggtgttcattcaatgattttagtcttaatggtgctaacaatcgcttttgtgtggacaattcgacataaggagtagggaagatggaaaaacaagctgttttattaatgagttatggtacaccaaatcgcacagaagaaatttgggattattatacccatattcgtcatggaaaagaaccttcacaagcattatatgatgaattagtggggcgttatgaagaaattggtggtgtttcaccattggcgcatattacagaagcccaacgagcagcgattgaagaaaaattaaatgaatcaggaactggtgagtatcaggtttttaatggattacgccatattcatccatttatcgaagaaactttaacagaaattttaaatcaaggttttacaagcattcatggcttagtattggcacctcatcgttcaacattcatcgatcaatatcatgagcgagtggaagctaaattgcaaacacatccagaggtaacctatcatccacactatcatttttggcaagcaacaggtttcttaactttttggtctgaccaaattcaagcagccttgcatcctacccgcaaacaaaaatttttgtttacagcacatagtttacccgagcgtctattagcaaacggagatccgtatgtggatgaaattaaagaggcagcacaagccattgtgaatcaagtggaaggcactgttgattttgctaatgcttggcaaagtgtcggtcgaacagctgataaatggattggaccgaatgtggaagatgtaacagaagcattagtaacgcaagaaaattatgaagaaattatttatttaccttttggttttgtagcagataatttagaaaccttatatgacaatgatattgagtgtaaggagcaagttgaagctttaggcggtcactataaacggctagcaatgccgaatgttcaccctgactttattgcaggtgtggtgagcgaattgttgtcatccaatgagtagtaagtgaaaaagttatcttgacagatttttttaaaagcgttaagataatggcgaattgaatagtattcttcggggcagggtgtaattcccgaccagcggtgacaagttgtaacttgaagtccgtgacccggattcgtgcggtggagccagtgtgaatctggcaccgacagttaagcagtgattcctacaaatgttaatactgaaagtgataatatggcaatacccaattttttcttacgcataacacttctcctttttaaataaagtaatgaacaacatctaaatacatattttgcaacgattatacaaataattgaagctatcattcatggcaatctcatgattatgaaaaatacttaccgattttattatttctataacttaatcataacataaaatgtcttatacgtatagaaaatttggaaaaattagaatataataaacatacagaacattcaatctcgctactttaaattctcatccagcttgcaagtatttaagaaaatgctatatacgataatctgcttatctaataagcttcttcttttttctcatcctaagtaaaaccatcccattattctcaaaatacatcaaaacatctaatgtcttgaaaataataggccacttataattaaatagtaatcctttattctataatattttacacacatcttattgttggttagttttctggttaatttttgacattgtaatcttcaaaatcccttataaaaaggattgctagtctttttgtcagttttttgatagaatggcgtaaaaaatcttatggtgaaggtctattagcttcaatacgctctttttcgctgtttttatcccaccttctatttcacataaaggtcagtaaatatccattaaataattattttgagttagtttttttgttgactttccattctaatagctcattttgcgtctaattatttggcattattacaataaaaaagagcttgataaaatcaaactctatattagttagtgctgttctttttttacagtttgtttttttagtcgcttatattctttttcgacatcaactttaattttactttgttcttgtttaaaactactttgtaattgttcaatttctttatagaaattatcattacttgctggaactggggctggtgtaattacactcatattaactccttcactattaaatatgttctctatttttcatactctaaaaactctcccacttgaccatgttgtatattcatattactaacttccaattgaagtttataatatttctttacatcattattttggagtccatttttttgagaattatataactttaaaagatcgtcagaatcttttactatatatttaggaactgaggagtaatttctcattccttccaaagcctgaattgatactgtaatactatcatttaaaaacttctccatcgctttaatattatatttatagaaaagccaactaatacaataagttagggaccagaggaattaataaatacaacttcttaagtaacaaatagttctctttctacactaaaatcaatcttttatcagataactaatagcatccttattctgttttttttaatcttttcttcacaatcattcgaaaacaaccacatctttggtacggtgctagtctttgaaatgcttgttttgtctagtctagttatcttttttctttgtttttaataaatttgaaaaacaaaggaactttacaagaggagcttcatttttaactgaacagtaccaaaaccaataaagtatcgtcgtagtaattatgatttaaactgccataatccaaaacaaatgattgttcacgatgaagtgtttgccatctttggctaattgaagaagcataaaatattggagctgaaatactagttgattgaaatttattgagtggtttaccagacatagtataaccaccacttattttttgaagagaactaaaaaatttcatcatttctgtcaatacttgtttttctttactacttttatttttgttaattgctaaattatatgggactcgaaatgcattgtagtaataatcgtcatcatgtttatttaattttaggtttttatcctgagataaagaatgtactttatttccgttcgtcacttggataaagtctggaactaaaccaactttgcttttatgactagcttgataaaggctatcaagcattttagttttaattagcctccattgtgaattatttgaaaacttataaaatttatcaaaaaaggaaggtaaaacatcagaggttctcatcaaattttgatactttgatgaagcatttgcccaattacccactgtcaaaatattgttattgtgattaacattatatgttaaaatatcattcaaaatttgttttgcagtagttttataaagaggtttatgctgtgaccatttttcagaggctaaaattaatgcataagcaatatataaatcaccatcggtggcattattatttaaatcagtttgtttttgtgtcttgcttccattaatataacgccaagacataagacttgttccctttattcgatgatgagtgtagtaagtaaaaaaatcatgaaattgactttctgaagccttatcttgattattcaatacagaaattaacatgccatatccctgagcttcagacaaagcaatgcgatttttactattagctgaagtattgacataacttccttgagaagttttaacaatatacttatattgccattgattataaatttgttgtttattgtgttgtgagctttcttcttttatatacatcacagaaaaaataaaaagtaatataacaataaaaaaccaaacaaacgataaaattcttttagacatctatacttcctttaatcaccaaatctttttgttttgtaccattttgtaccatctctatgtaaaatatggtccaaaagcacagacaccacagatacaacagaaacaacaataaatagttgagcatatgttacatatgatatcagtgcaactgacagattctttaccgttagttgtccaaattggctcgcgagcgctatattgatttgcaatagataaataccaaccatcaaaaaccaatttatcatcaataaattcgcaagttcaatgttattactaccaattgtaaataaaatatgggtacttggattaaacatactgattccccaagtcactatgttagccacaaaaataatatcagaaatgacgattgcagcattaaaccaaaaaaatgtactaatataatagaatacttcccactttattcgccaaacgctcctatcaaataaatgtttgaaattatccaagatcacctgataattcccctttgcccaacgtttgcgttggtggtaataagctgacactgtctccggttcttgttggaaagcttctgaattgtgtgccaaagcaattagcttcccactttgcattattttgaacgagatggctgtatcctcagtcaatgctccattatcccaaccaccaatatgtttaacaaaatcagttttgatgataaaatttgtaccagggattcgaccaattttgaataggtgccataaacctacatgatgaattctttgtgtattaacaatttccaagttaatacaccttgttaaaaaattctgtttataatttctggtcttatttctaccaaaaacggccccatacttctcaggattttccaaagctttctctactaaaaagtgaagtgcatttttttcaggcatcgcatcggcatcatacacacaaatccactcacctgtggcaatacttagagcatcattcagtacacctgccttaccacccgttccggttctttgaataacttgagcactaatatgtttatacttttctaatgacacaacacttattatttgattatatgtgtcatcttgacaattatccgcatataacagtaattctaactgtgtcttaggataatttaaattcattatggattcaatagtttgagcaatcacaacctcttcgttgtgagcagggaccacgatagtaattttaggataagttgctaatctaaagactttttgacgttctttcttaatagtggttaaccaaaaatgggttgcgctaaataggatcatcagtcccaaaccagtagctatccaaatggatataattgctaatatcataattgtttggataaaattcattcattcgccctccactttaaaagtgtcaatcactttgtaataaattatccataagcaaacgaagaggataacgaaacttgtaaaaaatatgcctgtcactaaccatgaaatcagtacgaaattgctttctgtcattttttaatccttataataagtattcatcaattaaatccgtttctagatttctataaagctttttcaatacatcatcaaaatttaaagggtgctgttgatctagctttatactcgcaaattgataacgtagttcatgtttttttccgttaagcataaaatatatgtcattaagttgtttgcgagtctcaacatttaatgcattaacctcgtcttcttccattcttagactcacaataataaattcattattatcaaaagtaaaaatacgctcactaggaagacgtttatcttttagtaacaccgagatatctgaaagaactttaaacagttgattttgatctgcatactctcgttgttcatagtatggaagtgagattaaggttaacaccacaagttgctcactatcagaaaattgtgtgacaattttgtcataatattttctaagtgatacttgggtaggtgttttagtaatcaaatttttcttttccattttacgcataatcaattttcgattgttaatcaatatactacgactcaaaattcgtatacgaattaatgagctcatagtagcgaaaaaaggaaatataacaagtaataaagttttgactataccgttgacttgcgaaccaatattcaaaacaaatgcaataccaataaatgtaacaatcgttactaaccacactaaaataatacgatcaataaaaaaaccagttataatactaatcaaaattataactgttattggaatcattagatatttatctagaaaaccaacaagagttgttattgctaaaataaaaacaataaacaaaagaattgtaacttctaatgtcaatgatctaattttatgtttcatttataaattacctactaaactattggaagtgatgataaataatatctaaaatccgttcagacgctctaccatcaccataaggatttttagcacttgccatcccttgataaatattttcatcatcgagtaataaacgcatgttttcttcaacaatgtcagactgattaccaattaatttcagagtaccagccgctacaccttctggtcgttctgtattttctcgtaaaactaaaaccggcctccctagagacggtgcttcttcttgcacaccaccagagtctgtcataatgaaaaaactacgagctgcaatattttgaaaatcaaccgtatttagcggtggtagtaaatgcactctatcaatatcatcaaagtattgatgggcaacctcttgtacctttggactcagatggactgggaaaataacttcaacatcactatactgattaactacatttttgactgcactaaaaactgaatccataccactttcttggttttctcgtcgatgcattgttagcataataatgcgatgtccttcagttaccttatctagtacactgtgattatattctttatgaacggtgtactttagagcatcgattgaagtattaccagttacaaaaatgttatttctattatgatgttctaaaatcaaattctcttggctttgaatagttggtgcaaaatacaaatccgcgagcgtatcagttaatcttcgattcatttcctctggaaaaggtgagtatttattccaagttcgtaatcctgcttcaacatgaccaataataattttatgataaaatgcactaacacttgcagcgaaagttgtcgctgtatcaccatgaaccaaaacaatgtctggtttatccttttcaaaaatttttcctaatgatttaataacatcaattgttatgcttgataaggtttgttccttcttcatcaaatgtaaatcataatcagggacaattttgaaatcactaagagcttgatccaacatctctctatgctgtccggtcacaacaataatttcttgaaaatgattgttattttccatcgccttaataattggggccattttaattgcttctggtctagttccaaaaataagcattactttaattttcttcttcataatatcctctttgtattatgtaagtctaaataaatttaaaactttttaattggtttttatacatgtttgaaaatgatcactattgataaagtcgctcttagaaagtactcattaaaaaattcaatattcatttgatctttcggatttaccacttgattcaactaaatcatttagaagatggtaaaaaattaatcattcataaatataattgtcttttttcagagggaaactttcatgctaataatcacaatccttacggcaacggaggaactccaaatgattaattttactatttattctaatttaagccactatgattgttgatttagtaatttttgagaaaagacagtgatagtcgaaatataggttttgtgtcaatgtagaatgacacaaaaaaactcaacataacaaataaggttaataaagaatgacgaaatacttttacccaaatttaaaagataaccaaaaagagttattaaatattattgataacataataatcaataatactatctcaaaagaagaaaaaaaactttttgtaatagcaaaaagagatattgaaagagggcgagattttgatgctcaaattagtgaactaatttctagtttgcagtatctggtgcactcttctcctgttctttattttcttgaagagtctcggaagagaatgctagttaatccaggtactggaggttctccgtatgggtggtcaaactttgaaagtaaatagacatcaaatttgagtagtaactggaatttattatagattagtttttacaaaattatgggtatgcccattttattctacaactagaattttataaaaaaagtgcttttgagcactttttatttttcataccccactaactattttttctctctttttcagctaacatcttcttaacaaaattaggcatttcccctctgacagctccgtcagtagacttttttattgatttagccacttgattttcatattcagaagttgttttttcatgaccatctaatcgtttctctcccaccaaattttgaatggatgtaatatcctgcgaaacttctaaacagcccagatattctcctgtttcttcatcacgcattgcaaaatatcggatataaattttcttattaaaacgatgtaaatcaatccaaaaatcagcttgatcgcgtgttccagatttaaaatcttctaggattttttctactaccgccattgattttggcgggtggcaatcaataacacgtcgaccaattacagatttagctcgtggaaaaattcgttctcctcccgagaaaaagcgaacgatatcttctttatcaacaaaacttagatcaactggtaaaacattaaacaaagccgtcaactcattgaggtgtaacatgccagttggcaaaacaaccgctccctcacttgtaactttttcccaatcatattgccgcttaactcttttaggtttgcttacttctaaaccagattccttagcaatagcctctgtcattgctttagcagattcaatcgccgccaatctttgaggttcatgctctttttccttttcaattgactctttagaagctttccattttaaaggttctgcaatgaatgcatagccaatctctttagaatcctcctctatttgttcccaatcttttaaagaaaagacatccaagcacattggaatcataattgcttcttctttaaaaatcatttcttcaatttctgtcagtaaattttctagcatttcacgtaatgggttcaaagctgttttatctgtttttaaataaacaattacttctttaatcatctcacgaacactatcatctacaccccacataacttttggtggcgctgtgattccatattgttccataaaagaaaaaattaaagtttcttttctagcataatgtttgtcaatattatacaaatcaataaccgctacaagtaaacgttctttataagaccaatctcctttttcaatctttgaaaaaacccaccgaatttcgtcatttaatagcgatgtaatcacttgattttcaagtttcattgtatgaataggatgtcctggagtattttcttctaaagatgatttatgaatatctgtaatagcccctttaaagacagctgcatgaacattgcataatttttgaatttcagagggattgagccccccttggatcaatgccttttcagcaccagttatttccgaaacatctacaccatcaaattcttcattaaaaatttttttggcgtcctcaaacgtccccccttcgtgtaagagtgtcaatatttcaacaattcttttttggcgctcaattgtagtcgatttattcatatttgtcattattcttccaccttctactttgaaaactcaaaaccagcctcagcaaaagcaataacaattttatcccaatcgatatgtttcatttttgctcccattggaattgtcgccatccttccagcagtctgtagcattccaggcatttttatctcatgaaagcccaaaccatccattaagtcaataatttcagggtgttctgttgctaaatcataaagtttagcatttatatccagttgaatcattctaatctccttttcaaatgtcaaaattttgtaaaaaaactttgacatcttatcttattctaacaaaatattagtctcattaaaagataaaaaaagaatctataaacggttctgttgcaaagtttttaatctactatcaaataaggtagaataatagaaaaagatagcaggaggaatgacgatgaatcattttaaaggaaagcaatttcagcaggatgtgattattgtagccgtgggctactatcttcgttataaccttagctatcgtgaacttcaagaaatcttatatgatcgtggcattaacgtttgtcatacgacgatttatcgttgggtgcaagaatatggcaaacgactctatcaaatttggaaaaagaaaaataaaaaatccttttattcatggaaaatggcattatttgtatcgagccatcgatgcagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatacgtcttttatcaagggacagaacatcgtaccattaaatacctgaataatttgattgaacaagaccatcgtccagtaaagaggcgcaataaattctatcgaagtttacgcactgcctcacccacgattaaaggcatggaagccatccgaggattatataagaaaacccgaaaagaaggcactctcttcaggttttcggtctgtactgaaatcaaggtattattgggaatcccagcttaaatcatagataccgtaagggattttattctttatttaaaaccttgcaacagaaccagcgtgttgggtttattaaacgaatacaggaacttggtttttctttaagcgagatttataaattacttggtgttgtagataaagatgaagttcgttgtcaagatatgttcgaatttatttctaaaaaacaaaaggaagcgcaaaaacaaatagaggatttaaaacgaattgaaatgatatacatctttccgaaaaagtttgctttttctcaaagcatggctataaataattgttagtccattcttaaggtcgataacacttttcaataccgaccctaataccgacctcaatactgaccttgataccgacctcaatactgaacaaaaaaagccacctgatttcagtggcccaattaatatatttaaaatctttataaaggaggattcctcagatgtatctggttgagcgaatatcaagctttctgattggctcgtggtatataacgagttggtcattgagtttcaacctagtttgatacatttgattggagcataatttaatttcatattctcaaaagatgagaaaaatttatattatcccaaaaatttcgtaatactatctgcaacattttgaatttgttcaggaatgttttcggttatacctcctgcaacattttgaatctgttcgggaatgttttcggttatacctcctgcaacattttgaatctgttcgggaatgttttcggttatacctcctgcaacattttgaatttgttcaggaatattttcggttatacctcctgcaacattttgaatttgttcgggaatgttttcggttatacctcctgcaacattttgaatttgttcaggaatattttcggttatattccccaaaatttcttgtgcttgttcagttaagttttgaaatatatttttaaacatttatagctctccttctatatcttttttatttggcaataataatctcaatgaatttagcagaacaaccagcgtacttccctcatgcaatgttatgcttagtaccaccgaggtatttttccatagactaatatacactaaaaatagaacaactaataaagcaaatattatattttgagttacaatattttttaatcttttagaagttttatgtgcactcacaaaattaccaaggtcattattcattaatactacatctgcagtttctatagctacatccgtgccatctcccatcgcaatacctacatctgctacagcaagtgctggtgcatcattcacaccatctccgatcatcgcggttggaccatatttttctttattttcatttattatttttgccttttcatcaggcattacatttgcctgcacatctcttacgcctaactgtttcccaattgcctttcccgttaatactgcatcaccagttatcataatagtctttatttgattcttatttaaatattgaattgccgaaattgcagtcttttgaggagtatcttgaattgctattaagccttcgactttatcgttaacagcaataaataccaccgtttttccttcattttcaaagttttcctgtttttcaatccattcttgacttacgattttaaaagcacttggtttagcaattcgatagctttctccttggtaggttgcgctcaaccctgtcccaagttcattttctactttgatatcgtagtcaactttttgaatttcaaatttattaactatagcatttgctaatgggtgattactttgcttttccattgctactaatgtatttctaaaggattcaccatcaagttcgggattaaaatagaaatctactacttttggttttccttctgtcaatgttcctgttttatcaaaagcgacagcttttaaattaattaaatttgaaagaaaattaccacctttaaatagtattccttgttttgctaaagatgatgttccagctaatgttgcaggaattgcagcaacagctaatgcacatggtgaagcagagactagaaagactaaacttcttgaaattgtttccgttaatgtccagcctaaaaacattggagaaaatataattaaagctaaaaatattactaatactccgttgacatagtgtggttcaaaacgttttatgaaatcggcagttggtgaaaggttattttgtgactcttcaaccatagttaatattttagaaaatactgtatccttgctatccttggatactctcatagtgaatgtacctgtaccattaatggttgaaccaaaaacaatatcaccaacatttttttctcgagggatactttcaccatttatggttgactcatcaatgcttgttgaaccattaagtatgataccatcagttggaacttgcgctccattcaaaacttgaagtctatcacctatttttaatttatcaatcgaaactacttctatatttccctcattattaattaaacgagcttccgtaggatttagttctattagtttagtaatttcccgtttactttttccctcaacatattcttcaagaaagtgtgcccctgcgaatataaagattagtagagcagcttcaacggcttctcctaagaaaattgcacctattgcggcaagtgtcattaaaatatgcgtattaggagtaaatcttttctttttgactgtctcttttatggtatcatctatcccttcaagcattacatgatatcccgataaaatagttgctattatgctaattaaaactctgactgtacttgatattgggagtaataatccgatgataaaaattattattccgataaaatataagcgtaatgctctcttttcttttaaagctgtaattaagcttttcatattagatacctcttctaaatgatcttcacgatatttagaaaatattttaaaaaaagaatttaaaattaaatagaaggtgacaaaatattatccactcttactctatccctttcattgattaacgcaggcatcatgatccagtttaaatactgacagaatcatttagtagtagtttttattgttatattcattcattaaaaactatcttttacggtttaataacctatctcatgttttattctttcttaaaatagagttggaaaagcaatcattcctaaaatagctataccaaaaatactgtataaactgtttatgacaagacaaattttcattaaatgattttgtacttccatctttttataagaaatagcagtgaataggccactgattatcataattacagcataaatgataataataatttctgctattggcgataccagtgcccaggtgttcattctcaaaattaagattgtccatggaataaagagtataatagtgctaataatagttactgtattttttttcattcggctatctcctttctatttttccaagtaacaaacaaatgaacgtaatgagtgcagcaactggaatccatggaattaactcaatagttgaggtagacaaattagttgcgagttttccatattctgaaacaacaacaaagaatgggtagcacatgggataaagaaaccaaacttttgtattaataagcaatacagaaggaacaatagaagccaaacttaagccgatagcaaatataggcgtttttattttagaagaaattaaccaaaatactgcaagcattggaatagcagaaacataaattaaccctatttcttttagtacaaaaaatggagaaagaaaaaaattgtagtcttgtgtctgagatataatagcagtgctagcataatacaatcccactactattaagagttgaatagctgcaagtgctagaagaacgacaaattttgctaaatataatgaccacatatttaatggaagagaacgcatctttaaatttccattgttgtttcgctcaatttgattcaaaagtagtgtcgctacaaccatacttgccggatataaaaaccaagaagcgcccattgtaccttgtataaataaattgtattccggagagattcctactccggtattaaaatttagttctccattaaaaatagaaggtaaccaaagaataatagctgcaataaggaacacaaataaaatttttgaccgtttaatttttttaaattctatagtaactagagataagaaattcattcaactttcctcctaataattaagatgagccattctactaatgcaataattgttatttcaatcagcgcaacatagatatagatgactacttgatttgaatctacttctccaagggtttgaagaggcattgcgaaaggaaacaatgatagtataaaactttgagatgaaagcacggttcccataaatacagctactacacctattccaagtgaaaaccacatatttttaaatagtgacgcaataagaagcgctaataaaatgctaggtaatcccattaaaaataggaagccaaagttttttaggagttctatctcaaagttaggatagaaactaaaccaataggaaataatgaatgacaaaatgcctgcttctataacaagcacgattaaatacatactcgctagaatagcggctttccaaaggtagatattgctttcttttattggtaaggacttcattttttgtatagcattatctaaaaattcgctataatacatcaaacaagctccagatataattagtaggatattcaacatggccatcatttgccagtttgacttaagtagaatttgaagaggcgtatctggtaaagacaaatagatatctgagcgaaagaacatatttaataccggtactcctgctgccagtaagccacccattagaaatgcaggtataagacccgttcgctttattttttttagctctaaaagaaccattatttcattcctcctcgctgtacattgtctccgtcaatcaatgctatgaaggtatcctcgaggttgtttgttgagtagccttgttcggctactttctgttttaattcttcaattgttccttcaaaaagaagatttccatgattaagaacaccaatattatcggccattaattcaatctcagaaagtaagtgagaagagactagaacggtacaatcaaatttttctggtaaagaacggataaggtttcttatttcatgtactccaacaggatctagaccattagttggttcgtcaaggataagtattggtggtcgtcctattaatgcactagctagtcctaaccgttgcttcatgcccaaagaatactttctagctaatcgatctttccacttagttaatccaacaatttcaaggacttcatcaacagaagtttgtggcaatttcaaaattttccgaacaacatccaggttctcttctccagtcaggtttccgtagaaagcaggtgcttcaataaaagaaccaatttcttttaagatctcatttctatctttaggatgttttttatcgtcaattgttaagccaccactggtagggttggttaaacctaagaacattttcataatagtagactttccagcaccgtttggacctaataatccataaacctttccttttggtatgtgcatagtaacatcggatacagccgtaaaatcagcatatttttttgtaagatttttcgtttcgataatagccattgtatttgctcctttcctttataatgccattatacctactcaaccttgtgagaaccttctacgtaccttacatctaccttactttttcattagatgaaaaaagcatagactatttaggttataataaaagatataaagaaggtggataaatgagtatagagtacttaaagaagaaacgtattttgttggttgacgatgaacctaaattactggacatggttgtttcgatattaaaagaaaatggatttgaatatatttatactgctcaaaaagtagaagaggctgtagttgtagctgaagaatacttacctgagcttgccatacttgatgttatgcttccagatggagatggattttctttaatgaaaaggctaagaaaaaagggaaattatccaatcttattcttaaccgctcgtggagaagacgaggataaactcgatggacttggactaggagcagacgattacatcgtcaaaccttttttacctaaagaattaatttttcgtattacagccatcctgaaaagaagctataaagatgacaatccctttgttcaattacaaaatagtaaaatcgattttgaacgtgctgaagtgataaaagatggcgagcagattttactaacagcgaaagaacacattctactttcgattctataccgtaatgcagggcgcattataacaatcgatgtcctatgtaaagaactgtggggagataattattttggttatgaaaactcactaatggctcatatcagtcgcgtccgccaaaagattgaaaaaaatccttctcaacccgtttcattgatcacggttaaaggacttggatataagcttcttacggaggcaaattaaaatgaaaagtgtgcctaaacttataggacgttttattggcattctgtttatgagtttgttgttactgataatcttaaacgtcttagtcttgtcttttatttcagtcaaacaattatcgaatagttctccttatcagactgcggaagagattgcagtctccttacaaaaaaaagatagtggatttaaattagatagtaacaatcaaaaatggttacaaactaataatatctgggcaattctaatagacgaagacacaaaaacagttacatggcagacagatgatcttccagagactattccaaaaagttattctcttagtgctatttcttctcttacatcaggctatatagatggatatcctacttatactggggcctctgaaggtgggatagtagtacttggttatcctaaaaagagttattggaaacacatctggccaagttgggattaccaatttattgctgatctaccccaaacagtttttattgtgctaatagctaatttgttgttgatagttttaatctattattgggtaacaagtaagctaacaaaatctatcgctcctattgttcagggtattcaagggctagtaactaaaaataacgtttatgtaaaagaaaaagggccactttctgaattagctatgaatatcaatcagacgtcacaaaccttgcaatctcaagaaagagtacttaaaaagagagaaacagcaagagctaactggattgcaggtgtttcgcatgatattcgcacaccactttctatggttatggggtacgctggacaactagaaagtaacccttctctttcactagacgaacaacataaagttaatattatcctaagacaaagtgaaaaaatgaaaaatttaattaaagatcttaatctagcttctaaattagagtataatatgcagccaataaatatggaaaaaataaacgttgcagtactaactcgacaagtagtagtagattttttaaatatcaagttagataaggatttcccaattaaatttgaaatgaggaacaacgttcattcctcctttgttttagcagacgaagggctaatgaaaagagctattacaaatttgattcaaaatgcaatcagtcataatgaaaaaggctgtcacatttttatttctgtatttactaaacaggaatcttgtattgtcgtagtagaagatgatggaataggaatttctgataagcaaatagaagagttgaataatgcgcctcattatatgattagtgatcaatctactatggaacagaggcatgggttaggcttactcctagttaagcaaataaccttatctcataatggggaaatgaaaataggacacagttgttacggtggtttctctgtgacacttgaatttccaatacataatgttaattaacattatgtattggaaattatcttttatttgatatagaaaaaaagtatctgttttggaatgtacttatagcaggcggaagtaagttttagactcgtataaaacttagaatagtggtagaaagataaaaaaagagtcttgattgaacaagtttcttgatacatgactttatctaatttcatgtattaaattaatcgattttatttctttgctaaagtaaatcgttcaattacatgtgaagtaagttgtactggttctgttgcgaagtttgaaaatcaaacgcgcccgctctgaactccaaatatcttaggctggtattcccattaataccttgatttcagtagacaccgaaaagccgaagagcgttccatttcttcggttctttttgtatattcctcgaatggtctccatgcccttaatcgtggaaacttggccactcgcctatctcccagggggcaacccccaagtacttccgccgtagatggacttaacttctgtgttcgacatgggaacaggtgtatctccatcgcaatgatgaccaaatcattaaatgttaccttgaacattcaaaactaaataacaattcttctaacttttaaaccataagcatattatatttgactcttttggtaaagtcctcgagcgattagtactggtccgctccaagtctcgcaactcttccacttccagcctatctaccagatcatctctctgggctcttaattcttacgaatgggtaatctcatcttgaggtgggcttcgcacttagatgctttcagcgcttatcccttccctacatagctatccagccgtgctcctggcggaacaactggtacaccagcggtaagtccatcccggtcctctcgtactaaggacagatcctctcaaattacctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatgcggtaccaccggatcactaagtcctagtttcctacctgctcgagttgtagctctcgcagtcaagctggcttttacctttacactctacgattgatttccaaccaatctgagccaacctttgagcgcctccgttactctttaggaggcgaccgccccagtcaaactgtccgtcagacactgtctccctggccgattatgccagcgggttagagtaaccataagtcaagggtagtatcccaacaacgcctcaatagaaactagcgtccctatttcaatggctcctacctatcctgtacatgacttacaggtactcaatatcaaactacagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgacttacgtctaagcactcctcttaaccttccagcaccgggcaggcgtcaccccctatacatcaccttgcggtttagcagagagctgtgtttttgataaacagttgcttgggcctattcactgcggctggcttttacaccagcaccccttctcccgaagttacggggctattttgccgagttccttaacgagagttctctcgatcacctgaggctactcgcctcgactacctgtgtcggtttgcggtacgggtagatatgactttacgctagaagcttttcttggcagtgtgacatcagagagttcgcaaccgtagttgcttccccatcacagctcaatgttaaagagaaatgcatttgacacatctcacacctcactgcttagaccagaatccattaactggcatctcttagcctactgcgtccctccatcacgatcatatctagtactggaatatcaaccagttgtccatcgactacgcctttcggcctcgccttaggtcccgactaacccagggcggacgagccttcccctggaaaccttagtcttacggtggataagattctcacttatcttgcgctactcataccggcattctcacttcttaacgctccagcactcctcacggtataccttcatcgcggttaagaacgctctcctaccattgataaaatatcaatccaaagcttcggtaatatgtttagccccggtacattttcggcgcagggtcactcgactagtgagctattacgcactctttgaatgatagctgcttctgagctaacatcctagttgtctatgcaaccccacatccttttccacttaacatatattttgggaccttagctgttggtctgggctgtttccctttcgactacggatcttagcactcgcagtctgactgccgaacatgtgtattagcattcggagtttatctgagattggtaatcctagacggacccctcacccaaacagtgctctacctccaatacacttacatttcgacgctagccctaaagctatttcggagagaaccagctatctcccagttcgtttggaatttctccgctatccacaagtcatccaaacacttttcaacgtgtcctggttcgggcctccagtgcgtcttaccacaccttcaccctgctcatggataggtcactaggtttcgggtctacatcatgatactaagtcgccctattcagactcggtttccctacggctccgtctcttcaacttaacctcgcatcataacgtaactcgccggttcattctacaaaaggcacgctctcacccattaacgggctcgaacttcttgtaggcacacggtttcaggtgctatttcactcccctctcggggttcttttcacctttccctcacggtactggttcactatcggtcactaaggagtatttagggttgggagatggtcctcccggattcaaactggatttcgcgtgtccagccctactcaggatactgctaggtataagcgctatttcgtctacgggattattaccctctttgattaaccttcccaggttattcgactataatgcttaagtccacgttgcagtcctacaaccccaagaagcaagcttcttggtttgcccttcttcgcgttcgctcgccgctacttacgaaatcgtttttactttctcttcctgcaggtacttagatgtttcagttctctgcgttacctttacatgagctatgtattcactcatgaataactgctagtagcagctgggtttccccattcggagacctagggatcaatgcgtacttactgctccccctagaatatcgtcgttagtcacgtccttcatcggctcttagtgccaaggcatccaccgtgcgcccttattaactttgccatgatgatttataatcatcgtttttcaagtataagtttgtaaattctttaaaattcacagcttttggtttatttatcgttattagatattgttatttagttttcaatgttcaagtgattttaacgtcttgtctgacaatggagcctagcgggatcgaaccgctgacctcctgcgtgcaaagcaggcgctctcccagctgagctaaggccccacaatcaagaagttgattcttgcttaggtttatgactaaacccctcaaaactgaataaagttgaatgctcacgtctttgtatatattccttagaaaggaggtgatccagccgcaccttccgatacggctaccttgttacgacttcaccccagtcatcggtcttaccttaggaagcgccctccttgcggttaggcaacctacttcgggtactcccaactcccgtggtgtgacgggcggtgtgtacaaggcccgggaacgtattcaccgcggcgtgctgatccgcgattactagcgattccgacttcatgtaggcgagttgcagcctacaatccgaactgagaatggttttaagagattagctaaacatcactgtctcgcgactcgttgtaccatccattgtagcacgtgtgtagcccaggtcataaggggcatgatgatttgacgtcatccccaccttcctccggtttatcaccggcagtctcgttagagtgcccaacttaatgatggcaactaacaataggggttgcgctcgttgcgggacttaacccaacatctcacgacacgagctgacgacaaccatgcaccacctgtatcccgtgtcccgaaggaacttcctatctctaggaatagcacgagtatgtcaagacctggtaaggttcttcgcgttgcttcgaattaaaccacatgctccaccgcttgtgcgggcccccgtcaattcctttgagtttcaaccttgcggtcgtactccccaggcggagtgcttattgcgttagctgcgatacagagaacttatagctccctacatctagcactcatcgtttacggcgtggactaccagggtatctaatcctgtttgctccccacgctttcgagcctcagtgtcagttacaggccagagagccgctttcgccaccggtgttcctccatatatctacgcatttcaccgctacacatggaattccactctcctctcctgcactcaagtctaccagtttccaatgcatacaatggttgagccactgccttttacaccagacttaataaaccacctgcgctcgctttacgcccaataaatccggacaacgctcgggacctacgtattaccgcggctgctggcacgtagttagccgtccctttctgggtagttaccgtcacttgatgagctttccactctcaccaacgttcttctctaccaacagagttttacgatccgaaaaccttcttcactcacgcggcgttgctcggtcagactttcgtccattgccgaagattccctactgctgcctcccgtaggagtttgggccgtgtctcagtcccaatgtggccgatcaccctctcaggtcggctatgtatcatcgccttggtgagcctttacctcaccaactagctaatacaacgcgggatcatctttgagtgatgcaattgcatctttcaaacttaaaacttgtgtttaaagtttttatgcggtattagcattcgtttccaaatgttgtcccccgctcaaaggcagattccccacgcgttactcacccgttcgctgctcatccagttggtacaagtaccaaccttcagcgctcaacttgcatgtattaggcacgccgccagcgttcgtcctgagccaggatcaaactctcaaataaagtatttaagtcaccgaagtgactggcttgtctttcattattgattgacagatttttgatgtatcttactacatcacatgagtcattcttctttattcagttttcaatggtctagcttatcgcttcaagaccctcgtctcttgcgacaactattatattctatcaaacctacctaatcttgtcaagaattaactgtggcttttacgactttttttatcttacgtctctgtcttttttctcaattttacactaaaatagattttttggaaaactttgcaacagaaccgtctttttcaaatcaattccaaatcaaagttaaatatcaatcaaaagataaattaactgaaatttatggttttgtttctgaattcatcaataatcaagtgagaataaaatcaacagataaaatgtacctcatctctattgaacaaattataaatatttcatagcaaaaaagctcatgttaataaataacatgagcttttttgtattcattatagatatagtttaattaaatcattcagaaattgggatgtatttttataattttgtttttctgccaatttttcaaggccttcttttacagaaggttctaaggtaaatgaatatgattttttattttcttctgattcaattttttttgggagttccacttttgacttagctaaagaactgtttgataacactgtttttacttttttatcatctacatcaaatgccattttctctcactttctttactattatagcttaattatatttacaatatatttatatttacaacatatttacgatataatgcaaatggaattatattatatctaaactatatttattttatattagaattgtagttatgcttttattttattagttatttcattaaatgcaaaatttaatttttcataaaaaactttattactattaaaaacatctttatctttttccatttcaactaagggaactccgtcaagtgtcgaacggttaaataattctttctctggaatcatagcaatagttcctttatcttgtgatattttttcagaaaactctcttgatgacttagtattatgtcttattctatttccaacaaaatatggtattgctgtgatatatgtttcccgtgtccgtgcatcaataacctcatctttaaaattttgaaggcgttcaatcaacaaactttttgacatatatccgtattggctaggttctattgggcttaaaatataatgactaacagcaattgcattttttgtaacggtttgaaaatctggatgacaatcaataagtataaaatcaaattcttttattctatcaacattatcttgaagccacatcattaataataaatctttattatgttttgagcttaactctacttctaattcatctaacattggagaagcaggaatgatgctcaaattatcatgtattttatgaatttctacttcttcattcataaatgcattgtaaattgtattttcatttgtaaacaaattatatgtttgacttaaactgcattggtggtcagtatcaattaaaagaactttgtatccctgtcttgataaccattctccaaaattgaaagtaattgttgttttaccaactccgccttttactgctgacacactaataatcttcatggcattccctcatctattcacaatataattatattgtatttatgttataagtatattatagcacaaatagaaattaagtcaaattataagtatgttatgtttacaatatgtttatattgtaaatgttcagtccttgttatttttcaaagctttgcattctctgatttcattttacaaaagttcagaataaaaaatttttaataattaaaggggattgattaaccaaaattattataataaatttatattagttagtagagaaacttccaaaagaattgtaaatatagttataacataactatattacgtttatgatatgtctatgatatagtcgcaatatgtttatgttgcgacttttataaatttttatgaaattgcatatctaacgacaatgtgataaaataattttaataataaaaaattgaatcgggaaaaaaagataaaaaaagactagttgctggaaacaactagacgaattttattagttagtagttcggattaactacttagcctatctaatcttaacttggcggaaaaggttagatacacatttcaatctttaattattctacaattataccaaaataataaatttttttcaacactattatgctatttaattaccgaataatttaaagaataaagatgtaatggactaagtagcaaagactaccagtccatttttttattttccaaatgagagggtacatctttatgacaaaaagtaattttaagttttatcaaccagacgatgtttatggcactttgttttttcaatttccgaaagttttaatatacggggacaagtataacaaattaagttctgatgcaaaaattgcatacatgcttttaaaagataaactagaattttcaattaaaaatgaatggattgatgaagacaattatatctacttcaaatactcaaatattgctttaatgcaaatctttaattactcagaaaaaacagtaataaaaataaaaaaagaacttgaaagtgttgatttactttatcaaaaacgaatgggctataaccctaaaactaaaaaaaatgaagcaaatcgcttgtatttaggagagttagaactatcagcagaagatgtgtataagaaagaaaaaagggcacgagcccttgctacgagcggaactgtaaaaagtacagtacggtcggacaaccctcaaacccttgctacgagcggaactgtaaaaagtacagcatatctatataaagatatattagatacctctttagataatattaaagatactcaagaacttgacttttcatcttctaatttttcagaagctcaacttaaagtccaaaatcaagatttagtgaagaactcaaaatctttcctcaaagaagggacacatgaactatttcttagtgaagaagccattaacttacttcaaatgtggtgtaactctcctcaacaacttagaaagatggttggtattattcttaatgctaaaaatgctgtatgcaaagagaatgaggaacttggagtattctttgtcctcgaagaagaagcattacaagaaaaaatccttaatactctaagacgctattttaatgccattagaactaaagaaaataaaataaccaattacgaaaactatttatttgggtcaatgaaaaatatgtttgctgaatactggaataatcaagcgctcaaacaaagattaaactcaaacgaaacaaataaagagaacctaaatatggatgattctgtttggtctaattctaattataagaatgaaaccagtcaaattgatttagctcgtcttgaaagaattaaacttgaagctctagcgaaaatcaattctaaaccaacatgattcagggtactattttaataaaaaaacccgaattgctagttgattatatagccatgacttgatacccgatagaatatcttaaagtctctggttccagtgatttagctgattttaacagtaaagaatacgctaaaagtatcatctctaatttcaattgaaaaccttgaggcgaacgacttttacaacgctcagctcctagatttgtcaaaaaagagaaaactcgctcaatcacttttctacgttttgaaaaattagggaaaaggattttggtatcgtctatttgagtagttgtcatcattagttagtggatcaattttaattttaaaccgaaaccgtgtataattataaacaataactgccatgaaacagctctgctgtttcaaaggcttgcgccagtgcgctgggcaagcctggtggcccattttaaaatccagtgacgccaacgataacctggctaacctgtcatttttgccatttaaagacgcttcaaaaaatttctttaacccccaaatcactaagactaggagtttatggttttgatattaaaaggttgatttgaagctgtttcagtctattagtatttaagaaaaaatgatgtattattttgtttggctaccaatttagctaccacaaaaaataaaagggttgtataattggacaagatgttgtacaataagtttaacgaatagaatttgaagtgttaattcacaacagattcaaaagggtcacagggagctgtggctcttttttttatgcaaaaaaactgtcagattgagtaagtctgacagctagaaatgtggaattagtggcgcttgttgtgttggtctttcaaccagctcttgattatttcaagggcaacacctaccacaagaggtgcaactacagttacgaatagaatttgaagcatataattcacctccttcctaaggcagtaatgctccaagaaggtgcgccaaaaattattatatcataatgcaaacaaaaaaatcgtctaagttgaaaacttcggcgtttttttgttttctcgccccctgcgacaagggaattggagttaaactctatctttgaagtaattatctattaagtgtttaatcgctatcatctttttccaccgatttattagaagtcttattatttgctaaagattttgaggaatctaatagcgttggatcaacgttcaaattaggaagtgattttgagaaatctaataatcttggattaacgtccaaattaggaaatgattttgagagttctagcattttagagttgactccaaaattagataaggattttgagagttctacaattttggggtcaattccaaaattagaaaaagattttgagagttctacaattttggggttgaggtttagcttgtggtggtggacagcaaggacctatgtttacaatgtacggttatgaaactaccatcatggatttttcagaatctcagctatctaaagacgtagaagtggcaaaacgagaaaatttgtatattaaaactgtacaggctgatatgaccaaaccattcccatttgaatatgatagctttgatattattttttgccctgtctcaaatgtctatattgaaaatttagataatatgtattcagaagcctaccgtgttttaagaaaaggtgaattattaatgattggatatatgaatccgtggatttatatgtatgacggagatgaggtttgggatcaaactgataaggaattatcattaaaatatagccttgtaagattgaaagccatttatagactccgatttgaacacacgacagttatgctctgtcgtgtgttacatgtcaatcgttccacctactataacttcataaacaagaggccttcgaagcgtgaagtagttaaacgacggaataaattttatcaaagtctccgtacagcctcttccacgattaagggcatggagacccttcgaggaatatataaaaagaaccgaagaaatggaacgctcttcggctttgcggtgtctactgaaatcaaggtattaatgggaataccagcctaagatatttggagttcagagagggcgcgtttgattttcaaacttcgcaacagaaccaaaataagcataacttttaaagtgctccataactgttagatttcttgtctaacaattatggagcactttaggttccctgtgcttttttatttgttcaaaaacagcaaccgtaatttgttttttcccagtactatagctaacttaaatgtacttttcattagccaacgttaaaattcgtcttatactaaaatttaattgtttaaatgtgataatcaatgtgatattattattatatgacaacaatggttgttaacaacgtttaaattattcgtatacttattcgtatactatcaaaaatggaggaataggtattgaaaacaaatcgctatgttgttgcgtttgcaggtgtcatgtttcatttaatgattggttccgtttatgcttggagtgtttttactaatccaattgcaaaacaaaatggttgggcagaatcctcagtcgctcttgcatttagtatcgctattttcttcttgggaatgtcagccgcctttatgggcaaagtcgttgaaaaaataggccctagactaacgggaactattgctagctttctttacggaactggaaccattatgactggttgggctatccatcaaaattcaatttggctattatatctctcatatggtgtcataggcggcttaggactgggagcaggatacgttacccctgtatcaacaattattaaatggtttccagacaaacgcggtttagcaacggggttagctattatgggatttggttttgcagcaatgctgactggtcctgttgctcaacagctaatggctagtgttggtcttgaacaaacattctatctcttaggaacattttattttgttattatgctgctcgctgcacagtttattgttcgtccaaatctggcactatcaagcactactgaaaatagcatttctcaaaaaaagggaacacgtctaacccgaggaccggagctaacagctaaccaagccctcaaaactaaatccttcacttttctttggataatgttatttatcaatattacatgcgggatcggccttgtctcagctgcatcccccatggctcaaagtatgaccggcatgtctgtccaaacagccgcaattatggttggaatcataggccttttcaatggctttggacgtttgatatgggcaactttgtctgattatatcgggcgccctgctactttcagtgccatttttattctcgatattgtaatgctttcagccatgctcatcttcaaattaccgctcctatttgtcattgcattatgcttgttgatgtcttgttatggagcaggcttttctgtcatcccagcctacttaggtgatgtctttggtactaaagaattaggagctgttcatggatatgtactgacagcatgggctgctgccggagttgttggaccattactattatcattaacacatcaactgttccacaattatactttgacattagctgcctttattttgattgatctattggcactgctaatctcattctggatacaacgagatttcattaaagccagcaaattaataaaaagcaaatcataaaaaactactttaaagcgcattaaattattaaaaactaagacaaaattgcataaaaaagagtctaaaacagcatgagccgtaaagtgcaacacaaaagttagacaaaattgaatatttataaactgctaaggcatgttccctgtattcgcagggagtcatgccttttgttttctgtgatattcgtcgattgttaaaccaatcgacgtaattctttgtgatttccttgaattctccaataggttctgttgcaaagttttccaaaaaatctattttagtgtaaaattgagaaaaaagacagagaggacagagtaatgaatcattttaaaggcaaacaatcctgaaaagtatcagtatgataaaagtgaagttgttgctcataatggttttagatatcgtcaatatttaacagacgttggtgtagatacagatgttattctgcaagaaatagtacaatggattcgtgaatctaattgttatgaatatggcgacttggttgatgaaaagtttgatgaatggtttcctactgttagaagtcagacgatctttttaactgcttatttacgttctaatcggtataagccttttaaaaaaatagatagagaaactggagaaatattggaatgatggatagagaaaaatttgtattttgaaaggtttcataagacagttgataaattatggagtgactattcagtataaaatttgaatagggagttaataaaaatgacaataaatttcagtataagtaaagatatcgatattaagcaattagaagaattatataatgacgttggttggagtgcgtatactcaagatttggaagtattaaagcaagctatattacaatcgttagatgttataactgtttggaatgacgataaattagtagggcttattagggctattggagacggattaacgattgtgtatatacaagatatacttgttttgaatgcttatcagaataagggtattgcaagtgaattattgcaaagaatattaaataaatacaaaaatgttcgtcaaaaagttcttttaactgaagaagcttctggtgttagatatttttatgaaaagaatggtttcgaatcctgtgatcagggattgttagttgcgtttgctaaaatgaactaaattgtgatcttgagagtggcttagcctctctttttttgttttggctttattgaacgaaaaaaattgataaatttttgagtgaattatcgcccattttttgggcggatttttttgtgattggcacaaaaaaaggtgttttttgacacgaagtgtcaatttttgcgctagcaaaaacaagcctcgcagagcccacactttaccatgtgaagaaatggaacgctcttcggcttttcggtgtctactgaaatcaaggtattaatgggaataccagcctaagatatttggagttcagagagggcgcgtttgattttcaaacttcgcaacagaacctttcatgctctcagcattattttctagctttgcaaatttttttgaaacaagttatattgtagttaaaaaaactacaggaggatttatcacatttttatttggagcaatcgtttgtgtcattgcacaagtattacttattccattatttggcttgaatggtgctggattagcttcaatgcttggattcttaacaacgtttttatttcgtgtcaaggatacgcaaaaatttgtggtgattcagattaaatggcgaacttttataagtaattttgtgatcattttggtacaaattctttgtttattttatctgccgagtaaagtcttgtatctatgccttgccctattattttgtggcatgttagtggttaatcagcgtacaattttatacattatcatggcgctaaaaaataaaaaataagacatttggaatgaaatcctcataaaaatagacaggagatatatctcgataccattcgagatatatctcctgtctattcttatgctacttttgggttagctcaactcaaccgccttttaatctcccaacaacaataatacccaatcaaacaacccaaaaaattcaagataatatcactaatggcaaatgtgcccaaataaaagataaattgaatcgtttcaattcctaaaagtgtgaccaaactgacaatgacaaactgtttgaaatcagtattgatacagtaaaggccacctaaaggaatgaagtagataatatttagcactgcctcttgaatcgttctggtatccgcttttataaagtcaaaaggattcagtgatatcgcctgaaaatccgttgttttagtaaaaagcaccatgaataacagtaataaatacacactgaaagcaagatagagataaataactgaaaaatgtttgaggtgatactggatgccaaacaaccagataatcagcgttaataagagtattaaagttaatgcggtatagtcaaagtggttaatcaacctagccaggctttgatagcgagtgagaacgggcataatcagccaagtaatcgtcgcataactcaggataaatgtgaccaataaactgctgaggtagatcatatattttcgcaactgtttctaactccttttcttgatgagattaaccctatttggttctgttgcgaagtttgaaaatcaaacgcgccctctctgaactccaaatatcttaggctggaacgctgtgactaaaaaaacgactagactagtcacaggcaattttccgattgatttaataaaaggctatcatcattcgcataaaatatcagaggctaagcaatctaaacgaaaaggacaacgaataatgataatgactgaaaaagaatttatcgaatttttagctcaaacttttcaacttctctcaaaagggttataattatgcttgttatattattgatagaggaggaattatgaaaactttaggaaaagctattgctaataaaattgctttagttttgtcccaatacttccaacttccaccaggatatctgatgggagttatccccaatcatgtccccaatgacccacgagcttacttcgagcaattgaatgaagaacaaaaagtagaattgttaaaagtatgccacaaatggtcggaaaaacgagttgaaaatatgcaatacttaaactgaaaacgtaaaaagtttatcataatgataagctttttgtatcttgcttaacttattgaccttggagagaattcatattcatttcgcccaagattcactgaaagcaacctattgcaaagttggttcagttcgttgtccaagacagtactcaatatgtaattgcagaaaattgggaaaatcaaccagcgttagatttacataacaaaaaggaacgcttgaaatcttttgttagaaatatcagtcaatatcttatcgaagattgtaaaattagtatgagttactaattataccaaagtaaaaaaattaaaccagcttgcaccttaatagttgtgagctggttttttagtttattctaaaacttattaatatatctataaatcgttgttcttgaaactccccaagaatccgcaatcgacttaatcggcgtaccactttctaccaaggttttaagaagctttacgtcttgctccgaaaatttctcaggtcttcctccaagtcgtcctcttgcacgtgcagcttctctaccagcggcagaacgctccaaaataagatttctctcaaattccgcaaaagccgcaaacaaatgaaacatcaattgtccagtcgaacttgatttatccattgtaatattttcttgcaagctatggaagcttactcctttatcattaagtgaattaactatgctaattaagtcctccatatttcttcctaatcgatctaaccgccaaacaacaattgtatctccagaacgagaaaattcgatggcggattttaaaccaggtcgatcttttttacttcctgacagatggtcagtaaatattttctcacaatcatattttttaagactatctttttgtaaatccaaattttgaagtccagttgaaactcgtgcatatccgatattcattttattctcctttgttctaatttattgtatcataacttaaaaatatatatataaatgaacatagaataaattacgggttaatgaacgagaaatgtaaatgattttgagagtttttataacaaaagaagagtgtccagaaaatgaccattttatgaacattcaaacattcacttgaatatagatggatgttatgatacaatatattcaaacaaacatttgaatgtaaaggaatgatcgtatgaataatgaaatttgtgaaataacttgtattcatgaagacaaagttaatcgtgctaaatctaaactagcaaactttgatactccgtcagtaagtggtttctttaaaatattgtcagatgaaaatcgacttaaaattgtacatgctttagttcatgaagatgagctatgtgtttgtgatattgctaatatcattgatgcttcggtcgcaacaacttcacaccatctgaactccttaaaaaaattgggagtagttgatagtcacaaggatggtaagttagtctactattttattaaaaatatcaaaatcttaaatcttatggagcttggcgtaaattttaaagaagaggtgctagcatgagtgagaaaatgaccgaaaaaacctatcgaatagaaggattaagctgtacaaattgtgcaggtaaatttgaaaaaaatgtaaagcagttgccaggagttacgagtgcaacagtaaactttggtgcaagtaagatttcagtagaaggccaaacaacaattgaagaactcgaagaagcgggagccttcgaaaatcttatcattcgtgatgatcaagaaaatgatgaacaagttagatcaaaagagtcttttattaaacggaatatcgctttaatcatctctcttggttttatacttgttgctgtgatttcccaactatcattgggcgaagatcatttattaacgaaagctctttatatattggcaataataattggtggatttgatttatttaaagaagggttctctgatttgatcaaattggacttctccatggaatctttaatgactattgcaattattggggccgcatttattggagaatgggccgaaggttctattgtagtaatactatttgctattagcgaagctttggaacgattttcaatggataaagcaagacagtcgattcgttctcttatggatatagctcccaaagaagctcttatcaggagaaacaatgtagagcaattagtcagtgtcgataaaatcgatatcgacgatattatgatcattaaacccggacaaaaaatagccatggatgggcttgttatcaacggtcattcttcagtaaatcaagcagcaataacaggagaatcggttcctgttgaaaaacagttagatgatgaagtgtttgcaggaacactaaatgaagaaggtgttcttgaagtcaaagtaacaaaaaaagtaacggatacaacgattgccaaaatcattcacttagttgaagaagcgcaaggagaacgagctcctgcacaagcctttgtagataaatttgcaaaatactatacgccattcataattattatggcccttttgatagtggttgttcctccgctattctttggtggtgactggaataaatggctttaccaagggttatccattttagttgtcggatgtccttgttcattagtgatctcaacacctgtttcaattgtttcggctattggtaatgcagcaaaaaatggtgttttagtaaaaggcggagtctatctggaagaaattggtcatttgagagcaattgctttcgataagactggaaccttaacaaaaggaaagcctgtcgtaacggatttcattgcaaccagttctgaaactgatataaattatctatcgattatttcatcgttggaatctctttctcaacacccattagcttctgctattttaaacgaagcggataaaactaatgtggattacaagtcaatacaaatcgaggatttccaatctatcacaggtaaaggacttacaggtatacatcaaaatatacgttactatattgggagccctaaactgttttctgcatcagtaatcgaagaaacagcggtcaaagtacaatacagacaatttcaagaacaagggaaaaccgccatgtatttcggtactgacgaacaaattttaggagtaattgctgtcgcggatgaagtaagagattcaagtgctgccgttatttctgaactccacaagttgtcaattgaacacactattatgcttactggtgataatactaaaaccgctgaatctattggtaagcaattaggtgtgactgaaataaaaggagatctaatgcctcaagaaaaattagattcgattaaagcgttgcggacaacttataataaagtagcaatggtgggcgacggcattaatgatgcaccagcattagctgcatcgacggttggtattgcaatgggcggtgcaggaacagatacggctctcgaaactgctgatgttgctctaatgggcgacgatttacaaaaattaccattcattgttagacttagccgtcaaactctaaaagtaattaagcaaaatatcaccttctcattaggtataaaactattagctctactactagtcataccaggttggctaacactatggattgctattgtagcagatatgggagcaacgcttttagtaacattaaacggattacgattgatgaaagttaaataacacaacaaataaaagaaggcatgtttataagcgtgccttctttttatgatactttttagtttttttgaacgctagttatgaagcaaactatgcgccatttaaatattaaaatgacagtctaaccttattaagtaggtgttcccattaatactttgatttccttagataatagaaagctccagagaaataaaataagatcttcaaattataaatttcatctctttaaaaattaggtctctgttttccttaacttaatgacattggggtatactctattgaactatttttagttagtggtataatagctattgcaggtgttcattagacttgttcaaaaaaggtggaaaattgttagaaaatgaatatttcgtgttcactggaacactcaccacaatgacgagaaaacaggcgcaagctattatttcagggctagaaggtcataatcaaagtagtgtcacgaaaaaaaccacacggctggtgacaggctatttccccattgatttaatcaagggctattccccttctcgaaaactgacagaagcagaacaagcgattgaattaggacagcctttgattatcatgagtgaaaaagagtttgtggactttttagcacaatttttccaattactatcaaaaggattgtaaacaatcataaaagaaagagagaaactataaatgaaaaaaataatcgcatttagtagtattgttcttctagctatttttggacttgtagcatgtggtacgaactcccaaaaattatcgaaagagaatattgaccgtattcattttaccattaccaatgggagtaactatcaatttcaagaaacggatatgaatatcaagaaaaaagaaatggtttcatcaattgtcgattatcttgatgagttggatttatccaaaaaaaatgaggtcaaagatactggcggtttagtcggtgctgatacgtatacactggatttgaaccgtggaacaaaatttgtcagaagatacatgatttatggcgattacatcaccattggtaaggataaaaaacagcaagtgatttataaagtgaaacacgataaactctctgatttacttaaaacgttggacgatttggcagaagccaataatgataaagaggaggagtagaaaatggcaaaaataggttatgctcgtgtttcaagcaaagaacagaacctagaccgccagttagaagccttacaggacgtttctaaggtgttttcagataaggcaagcggacaatctactgaacgtcctcaattacaagccatgctgacttatttacgtgagggtgatattgtcgtggtgacagaattagaccgcttaggacgaaataacaaagaattgaccgaactgatgaaccaaattcaacaaaaaggcgcaacgctggaagtcttaaacttgccatccatgacagggattgaagacgataatttaaggcgtttaatcaataacttaatgattgaattgtacaaataccaagcagaaagtgaacgaaaacggattagagaacggcaagcccaaggtattgccattgccaaacaacgcggacgatttaaaggacgaaaaaagaaatattcttttgaagatgagggcttgcaacatgcctttgatttataccaacaaggattaacagaaaaagaaatcgagcgtaaaactggaattaatcgaacgacttttcgacgttatcgtcaaaaatataacgtgataagagaagacagaaaataataagctgatattagccctcagaagggctttttcttttaactatgatatttattaccaactcacgtttaaaatgtcttagaatgcaaaatatgagtttctaggactatttaaagcttttcatctaaacaaagtagtcacgaccgttagggagttctttttagtggcagaatgaatctaatataaaattagagtgtacaagcggagcgacaagagcaacgtagggagtttaaatttagaacctcaattcaatggttttgactttttcttttgaccttgattttaatttttgaaaaaaataaaaaaggcgaagcctatttatatttatcatatatattttaatcttttgttcttttgcgtgctaaaaaagcaagtgtttgcaaggttttacagaatttaatgtgtacaaaaaactgtttacatgtgtacaaaaaactgtttacatgtgtacaaaaaactgtttacatgtgtacaaaaaaattgttaaagtacacgtgtagtgatataataaaagcatagagaaattcactcgcaaaaatggtttctctatgccagactaaaacacgcaaaggagcgtatttatatgcccattataacagaaaaacaaaataatcaaaagcaggtactgaccttgaatgaccttgaaaaacgcaaagtggtagagcataacagcttgataacgtctattgctaaaatggataaaacacccttgaaaatgtttgaattagcggtgtcgtgtattgatacggagaacccaccgaaagacaataccgtttatctctcaaagactgaccttttcgctttctttaaagtttccgacaatgataagcatagtcgctttaaacaagcggttgagaaaatgcaaaaacaagctttttttcaaatcaaagaagaacaaggaaagggttttaaattcaaaagcattgtgcctatcccttacgtagaatggacggattataacgacgaagtaaaaattgaatttcatcgtgaaattatgccttacttaatcaatctcaaaaagaattttacccaacacgctttatcagatatagccgaactcaatagcaagtacagcattatcttgtatcggtggttatccatgaattacaatcaatacgagcattacagcaacaagggcgggcggagagtggagcaagtggaagcctaccgcaaccccaccatttcaatggaagagttacgaattatgacagatacagttaatgagtataaagattttagaaattttgaaaaaagaattttaaaaaattctattgaagaaattacagaacatacctcttttaacgtgacttatgacaagattaagaaagggcgttcgattgattctatcgtctttcatattacgaagaaacgccgagcagacgataacagttacaagctagaggataaaacgtacaaggaagtgaaaattgaaaaagaacaaagtgaagctattttagttaagcaagcaatggaaagtaaatatacaaggttattattggagaatttccttttatcgccttatgaaatgacagatacaacacttatggctggcttgcaaaaaaatgtttatccaaagtatgacgaactcaaaacattacgaggacttgagggggtcaaaaagcacctctcatacgttcgtgagaagcaagaaccttattcaaaagggaacattgcaaagtatcttaaaaaggcaattgaacaatacctaccaacggttaaaaggcaggaactttaaatgaacaaaataattagtatcaaacaaaaatttttgtgtaaagattgtgattatattttagaaatttctcgtttaaaagtaaaaaaagcaaaacaatatggtggtgtctattgcccaaggtgtggcaaaaaaattatggataataaaataaaaaaagtttagagattactctaaactttttttattttttatacttatcaggtttttgttaatttatcatatttgcaaaaacttgtaaaagttgttctgtttcatcaacagttaaatgttttgcttcaagatatttttaaagtaaagcgcctttttgaattaattgccgtgtccgtttttttcgttctttatagttttcagaattattctgtaaaacagaacgattaatttttatttgaacttgttttgctttttctctttcttgaatcaacaaattttctaatttcttaatttgttcaaaatcaagttgttcattatcaaatttttttaaaattgtttcttgcttattgattgccttttctaactgttcaatcgagtaagataaatcttttttatttttaatagtcataactattactcattcaaaggtttaagattaggatagcacgacttatttattttccaatgaaattaactagcaattcgggttttcttaattttttttataaaaaaattactcctaaagcagagtaattttattgttaatttttatcagagattattccaaaaatttttctgataaaaatgaagtatcactcctaccgaaaatcctaaaaggaggactagggcaaggttaacaactaaaggatatggaataaagataatcagggcaataattgctccaatgagtgctcctgctcccaaaagcgtagcaaagaaaatgataaaaacccgaaatcccccagaacctcttgtaaaaagttgagtcaacgcagtccaatttaaatttaagagatgccaatctctgacaaaataatgaagtgaaatcagatataccccaataacattcccaattaacagcccaaagagcaaggtaacagggactttcagtaaaataccaatcactaaagataagattaaatcaagaactagttgaataaaaaaggcaaaatgaaatttcactctgagatagaaattcaacttcatgggtaagcttttaaaataattaaaattttcccgatcaagtgagataatcattgaaggaagagagctattgttaatggtcagaaaagctaaactaattccgatgataggaaaaatagcaaaaaatttcaaatccaattttgacaaatttagaccactagataaaagaccgggcagcatagcaagcggaaaaataaaggatcctgtcagcatttgaatccataaggtaggatttttaattagtcctagattataaattcttaattgtgaggtaaaatttctcgttcttcttatttttcttttttgaacaattctcgtttcttttgactcttccaagagaattttaaacatttttggaaccactagaagtgtaaaaacatagtaaagagcaatcaataagattataaaaaagagaaaactaaataaactatagaaagagaacggatttactaaccatttccaaaaaggtaaaaatggcagaaaagttcctctatccaacaacttacctgtcgcactaatcgtcgtttgagcattatttagatacataatcccagcaaaaattccaaccattgaaatcaataatagtatggtctgggaaacttttttatagcgttgaaatattttagattgaaccaaaaaagtaatcaaccatgtactaagcagtaagaataatagagcaaacagaaaaaatccaactaatccgagaaagaggccaatcactccgtttgccctaaaacctgttattccaaaaagcaccaaaagaggcattaaataaggtaagataacaaaaattacgactaaaaatttagcagcaaaaatattaacattttcaaaagggagaggcagataatctcgaaagtctttgctctcataaaaaatatttaaaattgctgacaaggcttgagaaaaagtcatcagggcaaacagagcacaataaaaagtaaaaaatcccggatattttggaaagtcaattgctaacatcatcagtccgaaaaatggcaacatgatgagcgagacaagcccatattgaatcaaaagtgatttggttaaatttttggttttacctttttctctttgacgttgggtagcttgaggattggcataaaggaggttgacactaaaaagacttttaatttgttgaagattcatcatcgtctcctctatttagctcttcttgctgacgacctaccattttgagataaaccgactccaaagattgatcttctgctgaatctaataaagcatcaactgttcccgaataaattagttcgccagcttttaaaatggctagttgatcacatagctgttgcgctacttctaaagcatgtgtagaaaaaataaccgtttttccttgggcagcgtgtgctttcatcagattttttaaatcaaaagctgcttgagggtccaatccttgcaagggttcgtcaagtatccaaatatcgggagtcgataagagagccccaatgacaattactttttgacgcattccatgagaaaaactttcaattgtttgatattctttcccttcaatatcgaaaagtcgtgtaagagtttctagttgtctttccttttcagaggtttcaagtgcaaaagctgaggcaattaaattccaatattctttaggagataattgtaaaaagatatccggagtatcaggaacatagccaattctttttttgatttctgaatgatgttcagcaagatttaaaccatcaactaaaacttgtccacttgtcggttcaataatactcgtcagacattttattgttgtggatttccctgccccattatgccctaaaaaaccgaatatttgaccttctggaattgttaaacttagatgatttagagcatactgcttgccatacatctttgttaattctctaatctcaatcataaattttcctcaattcattttatttttgatgttaaatgctatctttgcatttattatatcatagaatattctgaaaaaagtcaaaatcttgtatataagaaaaagaaacctactggtttcttttaagcttgttctgattttgataaaagaataactgaaacaataaccataacaatccccaccatttctagtagtgttaattttaagccaaataagggaatacttaaaaagacagaggttagtggttcagtggccgttgcaaccgaaacaacaagaggtgatattagctggaatgctcttaaaagcaacaaaaaagccaatgctgttcccactatagaaatcgtcaaaacgtaaaaaattgaaagaggttcaattcggaaattaatccgccaaaccggataaaagatattacaagcaattcccgcaagcatcattccccatccagtcatattgagcgccccatacttatccaataaaggacgtggaatgatagaatagattacgaccgcaacacccgcaagaaggcctgtcacaagggcaagtggactaattgaaagatgtttgatgtttccatttgtaatcaataaaaaaacacctatcattgctaaaataacaaataagaccgatttaggttttggcacttgtctttggaaaatgaataaataaagcataataaaaacgggtgctgtatattgtaaaattgtcgccgtggcactgttagacaattgaatggcaacataataaaaatactgaacagagaaaactccaccaaaaacatacaaaaagagcgttggcatgttcttttttgatttccagacatcaaaaaaacgcttatggtctcgcgaataagacatgaccagtaaaataataccagcaatcgttaaacgtgttgatgtaatccaaagtgggctaccatgataatcacggaataaaagctgaccaaaaatgccagaaattccccacatacaaccggcaacaactgcatagagcgtgcctttaaaaatttgtttttttacattcatttttatattatagtatatatcaagagggtttcacggggttcaatcatcattatattttatttaattctaaatacatggaatgaggatagaatagttagtaatattaaagggataaattcaactaatatattatatccttgtaataacataagaaattattacatttatcctttagatatagtgatttgtggtgggggcaatcattctcaattttcagctaaattaaagcttgaaggtgaatcacatatttcgcaaataatagatatatccaacctctattctggattagaatttgacggtgtaaattttattgatataaacaataaaaatgaaattgtaaaaagttgtgataatgagggtgaaattataatagggactttatttgaaattggtagattacttgtaaaacacaaagtatattttgacaacaaaattaagaaggcaactaaaaatgactagaatcggctatgctcgtgtttctagcaaagaacaaaacctagaccgccagttagaagccttacaggacgtttctaaggtgttttcagataaggcaagcggacaatcgaacgtcctcaattacaagccatgctcacttatttacgtgagggtgatattgtcgtggtgacagaattagaccgcttaggacgaaataacaaagaattaaccgaactgatgaaccaaattcaacaaaaaggcgcaacgctggaagtcttaaacttgccgtccatgacagggattgaagacgacaatttaaggcgtttaattaataacttgatgattgaattgtacaaataccaagcagaaagtgaacgaaaacggattagagaacggcaagcccaaggtattgccattgccaaacaacggggacgatttaaaggacgaaaaaagaaatattcttttgaagatgagggcttgcaacatgcctttgatttataccaacaaggattaacagaaaagaataagctgatattagcccttttgagggctttttcttttaactatgatatttaattaccaactcacgtttaaaatatcttaaaaggcaaactatgagcttgtaggactatttaaagcgtttagactaaacaaagtagccacgaccgttagggagttctttttaatggcagaatgtatctaatataaaatcagagtgtacaagcggagcgaccaaagcaacgcagggagtttaattttagaacctcaattcaatggttttgactttttttttgaccttgattttaagattttagaacggagtgaaaaaaggcgaagcctatatatatttatcttatatattttaatcttttgttcttttgcgtgaggaaaaagtcttttttttcaaggggatacagattttttaggagagaaaaaactatgtataaggagagaaaaaactatgtataaggagagaaaaaactatgtataaggagagaaaaatttatcgtctctctctttattatgatataataaaagcatgaagaaattccgtctaaagaatttttcttcatgcttaaccaaaattactcataaggagcaacttctcatggaaattataacaaaaaacgaccgaaacagcaatgaaaggatagtgtgttctttgaaagaaattgagaaacgcaaaatagtggagcataatgacttgataacatctattgccaaaatggataaagtccctttaaagatttttgagttggcggtatcctgcattgatacggaaaacttacccaaagaaaatacaatctatctttcaaaatctgaactcttttctttttttaaagtggacgacagtaataaacatcatcgttttaaagaagcaataaaggttatgcaaaaagaagctttttttgaaatcagagaagaagcaggcaagggttttaaatttaaaagcattgttcctatcccttacgtagaatggacagattatcatgatgaagtgaaaattgaatttcatcgtgaaattatgccctatctgattgagttaaagaagaactttacgcagtatgctttatctgatgttatggaattaaacagtaaatacagcattattctttataaatggttatccatgaattataaccagtacgagcattacagtgccaaaggcggacggcgagtcaaccaagtagaaagttaccgcaatccctcaatcaccgtcaaagaattacgagaaataactgatacgattcatgagtataaaagaatgcaagattttacacgttggacattggaaaaaccgttggaagaaattaacgctcatacttcttttaacgtgacctatgagaaagtcaaaaaagggcgttcaattgattctgttgtctttcatattgagaggaaaagaagcgcagacgataacagttacaagttagagaatacagcctatcaagagggtaataaagtcaaagaggaaaccgaagataagctagctattgaagcaatgaaaagcaaatacaccaagctattgattgaaaattttcttttgtcaccattagaaatgacagatacagcaaccatggcaggcttacaagcacacgtgtaccctctctatgacgagctgaaagaattacgagggttgaatggggtcaaagaccacttgtcttatgtgagagctaaacaagaagcctattcaaaacgcaatatagctaagtatctcaaaaaagcaattgaacaatacctatcaacggtaaaaaggcaaaatttgtaaggagaaatttaaattgaaagataaaatgactaatcaaacaattgttgatattagacaaacagaagatacagtgtacaatcctttagaaattaaagaaaattttactcaaactcaaattgaaaagacagctgaaatgctagggatagagaaaaaaatattaatacgctttaataaagatatgaaaaaacaaggaaaatcaataaatgttatcacatttgaaaagtggttaataaagcataacgagcaaaaaaccaaaaataaaaaataaaaatttgaaaattaaatgaacaaaataatcagtatcaaacaaaaaacaatatggtggtgtctattgccaaggtgtggaaaacaaattatggataatgaaataaaaaaagtttagacagtagctctaaactttttttattttttatacttatcaggtttttgttcatttatcatatttgcaaaaatttgtaaaagctgttctgtttcatcaacagttaaatgcttagcttcaagatatttttcaagtaaagcgcctttttgaattaattgccgtgtccgtttttttcgttctttatagttttcagaattattctgtaaaacagaacggttaattttaatttgaacttgttttgctttttctctttcttgaatcaacaaattttctaatttcttaatttgttcaaaatcaagttgttcattatcaaatttttttaaaattgtttcttgctgattgattgccttttctaactgttcaatcgaggaagataaatctttttcatttttaatagtcataactattactcattcaaggtggggacaccatctttgggaacaatgataaatgaagcgactaatccagaaacaatgactgataagccttggacttgggttccagcaacagtggtcatcctaattgtggtgcttgctattatctttatcggaaatgcactaagacgagtggctgaccaaagacaagctacaagataaacaacattcaagagtgataaaaatgtttatctattaaaaatggatatgataaattaaatattatattgaagcaagcaagaaataaaaagaaattattggagaaactaagatgaacaaattaaaagtaactttattggcaagtagtgtagttttagcagctacactcctaagtgcttgtggttctaatcaaagctcaagtacaagtacaaaaaaattaaaagcggggaactttgacgttgcttatcaaaatccagacaaggcaatcaaaggtggaaatttaaaagtcgcatatcaaagtgattctccaatgaaagcacaatggttatcgggactttctaatgatgcaacttttgctacaatgtctggtcctggtggaggtcaagatggtttgttcttcacagacagtggattcaaatttattaagggaggagctgccgatgttgctctagataaagagtctaaaacggcaacgattacccttcgtaaagatttgaaatggtctgatggttcagaagtaacggctaaagattatgaatttacctatgaaacgattgctaatcctgcttatggttccgaccgttggactgattctctggcaaatattgttggcttgagtgattatcatacgggtaaagctaaaacaatctcagggatcactttccctgatggtgaaaatggaaaagtcatcaaggttcaatttaaagaaatgaaaccggggatgactcaatcaggaaatggttacttccttgaaacggtagcgccttatcaatatttgaaagatgtcgctcctaaagatttggcttctagtccaaaaacgacaacgaaaccattagttacagggccttttaaaccggaaaatgttgttgctggtgaatctattaaatatgtcccaaatccttactattggggtgaaaaaccaaaactaaattcaattacttatgaagttgtatcaacagcaaaatcagtcgcagcactttcatcaagtaaatatgatattattaacggcatggttagtagccagtataagcaagtgaaaaacttaaagggatacaaggttttaggacaacaagcgatgtatatttccttaatgtactataacttagggcactatgatgctaaaaattcaattaatgtccaagatcgtaaaacgccattgcaagaccaaaatgttcgtcaagccattggttatgctcgaaatgtcgcagaagtggataataagttctcaaacggactttcaactcctgcaaatagtttgattccacctatctttaaacaatttacgagttcatcagttaaaggatatgaaaaacaagatcttgataaagctaataaacttttggatgaagacggatggaaattgaataaatctacaggctaccgtgaaaaagatggaaaagaattatcgcttgtttatgcggctcgtgtaggtgatgcaaacgctgaaaccattgcccaaaactatatccaacaatggaagaaaattggggtaaaagtgagtctttataacggtaaattgatggaatttaattcttgggtcgaccatatgacgactcctccaggagcaaatgactgggatatcactgacggttcttggtcattggcatctgaaccttctcaacaagatttgttctcagcagcagcaccttataactttggtcactttaatgattcagaaattactaaggatttaaatgatattgattctgccaagtctgaaaatccaacttaccgtaaagcagctttcgttaaatatcaagaagatatgaataaaaaagcttatgtgattccaactaactttatgttgaattatactcctgttaacaaacgtgtagttggaatgacgcttgattatggtgcaatgaatacttggtcagaaattggtgtttcttctgctaagttggccaccaaatagttttacttaacttttgtttacaagtttttttgtaaaaataccctcactttagttttcgcaattctaaagtcacagaagttcaaatttatgatttgagcttcttttattaaaaaaggagtttgatatgacaaggattcaagatgatttattcgctactgttaatgctgaatggttagaaaatgcagaaattcctgcagacaaaccaagaatttcagcttttgatgaattagtactaaaaaatgagaaaaatttggctaaagatttagctgatttatcacaaaacctacctactgataatccagagttgcttgaagcaatcaaattttataataaagcaggagattggcaaaccagagaaaaagcggacttttctgccgtaaaaaatgaacttgctaaagttgaaactttaaatacttttgaagattttaaaaataatttgactcaactcgttttccattcacaggcacctcttccgttttcttttagtgttgaacctgatatgaaagatgctattcactattctcttggattttctggcccgggtttgattttacctgataccacttattataatgatgaacaccctagaaaaaaagaattacttgatttttgggctaaaaacacaagcgaaattttaaagacatttgatgttgaaaatgcagaagagattgcaaagtctgcccttaaattcgatgctcttttagttccatcagcaaatacttctgaagagtgggcaaaatatgctgaactttatcatccaatttctactgacagctttgtcagtaaagttaaaaacctggatttaaaatctttaattaaagatttagtaaaaactgaacctgataaagtcattgtttacgaagatcgtttttatgaatcatttgattcacttatcaatgaagaaaattggtcactcattaaagcttggatgctgacaaaaattgcacgtggcgctacttctttcttcaatgaagaccttagaattcttggtggagcttatggacgtttcctttcaaatgttcaagaagcaagaagtcaagaaaaacatcaacttgatttgactgagtcttattttagccaagtgattggtttattctatggtaaaaaatattttggtgaagctggtaaggccgatgtcaaacggatggtcactgcaatgattaaagtttaccaagcgggtatactctgttggacacatcaaatccaaatagcaaatttgaaatggattatcaatatggtataatgggataagaaaagcgacaggaactggcattcccatcgcttgataagtcttcagagattggtataattagtgcttaccttttatggtttgcactttttttgatgcagtaagcttttgcacaaggaatttatatttcccatatgcaatgtaaaacttacctaatgcaccaagtataatcgcaatagcacaagctatcgtaatcattacgaaactcttcctttacagtaatagacataggactctatacctcctgttttcagtttaattgagagaatagtccccatatttactctgtaaaacttatcaggagcttcatagtagcgagctgtccactccatgaactaattataccatagagaatatgagacttgcagttaaattccgccttttttttcatcaaaaataatagatgtacacagtaattccaaaaaaagtcaaaaaaactcaaaactgttaagttttgacctcttttttgaatgcagatgaatagtgaggttagagcaggtcataaataagggtcatatttaaaagctaaaattgtacgttttagtcaattacatacaagcctatttaagggctttttcttttattcatgataaattattactaactcacgtttaaaatcacttagaatgcaaactatgagcttgtaggactattcaaagcgtttagactaaacaaagtagccacgaccgtcagggatttcttcttagtggcagaatgtatctaatataaaattagagtgtacaagcggagcgaccaaagcaacgcagggagttaaaaatcagaacacccattcaatgtttttgattttttcttttgaccttgattttaagattgaaaaaaatagacttgccttagcaagtccttttattaatttatcttatatattttaatcttttgttcttttgcgtggtaaaaaagttagtgtttacaaggttttacagatttttataggggaaaaaagcgatgtatataggggaaaaaagcgatgtatataggggaaaaaagcgatgtatataggggaaagaagttttactttcccttgtattttggtataataaaagcatagagaaattatgaccgcaaaatcactttctctatgccaccttaaaatcactcacaaaggagtaactttctatgtctattatatcagaaaaacaaaaaaatcaaaagcaggtgctgaccgtgaatgaccttgaaaaacgtaaagtggtggagcataacagcttgattacgtccattgctaaaatgcaaaagaccgctttaaaaatgtttgaattagcggtgtcttgtattaatacggaaaatccgcctaaagataatattatctatctttcaaaaaaagagttgtttgctttttttgatgtatcatcagcaagtaaacacacacgttttaaagaagccattgagttgatgcagaaacaagcttttttccaaattaaagaagtcaaagataagggttatgaaatgacaagcattgtgcctattccaacagttaagtggaacagttacaatgatgatgtaatgatacaatttaatcagtttattatgccttatctgattgacttaaaggcagagtttacgcaatataaaatttctgaattaaaagaactcaatagcaaatacagcattatcttatatcgttggttatccatgaattataatcaatacgagcattatagttataagggtgggcgccgagaagaacaagttgaagcctaccgcaatcccttaatcacagtgaaagaattacgagaaataactgatacggtttctttgtatcagaccttcaaagattttgatagctacgtattgaaaaattctttaaaggaaatcaacgcctatacgtcttttaacgtgacctatgagaaagtcaaaaaagggcggagcattgatagcattgtctttcaaatcgaaaagaaacgccaagcggacgacaacagctacaagatagaagaccaagcctatattgagggcaagaaagccaaagaggaaaccgaaaaagacttgtatacagaagctatgcaaagcaggtacactactttacttttagaaaatatgcttttaagtccgtttgaaatgcaagatataaaactcatgtcaggcttgcaggcacacgtgtaccccctttatgacgaactgaaagacttacgagggctaaatggtgtcaaagatcacctaagttatgtctctagcaagcgtgaagaatattctaaacgcaatgtagcgaagtacctaaaaaaagccattgaacaatacctaccaacggttaaaaggcaggaactttaaatgaacaaaataattagtatcaaacaaaaatttttgtgtaaagattgtgagtatattttagaaatttctcgtttaaaagtaaaaaaagcaaaacaatatggtggtgtctattgcccaaggtgtggcaaaaaaattatggataatgaaataaaaaaagtttagaataatggttctgttgcgaagtttgaaaatcaaacgcgttctctctgaactccaaatatcttaggctgttattcccattaataccttgatttcagtagacaccgaaaagcagaagagcgttccatttcttcggttctttttatatattcctcgaatggtctccatgcccttaatcgtggaagaggctgtacggagactttgataaaatttattccgtcgtctaataggtcgatggtcttgttctattaaattgttaagatacttcacagttcggtgctctgtcttagtatggctattaaaaatactaaagctagaaattttggatttttattatatcctgactcaattcctaatgattggaaagaaaaattagagagtttgggcgtatctatggctgtcagtcctttacacgatatggacgaaaaaaaagataaagatacatggaatagtagtgatgttatacgaaatggaaagcactataaaaaaccacactatcacgttatatatattgcacgaaatcctgtaacaatagaaagcgttaggaacaagattaagcgaaaattggggaatagttcagttgctcatgttgagatacttgattatatcaaaggttcatatgaatatttgactcatgaatcaaaggacgctattgctaagaataaacatatatacgacaaaaaagatattttgaacattaatgattttgatattgaccgctatataacacttgatgaaagccaaaaaagagaattgaagaatttacttttagatatagtggatgactataatttggtaaatacaaaagatttaatggcttttattcgccttaggggagcggagtttggaattttaaatacgaatgatgtaaaagatattgtttcaacaaactctagcgcctttagattatggtttgagggcaattatcagtgtggatatagagcaagttatgcaaaggttcttgatgctgaaacgggggaaataaaatgacaaacaaagaaaaagagttatttgctgaaaatgaggaattaaaaaaagaaattaaggacttaaaagagcgtattgaaagatacagagaaatggaagttgaattaagtacaataatagatttattgagaggagggattattgaataaataaaagcccccctgacgaaagtcgaaggggggttttattttggtttgatgttgcgattaatagcaatacgattgcaataaacaaaatgatcgatgctgtttggcaaaaaaagaaaaagtgattaatttatattttatttatggcgctaatttattagcgctttttttgttgtcggctagccgacttctgatacatttttttaagcacaaaaaccacccaattttggagtggtgtgtaagtgcgcattgctttaaaaatggcaatgaaaaaaaacccaaagaaaatcttaaaggcgcacttacacatcaaataaattgatgtcgtgctaaaccctaaaaacctgtataagaagtttcctttggcaacaacaaaaaaatagactatggggattggggcaacgccccaaaaataaaaagaatcgtctgaaacgaggaacaaactaaaatgtaaattttaggtgtgaccgagtggaagatgattctttttaccgtaagtgtatatccacttactaagctcgctataatatattataacgtttttatttacatgagcaaagcgagtttttccaacacgtctaatctaaaatattggcaatttataccatggttttcatggtatataagtgcgcccttaggaaaataatttgaatatatttcagattttcaatctgactgctcctgtcatcgagcaaaccgatgaggaaaacaaaaataggactaaacttttttgtttagtcctatttttgttttgaatagtactagaattttatatcaaaggcatacatattaaatatatgaattaggaattcagtcccttaatgaacccatgataaaaatcaatataattcaacaaattagcgcagatcacagtaatacacaataaaagaattattattttagtggattttttaagattgattatttcttgatatttaaaaattaatataataacaagaactactgaggccattgatgaaatatctacgattagctccatgattgtatcactcctttaagtttactaaattatcataacatacttcttgttttagtgtccctagaaggtcatattttgggttttaagcatttttgactaaccgtacggataaatttactcaggattaattaaagggctgtaacgggcttaaaatcgtttctaagaggatttagcgtttatttcgtttagttatcggcataatcgttaaaacaggggttctgatttgcggaaagggtttaagcgtagcgtcccttgtagctaatcaggttcgctgttagattatgaaagccgatgactgaatgaaataataagcgtagcgccccttatttcggtcggaggaggctcaagggagtttgagggaatgaaattccctcatggttttaaaattgcttgcaattttgccgagcggtagcgctggaaaatttttgaaaaaaatttggaattttgaaaaatggggggggtactacgaccccccattaagtgccgagtgccaatttttgtgccaaaaacgctctatcccaactggctcaagggtttgaggggtttttcaatcgccaacgaatcgccaacgttttcgccaacgttttttataaatctatatttaagtagctttattgttgtttttatgattacaaagtgatacactaattttataaaattatttgattggagttttttaaatggtgatttcagaatcgaaaaaaagagttatgatttctctgacaaaagagcaagataaaaaattaacagatatggcgaaacaaaaaggtttttcaaaatctgcggttgcggcgttagctatagaagaatatgcaagaaaggaatcagaacaaaaaaaataagcgaaagctcgcgtttttagaaggatacgagttttcgctacttgtttttgataaggtaattatatctattaaagattttaaaaatgaaatattggtagaggaggggtttggaaaatttcttgatattgatgatcaagaatacattgacaaaggatgtcacattttatcaagagctgaagtttttgcggaatcagaagcaatcttctcactaaaactcatccagcctactgactattcccatcttagagagggacagatgataataggctggacacatccttttggttcaggacaatcgttcatgaaagagcaagctctgcctaaaaagttaattgttgtagatttagatagtaactcgccttgcatttattatgaaaatgagatatttgaatcaggtattccaaagggactattatataaaaatagtttttacgcaggctatgcaggggttatagacgctttgttgcaatatggatttattccaactgaagagacaaaaatagctattttaggttctggaaatgttgcgcaaggtgcctttagtagtatctcaaaatattcctcaaacatccgaatgtattatcgaaaaacaatgtcaattttcaaagaaaattatacaaagtacgacatcattattaatggaattgaaattgggaaagatgatgatccaattttaagcttttcagaacaaaaatcattgaaaaaaggggcattaataattgatgtagcagctgatgctggaaatactattgaaggaactcattttactagtatagatgcccctatctacgaaaatgatggaaaatactattatgttgttcaaaatactccatcactcatctatcgaaatgtgagtcaagaattaagtaagaatttgagtgagaatatttttcataaggattgttccctttttattgaaaaggttttacctcttaaataaatgatattttatattttgattttttaaattatatactatcataccaagtgtagaaagccacaaaatataaagatagttctttacctaaataattgtatattagatggcgttataaatttattgctttttattgtggtattaaagtaagaaaatgcttggaatgcttaaaataagtgattttgaagtttgataaaataaaactaaccaaaaaactaaccaagtaaagaaaaagtgtatataaaaaatttattaaataaaaaattactggtaataataactagtgattttttatttagtaaatttctcatagttttaatgtgtcttatacgctaaaaattatagataaatatttttggtgtaaagtatatttgactaataaaatttttgattttttataaatataggtatattataaaaatagattgataattatttcacaattgtctatgaagtttgaattttacttagttggagtatatatgaaaaagctcactaaaaacattgttcaaaacaaaaagttcccaaaaaactttttgacatatgaacgagtacatgttggaatatatttatttttgctactacttatttgtgtattttcaattcatacgttatttggaaaaaaacctaatccaatggtaacaaaggtttttaatataatagttttatcgttaattatcgtactactattttttgtctataaaatgtctatttttatatttaaaggttcttcaaaattgacaagacctcgtatgggtggggtctatataaatcctaaacatcctattggtagaataatatttctcattctatttataattccgatagttatgataatcttagtattactaaatgtgccagttccaattaattatccttaaatcaggtaataacattttgtttattataaatttatcataagaatacccttatcatttatttttgtgaaaccttttgagattaatagtacttatggggggctttcaagattttgggctttttatggttcgggatatgttatgacttccatacttggacttattttcttatttagtctattgtattatgctatatttcattgagatataaatcagataataagtcataaaaatatattctcttaagattaaaaaagtgcacgcttttttctgaaatgaaatcaaaaaaataagaaaaataagaaaaataagaaaactactaaacaagactagtttagtagttttcttatatattttaaccgatcgatttagtcctgttgtactgtaatttgtggagatataattttatattttattccataaaatacttcatatcctaaataaaaattatcttgtaggtttacagtattcgtaccataactaaaagcattttttgatgattttatatttagttttgcataaaacggttcagcaccatttatagcataatatgaaatttatttatgttataaatctacctgatattcaaaaaaaagccatttttgacagattaagcacatttcttttttctccttatgagttagactcttaaaaatattaattggagggctatcattgtgctcattacttaaaatcattgtggaactattggcaggatcatcaattaaacctatcagatattttggagatacattgaagtattctgataatacaattaaccttattccagagggctctcctcccaacttataattactcaacgaatttcttgggtatcccaattctctctctatttgatttgcagatttaccacttttttcaatcaagtcctttagcctacgataaaataaatcattcatgaatataatctctctttttattcatttctttcaggttgattatgcccttttaaacctataatgattgattgtgcttgttttcttgtcatcgttgtaagggtgccagtaaatacaaaatactcattctctagcattaaaccacctctgctgtttttctgaatggattcgatgttcaacttatttgaccttctaggaatccaattatatcagaaaataaatataaacctttgaagtatactctgttgtcttttatgttgatccgttggattactctggctatctatctctatcattttatattaaaatattagtatagaaaaattttgtaatagaacagggtttctgataaggagaaataattatgtgtaaattaattggcataggtggtttcggtagagttacttttaaagaaaatcaaaaagaaatcgctaggaaagaattattactagaccacgttactaatgaactcgcccaattaaggtttaaaagggagattgaatccttgagaaaaataaaatcagaatatattgttaaaataacagattatgatgttaaataccagtggtatgaaatgccttattacaaatataatttgttaacctatgtccagagagaaaaagggagtgaagatctttcaattgaaaaaattattgatagattgattaaaggaattaaggtattagattctgaaaacatggttcacagagatataaaacctcaaaatattttgatgaatacattggatgatgtagtactttgtgatcttggattggttaagaccgaaaataatacgacgttaactgtaacacacaatgaggtgggaactatgaacttttctgctccagaacagttcagggatgcaaaacatgtagatataagagcagatatttatagtattggacgagttatggaatggatgttcgaaaaagtaaattcgtacaaaaataatacaactaatgtagttccggataactataaaagctttattagaaagtgtactgcttctaaagaagatgaaagatatcaaacagtagatgaattacaaaaagcttttaaaatgagattaaacgacagtgtcaaagtggaaattaaaaaaatggttaatgatattctcaatgattcagaatcatataaaaactttataggcttgaatgaaaaggatttcgaaaaaattttggaatctgatatgtataaaataataactgaaggaaaaatagaagaatggcttcttaacgattttgaatcatttgattgtttatataatacttgggataagaaaagaatccagagttatgaacaaaaatcttattatccagcagtcaattttgattccattgcaacaaatttttatgattacataataaataataatattgatataagtacaagaacttccttattaaaaaaacttattaatcactggggaaatcgttttaatgtaatgtatgtaatattcaatatattatcaaataatatttgtgatgatgatttttatacaaatttagttgataatttaactactgatgaattcagcaatttaagtaatttctataatcaagttggaaaaaattacaataatatctccgaatatataatgagcaggattgaaaatagataaacgtacaaaacgccaattgattgtgctttattgtctcttgcgcctataaagtaagaaaccttggtaagtcaattagaaaaaataaggagaaacgaatatgaaaaaatttaacattgaagattgggaaatagatgtagagcaagaaacaggaaatgacgattatatatatggcaattatgtagattgggatgaatttagaacaaccgaagaagaaaatctactttcttattttgaggttgatattccttggggtaaagaaatatcatgtcaagaattttttgattttctaagtcaagaagtgttttataatacctcaattattaacagttatccatttgaagatttagaaatcatagaaacaggtccagtcatgtcggatttactttttttatttccaagtcgtaaagatttggaatatgatatgttagtatcagatatttttgattattgtgaagttccatcaggaacggcttatgaagatgatttaccacaagaattacaattttggtattcaatgatggaagaagaatttctagaaagtgaatatgagtactataagaattatcctctaggatttgcaaattttaatgaatcaatacttgatataaaatcaaaaatgtctagcgcgtcagatacattgactaagaaatcattgctgttatcatcgtttattatcagtgaaagtttatacaagtcaacaattgtaagtaaaataccaactgagaataatattagcgagtttagcaaagaaatcttatctaaatcattgggagaaaaattaagaggaaatgttgataccagaaataaactttttaaaaaaatatttaacgtaaaatctccaaaacaggaatggatagcacttagaaattcgttatctcatgatattgagtcctcaaaattggtgggtgattgtataagctatataaatttaaaggacggcaaagaatacacggaaaatatttatgatttatttgagaaacaaattaatttttatgaagaattaaaatgtattgtcgaaactgacaatgaaaaataagtagattatagaacaaacaaacgcaaggtcaggttcatctattttagacaaaataatagaagatacatatgaacggttcttcaagtaattttttatcttgtaaagctaatcgttgttgctggtctagcaaactagtcaaaatttctatttgcttgttttgagcggttgctcctttgtacgtttcatcttctagcttataactgttatcatttaaaatcttttcggtattgaagaaataaatatagtccactaacaaaacaagcaatcccatatttaaacataaaaaattgattgactaaatatcctcttggaaaaaacatatcacatgcgataatagcaaccaacataacgtaggcgctttttaaactaatcaacaaggttctttcgtcacttttacccatttttatagaataagtaactacaaaaatagcactgaacataacaaatataaaaccaattcccacaagtagattaaaattgccaattgattgttccgaccattccttcagaggatagaacatggcttctggtatatcacttaaacttttaattttcattttctgctcctcctaaatcataagaaaaaatatctgttatatctactttgaaaaaagttgctattctaaatgctaacaaaagagtaggaatatacttccctttttccataacaaatattgtttgtttagacactcctattttatctgctaattccttttgagataatcgagctaatacacgaaattcatatactttattgttaatggaatcgccaaagtcttttttcataaactgacctccttaaaacaataatacaacaaacttttaaaaaaagtaaagtataattatatttaatatatttattatttacttaaccaaaaatagaaaactagtcataacttcccatcatgtctaatttttaaactttgagttgatatgagagcgcaaaattacttcctagatttatcgtttacaatcagtccaaagtttcaggattttccattcaaattatgttttaatagtattaaaataactgatggagaatatttaatatgaaaataggtaagcgaattttattaggtttagtggcagtatgtgctttatttttaggaattatctatttttgggggtataaattcaacatatatttagtaccaccctcccctcagaagtatgttcgagttgccttaaaaaatatggatgaacttgggctatttattgattcaaaagaatgggtagaaactaaaaaaaagacgatagaagaaacatcaaatgctaaaaactatgcagaaacaatcccttttttacaaaaagcgattaaagttgcaggaggaaagcattcttttattgaacatgaagaagacatatcaaaaagaagcatgacaaaatatataaaaccaaaggcagaaatcgaaggcaacactttaatattaactattcctgaatttactggaaataatagtcaagcatctgattacgctaattttttagaatcttcattgcataaaaacaactataatggggtaattgttgatttgagggggaatagaggtggagacttatctcctatggtattaggattatcccccctattgcctgatggaactctatttacttatgttgataaaagtagtcattctaaacctgttgaactacaaaatggagaaataaatagtggcgggtcatcaacaaaaataagtgataataaaaaaattaaaaaagctcctattgctgtattaatagataataatacagggagctccggcgaattaaccgctttgtgctttaagggaatacctaatgttaaatttttgggttctgattcagcaggttatacttctgctaatcaaaccgtctatttatatgatggctcaacattacaaataacttctgcttttgtaaaagacagaacaaataatatttataaaaattttcctattagtccggacattcaaacaaataatgctaaaagttctgcaatagaatggataaaatctcaaataaagtaaagcaaaaagacttgccaagaaaaacatatggtaagtcttttttgctagtcaaaacttaacgttatttactatgatataccgaaagcaagtaccaatgcaggtaaaatgttgtttaaaaagtgtatagctatactaacttctaatcgtcttgtcttaaagtaagctatagcacaggtcaatccaattaaaccataaataagaaaactgatgatgtttgttggggagtgcatcaacccaaaaagcacactacttacaataattccaacaactggaaggtctttaaataaatagccgacaattcctcctctaaatacgatttcttccattattggagctgcaataccaataagtaagataattaataatgggttttcacctgtaaaaagttgtcctatcgcttcatcatttgccgtctgtgtgactcctgtggcattaagcaataatgtaccaccaattccgacagtccgagcaattagggtacccactaagatgtatataatgtttttcttagtgaggaaatctttgcttggcgttaaaaaacagcctaagatatttggagttcagagagaacgcatttgattttcaaacttcgcaacagaaccactaaatctgtttactatgtaaataaaaccaaccacgtaaatagtacaaaaacaagagatgtaacaaggtatataactttaaatcaaaaactcttgaatactttgaaagagtggaaaaataagcagggtgaaatactaagtcaatttaccacttcgacacaaaacttgcaagttattcaatcaacaccagtaacagtaactaaaaatatgattgataaaaagtttaaacaaatacttcaaagagaccctagcttgaaaaggataagaattcatgattttagacactcacacgcttcattattgattaaccaaggagaagattacctagtagtaaaagaacgtttaggacatgcttctatcacaactacgatagatacctattcacatctataccctagcaaacaaaaatcaatagctgacaaattagataatttatattaaaagcctctaaaatcataaagtaaaagtgaaagtttttcattaatcgcaataaattctaaaagatattctttagagataacaaattgtaaattatcatcttttactttagtcttagttgctaagatctgtgaatcatcttgagtaatttgaaagctgtgaattattctatttcttctctttacaaggtcaaaaaaaatgttgacaatatcttcaggaaaactttcttccattttcttaaattgtttttgtagctttccagattctaagtccattaaattgtaccaactcagatcattcgaattagctaaaacattttcaataataaaactattatttgcattgaaaacacataaacaagtacctaataattcacggtactcctttgatggcaaaacctgtcgtgtataactttcatacataatatcacacctcaaaataatttatggtaccattttggtaactgaataaattatattatcaaatatacaaaaagacaaggtttcttgaccttgtcttttttgttttttatgtatattatataataaaagttactaataattactatataatctaaagaaggataattttatgaagactctctatcattatacatcggttgacacgttgctacttatcttacagaataagactttaaggtttaaaagtttgctttatgttgatgacccattagaacctacaacttcagacttcggcaacttaggtggatttaagtatgtttcttgttggactgatacacctaatagcattccacaatggacgatgtattctaataatatgactggagtatgcataggtatcagttttgaaaaagaaactgaggtttttttgacggaaaaattttctttttctaaatcttctgaaccaattgatatagtaaagatattacatcctttgaaatcaggcttattagttactaataataaatatgtgccatctttggaacaaatacagtatactgatgatatttccttgactactccacaggtaatttcctcaaatgaaactcatacatctattaatttagtttcaaatggaatatataagacaactgagtggagtttccaaaatgaacaaagattttctttccagatttttcctctatcaatagatttaattttaaaatcaatgaatgcaaatgtaggagatatgtctgaaatagtaaatagttttacttctgttcaacccacagaatacttggatttagatctaaatccaactatattcaataatatgacaattacttttggcaaaagatgttcagctgaagataagttgaaagtaaccaaatttttagaggataataaattagatattcctttatttgatagttctgttaatataaagccttaaattaggttatctaatttgtcagctattgatttttgtttgctagggtatatatatagaaataggtatataatgaaatacattcatagggaatgaaaactaaactattgatgatagttaataaaggagattaaaatgtttagtgaaaaaaaggttgaattgacagaaggggaaaaactcttcttggatagtatttatgatttaatattaaatcctgatattactgaagaggaaagaggcgttttgatatcagctaaaacagatttagaaaaaacgggatttttgcccagagtaatgaaccaactcatacttgcttttagaggaaatgctattaatagaacactaacaaaacctgtttcaaacttttatgttaatttgtacaataccacaagtcttatggagaatattagtggagcagccaccttatccgctgctatgattccaatttggtcggttggaggtaataattgaattgagaatactatttaacaattaatatcagaaagtaaaagaagtacctgtaacttttaattactcaggtactttttatatatatcaatttaaaaacaggacaccagggtatactcttgcctgcttgactaaaatctttcgtttgaacacattcattgaaaaacataactttcatgcttggattttcaaagaactgtttttctatttctgataagtgagtgtgtccttcttctaataaacctgtaagcaagcgttctttcgttgcggtatcgtacttcataggttgtctatcattcaaaacatcaatcactactttttcttcgagttggtcgccaaaatagagaatagcattgcacaattgctctttttgtagtccattcaattgctttctgtcaatcattggcaagtgttcttttatcgttgtttcatggtaataatgaacggcttttattgccatttcatagcgagcaaggggttggataatgccttggaaagcttttttaacttcgtcggattgacgagcaacactttctttattctctaactgaatatcgtgtttagcacagaatgttttaagaatagcttcttgtttattcagtttttctttcatcacacgaacactgatatacgggtcttttaaaagcaaggatagattgtgtgacaattcctgttgttggcttttaaataaaatttgttccgtttcttttaagtcaaaaagttgttcattatgaatggttttatcaactaattctcttgccatataaggactaagtgcgtttgtattgacttttggatagtgagcagaaataaaccgttgggcttctttatttaaaagaatttctgcttgttcaaccgcttctttttggtctttaattttacttaaaatcggttcttgttcttgcccattcgtcatcgcttgtttagctagtgcagagtttttccagttatttaacatacgctttttatcttccaatttctcaaaggaaataaagacgttaagttctttagaaaggtcagataaaatacgtttttctttgggcgtaaaatgacgagtaaacggatttgtttggttcttttcttcggtttctttttctagttgttcttgtttgtataagagttgattatactttttaatttctctattgatgtccccgttttcactaggcaatccttttaattcaagttgatgggcatagcttccaaggtgttttgttgggagttctttctttccttgttctttaaaacttttatccgttacggttatgtttaatccttttttttctaaagagtcattaatcgcaattgcccaattttcacgccattgttttaagcgttctttactatcccaatccgttgttttttctgtggagcattgataagttttcttttctttatcgtaaattttgttgccttgttcatcatagtgataaacttttttttgacgagttccccaatccccgttttctttaaatggacggtttgttgtcataatatgagcatgaggattaccgtctttatctctatgaatagcaatatcagccaccatgccatgattgacaaaattttcttgacaatagtttaaaaggagttcttcttgttcttcttcgttcaattcagaaggcaacgctaaaataaaatctcttgctagttgagcattttttgatttttcgattttttctacttcgttccataatttttgacggtctaacgtccagtccggtgcattgcttggttttaaaataaaagttttaggagcaacacttcgaccatagaaattaaatttgttatagcgttcactgtataatttttccccactacgataagaggcgctagcaattgcagactgtcctttccctcttgaaataactttagcttcaaaatgataaatagccataagaagtgttctcctttcttttttattttttacacgagcaaagcgagttttttcaacacgttcaatctgaaagattggcaatttataacatgatttttcatggtatataagtgcgcccttatatcttatagggatattttaccactttttattagtattttgtacttatctgtcttttgccttattttgttggatttgatagaatataattatcaagaagtgtttcaaataagaaaggactaggaagttatggcaaagaaaaaaagcttggaagatttacaaaaagaattagtaaagaaacaagaagacattaaaattatcaatagaaaaattggacaacaaaaaagatacattaatactcgtattggagaagaactcttaaaaggtttagaaatttctatttctgattttgattcagaagataagattaaaaaatttgtttctttagtcatttcaaattcaaaaaatgcagttcatcaacaattcaaaaatacgactttagaaaatgaaaataaatttagttcttctttgattgagtgaactaatgataaagaatttttgtgttttttttctgtcattttcactccttattgaatccgaattcgtgggtcaaccattgccatgataatatccgacaggagggctccaagaagtcccaaaaaaccatttaataaaatcaaagccgtaatcattgaataatctcgcccagatattgaagtaataaaaagttgtcctaagccaggatagccgaaaattgtttcagcaaatattgctcctcccaagagtccagtaatcacaaatccaaaattagaagcaattggtaatgaggcatttctcaaaatatgacgtctaaaaatcactttttccttaacccctttggctcgagccgttcgtacataatcttgtgtttgttcatctaaaattcctgagcggaagtaagtaaagattccaactgttccaaagaccgccaaactaaaagccggaagaatcatgtgataaatcttactaaagaaaacaggaattattcccatcgcatctggacttaccgtcccacctgtcggaaaccaattaagactataaccaaagataaagataatcaagagatagaatacgtaaggtggaataccaaaagtaattgaattataggtcaaccacaattggtcttgccattttccttcatttcgagctgcaactatcgacatcggaatagcaaataagtaagttaaaataactgacaaaagtgacatccaaaaagtattaatcgctctatgtccaatgacagtcatcacaggctctttgagattataggacattcctaaattcccatgtatggcattccctagccacctgagatactgctcccaccaagggtcatataaacctgctgcccgtcttaatgcttcaacttcatgtgggtcggtatgaggaccaatcaaccctgaaaaaggatcaccaggcatcaatttagcaaagaagaaaacaagaatactcaagataaataattgagggatcatcaataaaatacgtctaataattactttccacattttcccctccttttggcaaagcagcccaatgactttcacttaatttttttaagggcaaagcgtgtccatctttgtcataaaaatttgcttttttatcctcaaagtcttgttcaacttttagacggtttttccgattttccgctcttcttgtaacatcaatcgaagggatagcagataagagtcgtttagtataaatgtgctgtggctcatcaaaaatatctcttcgtgttcctttttcgacaattcgaccgttgtgcatgactgcaatattatcagtcatatggcggacaacccctaaatcatgagaaataaaaagaaatgcaattcccaagtccttttgaatgagcttcatgaaattcaaaacctgagcttgaacagataagtctaatgctgaaactggttcatctgccacaattaacttaggattagtagcaactgcccgtgcgattccaattctttgttgttgacctccagaaaattggaaaggatactgttctaaagcttgtttaggtagtccaacaatatccaataattcatgaatccgtttattttccgtattagcatctattttttcaaaatttcgaataggctccgcaatgatatcgtaaattgttttccgtggattcaaactcgaaaatgcatcttgaaaaatcatttgaacatctttattgtatttgagctggtttcttatcttttttttgctgacatcttgtcctttgtaaatcaattgtcctgatgtcatttgttctaaaccaacaattgttttgccaatcgttgattttccagagccagattcaccaactaaaccgacagtttctccttcatgaatcgttaaatctactccatcaacggctaaaacattatctgtcactcgattaaagaaaccagatcgaataggataataaacttttaagtcctttaaattaagaatttcgctcacttttccttaacttaatgacattggagtataccctattggccgtttttgatccattatcaatggctttttaaattagggcctagtacttttggaatggaaatactttcctacaccaaaaattctagacccaaataaatttacctacgggttatttggtttttctccaccaaaccaaatataatgaatttttctaggtatcatcttgcacctcattagattctattaataaatttattcacattaaaatatttgttctgaccaaatggttcatttaaatactcaacataatctttcttatttggattatttacttttatgatgctatcaaaatcctcaaaaccgtctcttacagtaaacgcgattttatttggtaaaggtagttttgcaaattgtataagttgctcattagtacaaccattttgatcattaaatttgaatataatatggtcccaacaaattctatctattcttcgtttccatttgcttttcgcgctctccctattcttataatgcaaaaagtatatttcaatatcgtcaagtactcccacaggataactgccataattaggatctaaattattaataatatattccttattttctgaacaatttggatctataaattcaagtttacaatgtaaataatgcttgatattactaataaattttaaataatcaccaggtaaaatgtacaatccaatcgtcggactttgcttcacaaggttatacctttcatatattccaccaccccaacaattattagaaataattgtaaagcgggtcttattaagtttctttctcctataatttctcctataatttgacaacttatgacaaagaaatgtcttataacgagcaataattggactataaatatccattaaaaacctcctaattttatttctgaattagttctaaataatatttagataataatttagccgcacgaggagtatagaatgaactctcttttaaatcacatagatactttgatctgttaatttttctcattgattgcttaattatttgatcattccactcatttaatgatgattttaatgatacaaagcaaacttcttatttctaaatctatgattttgatcatagattttaacattttctccaagaatactattatcaccaataataacggatttatttgctgaaatagacaagccattgtttacaaagacattttttccaaaaacaatttgcgctttatctgttacaaacaacgaaaaacaccctctggatctaaatccacgtttaaaaattacttttttaccgaaaataaacttataatagccaattaatagccatcttcccaatacaccagctttagctgagtgcaaatgaattatatccgggttaacatttttacatatctttttgatttcaaagaaagcttttatatcgtgaattgatatttgacgagtaaaattgttgaccttaattaaatgcacatttttattaaagtagtctttataattaatgggcgtctgttttcgaacagcgtatgctacataaacacaaaatcttctgataatccattagctaaattggtaatatatgtgaaaacaccgccacccatggcctctacaaagaataatacctttttttcctcgtcacttaatataatcctattataacatactctccagaaaatggagaaatgctcttatgctagatttacggacagattttcttctgccctgtaaactaatagcataggagcattttttactggaacattccaagaaacatttggaaaccagataaattgatgttggggaacgataagctgattgttttcgtccgcatcataatagttaagataaacaatatcacgaacttgtgtggttaaatgcgcttgaagcgccgaaccaaagaggtcatagcgaaccccttgcgaatattgataagaatctccactacgtactggtgctgggctgtaaaaatcatagtcaaagtttgacagaaaaccgacacccagataaccgccataagggagactagcttgaccattcaagtcggtatcagggcttgtcgtatcataaataacaccacttgaatcggtcgcaagattagtggtctttggaatgaccgttaaaaggttggcaagattggtcttgaatccttgtgccatatcaatatccgttgtgataaaagaggcgagaacagggatttgaaaattcgtgttatgggcgacgatttgataattgaggttgacattatttgccccgtagtagagggcgacaatcgagtttccgtcggagttggcaatgttttgttcgcctgtaaaagccaatccaatcggacagtcagacgtactttctttgggggcttgccagcttgattcatctgttgaaatgactttgtagatcaaatctagattggttccggctagggtccttccaacattagtaattcgtccagaatctcctgcattcatagtataagtggtcgcaggtatggtcgggccatccgtttgtccaaagttttcagtactgatttgatctgttacctgacctgtgattggaataacctctgtatttgccgaccaatgaagaccatcaggcgttaaaaagttatttggcacaaggttgttagccttgattgtaatactgacatcatccagtgtggacggacccgtaatatcattggcgactgaacctgtcgcagaaatcgagcttatgacagggtcttgaccattggcttggctggcaattgaaccatttgtgagagcaggacttatgatttttccgctcgccgataggcttgaagcaattgtgacatttgcttttgatgaatcaagaggaacacttggggcttttgaagttaaggcctttgaactcaatgaagctgaaacctctgaagaattagagcttgcttctacacttgaagtctgagccgaactggttgaagatgatgaaactgaactggcatttggagcggtgcttgcctgtgaagtgattgagcttgctgctttagtttgcatttctgcctgtgaactttctgtatttccttcggttgtcgaatcagacacggcaagagaagaatttacagttggattggtgacagcttctgtttggtttggtggggtaacagccgaattttcatcagcctttactgctaaagggtgactaatcactaacaaacttaaaagaattccagtgctaagtaacccaaatttacttgatgacttcatctgaaagtgctttttctgattttccaatgcaaaacctccttttagtgaatgttttttgttttctgattatttaacattatacgcttaattagaaactttagtaaaaataaagtaatcccaatgtcattaagttaaggaaaacagtatcattttattcttaaatattttgtttttctatctcattgacgttctaatttcataaatgaatcacgcaaaaaaacgtcctacttgtatagtccgattgataatcttaggcaatacgatataaaaaaccaggaaatttcttttttattaatcttctttgatcactccgattcggccttatgggaagaagatatcggcttatcaattgctctacattgacgttttgatcaaggaaaaaccgcctacaaatcccaaaggcctgtgtaaaattaatctggtaggagtgttttaaacgattagataagaccacagccaaagtaattgtcattgaaaaattatacataatgagacgggcaaagatttcttggataataaagtcaagcttctttgaatggaagtggcttaaacctagagcatatttcaattctctaaaggaagtttcaattccccaacgcaagtgataaaggacttttaggtcttcgcttgtaaataggaacggatccagatttgtcactaaggattcataggtgtcctcattcaacttaattctaacgactctgagactgatcggataagtttctttggagcggataggaagataatcaaaattcgctcttttatgcaagaaatgataatgtttatctttttttaccttatttgtctgtcttcttgttaattgaagggttatttttttatcaaatgttccatctgatggcaaatcaaggccattaagcaacccattactctttgtatcttttgctcgaatcaaaaatttttgtccgctttttttaatgtgttcataaacattaaaagattcatacccacgatccgcaataataattgttggacttgtgaaatcaaaatcatcaactatctgacacaaacttttacgttcatttaactgcttaattttttgaaagtccactgccacgtagtgtttatttaaaggatcatataaagcattaaggtgaagtgatccaacatgcttcccaaatttcccaactctataatgggtatctgattctttttcattgtaagggatattaagatcagaaccatcatgggcaaatattcgatagcctttgtataatttattgggttgtgctgaaggaatagttcggtaaaagagttgctcaaatgcttttaactttattttactacgagcttgtaccaaagcagacgcggtaggggtttttagggtgaaattaaaatgtgagagtaattcactagatagactttgccctccaaaagagaggatgattttaatcgttgtctcaaaagataactttctatttctagaaaaatcaaaaggagattgagcataaatttcaggatgattggtaatctcgtggatttgatcttctaagtttttctttatttgatgagacacttgaagtgttgatggaactttggtagtattaagcaataggacatccctccagaatacgtaacgctttgacgttttattattgataaaataattgtatcaagagggtgttcttcttgcttagaataaaataaaacaggaggtgattagatccttcctgttttaaaacattaaaagctgtgtttgataaaaactatacgaatgtcaaagatgaacttaacaaagaaaaaaatgtggaagaaaaaaactactaccgcaacaatacaaataatttcaatctgctcaaaggactaggaacaaatctactctttacgattttacgaggggaaagcgaacctgaacgtcccgctcataaattgaagaagaaaaagcataaaaacgatagaggatacagtccaagaatgtaagggttctgttgcgaagtttgaaaatcaaaggcgccctctctgaactccaaatatcttaggctgttactcccattaataccttgatttcagtatctactgaaatcaaggtattaatgggaataacagcttcagaggaacactggtcagaaacgttgttttaaaatttcaaactttgcaacagaactgattgggttatactggactattaggtgaatttgttggtagacggctattgactacttctgttgttcccttcgataaaatcttttaatttataatactctattgcctgttctactacatctctaaaattataaacagataaatagcctttataaattttccttctattaatctcatttttactttcaaaatacctttgaaattctaaaaaatcatcataaatatctaaaggaatatccttaaaaataactcggctcttctttaaattttttagtacatatgaactttggattattgtttttctatttaaatagtgttctgctaagtgtattgacgtatttgactcaaaatctgtcccaattaatactatttttgcattattattttttaaatacaattttcctaatggggagtgctttcctaatccataatcaagttcttgagtatttaagtatctcgctaattcaccccaaattgcaaaagagtatagcggatgtgaagttctaataacaccattaaattttctaaaagtttccggtatcactccaattccttttgatacaggagtagtatctttgttgtatggtaagagagcttttcgaataatgtcccaaaattcaggagctactggaggatacaaccatgtgcttggatcactcatctcaatggtctgagtaggcattataattgtccctttttctcccaccctgtctataatggcatttattactgcttctgcacccccaataacataccctaaggatttcaatgaggaatgtacaagtacagtatcgccacgtttaatatctaactctgtaagtatatctacaatgtttttttgggttaaaattggttttccatcaatagttggtgccatttttttacttttgcattaatggttacacattaatacagcctttctataattttcatatacttaaacccgaattgctagttgattatttagccgtgacttgatacccgatagaatatcttaaagtctcttggagctatactataaaagtagacacaaatatgtgtgttataatctgtctaggaagacagaaaaatgaaaggacttttatgtcaggatttaaacgttacgacgaggaatttaaacaatctctcgtcaacctctaccaaacaggtaaaactcaagccgaactctgtaaagattatggcgtctccacttctgcactcgcaaaatggatcaagcagtattctcaagttcgacttgaagataatacagtattgactgccaaacagattcaagaattacaaaagcgtaatgcacaattagaagaggaaaatcttatcttaaaaaaagcgagtgccatattcatgcaaaactccaagtaagagtaaaagccgtctatcgactccgatttgaacacacgacagtcatgctctgtcgtgttttacatgtcaatcgttccacctactataacttcattaacaagaagccttcaaagcgtgaaatagaaaatcaacgcttgagaaaacacctccttgagatttatatgaaagccaagaaaagaattggaacgagagcttttaaaatcattcttctgcgtgattatggcatcaatatttctgaagggcgtattttacgacttctcaaggctatgacactccctaaaatgtcaacgattaaacctcgttttaaatcaaaccactctcctatattttcttctgataatctactgaaacaagaatttaaccctaagtcccccaatcaagtgtggacaaccgactttacttatatttctatcggtcctaagcgtcacgtttatctctgcgccattcttgatctctactctagaaaatgtatcgcttggaaagtaagtgataagattgatgctcaactcgcctgtgacactcttgaaatagctttgaataagagaaaacctaaggaacccattatttttcattctgatcaaggaagccaatttaaatcaacttcttttagaaagctattagatgagcatcagttgcttgcttcttattctaaacctggatatccttatgataatgccgtgactgaggtctttttcaagtaccttaaacaacgagaaattaatcgaagaacttatcactcaattcaggaagtccaactctcttgttttgaatatatcgaacaattttataacaactataatcctcattctgctaataatggtttaactccaaatcagaaagaagaaaactattttaagaaaatatagctcattttgtgtctaaatatttgacattagtccaaaatgatataaatatttttatatgttatactgatattataaactatacctttacggtaaggtcaaggagaaagaatggaaaataaaaattatttgactataggaaaacttagcagctattctggtatacatatcaaggctttaagatattatgagtctatcggcattttacatccagcattaattgatgctaataatggttaccgctattactctcatgcacatattccatatgtgaaaattataaaattatgtgctgattatggaattcctctagggacttttaacgactttattaagtccgaaactgagatcaatttgatcgaaatcattagaaaagctagtaacatattagaattaaaagaaaagcaattaaaagaggataagcaatttttagaatatatacaaaatgaaataagcttatctcaaaaactagactcatcaattaatgttgatttagagcaaactcatgaggattttatcttgatacctttcgatgatgtatttttttcaaataagtactatgatacaattaataaaactatctctatgttgaaggatttagaaatagaattttttaaccgaattgggtgttattattcactccagtatggtaactacgataaatttcttgccttaaaagttcggggccactcatcaaagttaaaaaacataaaaattttgcatattgatcatgtctgtgttcaagcacaacatattgaacctgataagataacggatgaattaattagacttaaaaaacttaagcaaaattctatattaattctggaaacttacgaaaatccgtacaacttttcaacgccacatctggaattaaggatattattaaattaattggcagttatctaaaaatacaatactagatatgtatctagtattgtattttttaatttgggagtaggaatactacatttggttctgttgcaaagttttaaataaagaataaaatcccttacggcatctatgatttaagctgggattcccaataataccttgatttcagtacagaccgaaaacccgaagagagtgccttcttttcgggttttcttatataatcctcggatggcttccatgcctttaatcgtggtagaggcagtgcgtaaacttcgatagaatttattgcgtctctttactggacgatggtcttgttcaatcaaattattcaggtatttaatggtacgatgttctgtcccttgataaaagctgacgttaagtcaagtttttagagtaacaaacgtagaattagctaatcaacttttagttagtagcaaaactatatctaattgggaaactgggaagacgactcctgatattgataaccttattcgtatagcttctttatttcaaatatctttagataatttattaacggaggggtcagaagtggtagaaaatataaagaaaaaggcagagattaataatttaaaaaaatattcatactgtacagtcattacagatttagtttttttattcataattttgagtagccattatggtgcagagttaccaatatcaattttaatagccacttgtattggtattggtataaatattgcagtgatgttctatttttttaaataaaattaaaattttggaagataaaactaaaaagcaacagagaaaagagattttcataacaataatcttatgcatactagctttcgttgttacaatgctcgtctcatggtttaagcattaataatgaacaaatgactaataaaatagctattttggggttggatattagagaattaatctataggattctctttttattctttattttgttatgattgatttagaagaaggaggatttttaattatggaaaaaataaatgaagttcctgggcaagtgagttttggacgagcattgaaggatttttttattggatatattgatttcaagggaagaacgactcgagctggatattggtggatgacgttaattttaatgattatttcatttgttccaattatattttttgtctatgtagcaattggttctgcgtttgtctaaaaatgagtggctcagtcaagaaacagctgaaaaagccattgaaaaattggatgctattactcctttcattggtttcccagataaattgcctgaaatttatagtcgtttaaaaacaacttctggctctctctatgaagatgcccttaaattcgatgaaattttgactgctcgaacttttgaaaaattctcagaagatgttgataaaacaagctggcatatgcctgctcatatggtcaatgcttattatagtcctgatagtaatacaattgtttttccagcagcaattttgcaagctcctttttactctcttgaacaatcttcatcacaaaattacggtggaatcggcacagttattgctcacgaaatttctcacgcttttgataacaacggtgcccaattcgataaagaaggaaatttgaacaaatggtggttagatgaagattatgaagcttttgaagaaaagcaaaaagaaatgattgcactctttgacggcgtagaaaccgaagctggtccagcaaacggaaaactcattgtgtcagaaaatattgctgaccaaggaggaattacagcggcactgacagcagctaaagatgagaaagacgttgatttgaaagctttctttagtcagtgggctaagatttggcgcatgaaagcaagtaaagaattgcctaactttttacctaaatacattaataagtagatattccccacaataaatataattagaatgagtacagctagtaaggataacttgtgtgcgccagtttctaaagaaaaaccttttgctccaccataaacagccatccctatttgactgagtattgcaagccccaatacaataaaaaatttcttaatataattcaaaattattttccaactttcattaataaattaaatttagggtactggaaatttttataacagaaccctttttattctttttcaattcaaatatagattattattattcttttgctcgtaagaaaaagagtataaagccattatccgattttgtagtaactgcattagttggtaacactgtcaaaataaagaacagtatccctatcgcgtatgtcaaaaatgtgaatattgcacttccgccgctttgttgtaaggtacttattgtttctgtgcagctagaagcaatggatatgacccataaaactaaaaatcctcgccctcgtaaaccagcatctcgatagcgtctcacagccatagcgaggcttggaagaaataatgatagcccaataatagccataataaacaatggaataataaagctttcaaacgtagaagccaaaaaatcagtttcgtttgcactccctgaaatactcatagacctaactttttacctaaatacattaataagtagatgttccccacaataaatataattagaatgagtacagctagtaaggataacttgtgtgcaccggtttctaaagaaaaaccttttgctccaccataaacagccatccctatttgactgagtattgcaagccccaatacaataaaaaatttcttaatataattcaaaattcttttccaactttcattaatagattaaatttagggtactggaaatttttataacagaaccctttttattctttttgaattcaaatatagattattattattcttttgctcgtaagaaaaagagtataaagccattatccgattttgtagtaactgcattagttggtaacactgtcaaaataaagaacagtaaccctatcgcgtatgtcaaaaatgtgaatattgcacttccgctgctttgttgtaaggtacttattgtttctgtgcagctagaagcaatggatatgccccataaaactaaaaatcctcgccctcgtaaaccagcatctcgatagcgtctcacagccatagcgaggcttgggagaaataatgatatcccaataatagccataataaacaatggaataataaagctttcaaacgtagaagccaaaaaatcagtttcgtttgcactccctgaaatactcatattgatacttctatctaaataaaaaactatataattgaactcacttaccaaaaaagcctcataatagaggcttttatttctcgcgatttatctagaaatttatttaactctagcttctttatctgtattgtcttctactttgtcttttactttatcaacttgttcagaggtgaattttccagttgtttgagccgcactagtcactcgatcttgaatacttacatcatcttctttttgttgctctttcgttttaatatctgtgactgttacgttaacttcaacaacttccaattctgttattgccacaacctctttacgaatgacttctttaattttttcataaatatcaggcacattcttacgatattctgtaactactttcaagtctactgcaacttgtgttttcccaacttctacatcaacgcctgttgtaacatcatcagtattaataagttttcctgttaggtttgagaagaacccaccttctacggaaagaagtccatccactgattctaatgctaatcctacaatcttttgcacaactttatcttcataagtcaaagatcctttaatatctggttgggtttcctttgttttaggagtttctttttctgccattgttccaaatgctttcatgttttcttgtaccataatcttcaaatattatggtacaagaaaacatgaaagcatttggaacaatggcagaaaaagaaactcctaaaacaaaggaaacccaaccagaaattaaggggactttgacttatgaagataaagttgtgcaaaagattgtaggactagcattagaatcagtggatggacttctttctgtagaaggtgggttcttctcaaacttaacaggaaaacttattaatactgatgatgttacaacaggtgttgacgtagaagttgggaaaacacaggttgcagtagacttgaaagtagttacagaatatcgtaagaatgtgcctgatatttatgaaaaaattaaagaagtcattcgtaaagaggttgcggcaatgacagaattggaagttgttgaagttaacgtaacagtcacagatattaaaacgaaagagcaacaaaaagaagatgatgtaagtattcaagatcgagtgactagtgcggctcaaacaactgggaaattcacctctgaacaagttgataaagtaaaagacaaagtagaagacaatacagataaagaagctagagttaaataaatttctagataaatcgtgagaaataaaagcctctattatgaggcttttttagtaagtgagttcaattatatagttttttatttagatagaagtatcgaataaaagcattttttaatatgattactgcttttattatttcctccaaaactgttgttttaccttcatttcccgtaatgttcagaaaattcatgaagatatccaaaatgataattttttgcaaatatacagaaaaagcagtatacttttattaagtctatttagaaagatttcattgaggtaaatatggaaagtgaaaatattttggaagcaaaacaagtgagtgttgcttttcggattgctggtaaatttcaaaaagcaatttatgatattgatttaagtcttaaacgtggtgaagttttagctattgttggggaatcaggttctgggaagtcaacttttgcaactgctgttatgggattacataatccaaatcaaactcaaattacaggctccattttattggatgatgaagaagtgattggtaaaacgggtgattccatggcaagtattcgaggaagtaaagttggaatgatttttcaaaatccactcactgcgcttaatccattgatgaaaattgggcagcaaatcaaggaaatgttggccgtgcatgatgtttatccagaaaatcagtatgaaagtagaatctttcaacttttagaacaagtaggaattccaaataaaatcaacgcttgagaaaattacttcttgaaatctatatgaaagccaagaaaagaatcggaacaagagcttttaaaattattctcctgcgtgattatggcgtcaatatttctgaagggcgtatcttaagacttctcaagtctatgacactccctaaaatgtcaaccattaaacctcgtttttattcaaacaaatcgcccgaattttcttctgataatctactgaaacaagaatttaacccgaactccccaaatcaagtgtggacaactgacttcacttatatttctataggacctaaacgacatatttatctctgtgctattcttgacctctactcaaggaaatgtattgcgtggaaagtaagtgatcgaattgatgccaaactcgcctgggataccttagagatagctataaagaaaagaaaacctaaagaaccaatcatttttcattctgatcaaggcagtcaatttaagtcagcttcctttagaaagctattagatgagcatcaattgcttgcttcttactccaagcctggatatccttatgataatgccgtggctgatttaactggagcaggaacaggaactctaattattcaaaaatggcaagatgaccgaatgaatgcagacttttttaactatttgccgagtaactattggtaccaggcattagaattatcagatgaagctgtatcgttcttaatccacgcttttgcaattcgaggaatgaatggtgtaatcattcatggtgatgcattggaaatggccgcgaaacaagtttatttcattcaaaacagtgctaataatccgattggtttctcagagataaatgttatccctcacagcaaagatgcaatggaatttttagggattcatgaatggacggaacaggcaattgaacatattgaaagtaaatttcctgactggattccactcatagaagaaaagaaagaacagatgagtttatttgacgaggtttcagaatgaccgacaaagaatttagaatttgcaccagatgtggtgttatggatttaaagaatgatatgtggaacatgaattacggatactatctctgtgatgactgttactgggaagacgagtgcgaaaaatgaccccaacaaatgcttttgtcaatggattttcatgcacccgctaaacttcgtgcaaatattcctccaacaaatctcgaagaattttacgatacttttgatgttaaagaaacagataagatgtatcgtgcaccagaaaatcgtcttaaaatttggtaatcattgaatttatattaatgatatatttaaattgagtcaaataatttagaaaaagcacctataatcacaaagttatgagtgctttttccactttttgatatattataaaaagagttattgctagcacggttaggataccagagtatacttcaaaggtttatatttattttctgatataattggattcctagaaggtcaaataagttgatcatcgagtccattcagaaaaacagcagaggtggtttaatgctagagaatgaatattttgtatttactggcacccttacaacgatgacaagaaaacaagcacaatcaatcattataggtttaaaagggcataatcaggacggcattatcataaggatatccaggcttggagtaagaagcaagcaattgatgctcatctaataactttctaaaggaagctgatttaaattggcttccttgatccgaatgaaagataattggttccttaggcttcctcttatttatagctatttctaaggtgtcgcaggcgagtttggcatcaatttgatcacttactttccacgcaatacatttccttgagtagaggtcaaggatagcacagagataaacatgtcgcttaggtcctatagagatataagtgaaatctgttgtccaaacttgattcggggagttcgggttaaattcttgtttaagcagattatcagaagaaaatacaggagatttatttgatttaaaacgaggtttgaaggttgacattttagggagtgtcatagacttgagaagccttaagatacggccttcagaaatattaacgccataatcacgcagaggtcattgttcttgcccgaattaaacgagttgtccctatccaactaaaaatactgataatcccaatcaaagaccaagaattaaaacgtgggatgatagttacaaaaacaataatgatcatcaatgatggtaaaatcataacaaaatcagtgaaacgcatgaagattaaatcaaatctcccaccaaagtagcccgtaattacccctaagatatttcctacaactaaagtaataagtgtaactgcaaaagcgatattgaaagagtttcgtgcagaaatcattaacatcatgatgatatctcgaccaccattatcagttcccagtaaatgtccatttgtcagtggtgcaagatactggtccataatattaacatcaacataatttgattgttttaaaaacatcgagtaaatataaacgattagaaagacagcaactaggaaaagtgctgaaatcagtgctaatttgtcattcaaaagataaattagcgatgatttcaacaatttttctagttgctgtctttctaatcgtttatatttactcgatgtttttaaaacaatcaaattatgttgatgtgaatatcatggaccaatatctggcaccgctgacgaatggacatttactgggaactgataatggtggacgagatattatcatgatgttaatgatttctgcacgaaactctttcaatatcgcttttgcagttacactcattactttagttgtaggaaatatcttaggggtaattacgggctactttggcggaaggtttgatttaatcttcatgcgtttcactgattttgtcatgattttaccatcaatgatgatcattattgtttttgtaactatcatcccacggtttaattcttggtctttgattgggattatcagtatctttagttggatagggacaacgcgtctgattcgggcaagaacaatgacggttctgtagtgtagcggttatcacgtcgccctgtcacggcgaagatcgcgggttcgattcccgtcagaaccgttagtagaaatactaatgactcgttagctcagttggtagagcatttgacttttaatcaaagggtcgctggttcgagcccagcacgggtcataatcctagcggatgtggcggaattggcagacgcactagatttaggatctagcgcttaacggcgtgggggttcaagtcccttcatccgcatactaggtattagccgacttagctcagttggtagagcatctgatttgtaatcagagggtcgcgtgttcgaatcatgtagtcggcattgtcgtaagacacaaagtttaagtgcgaacgtagttcaggggtagaacacaaccttgccatggttggggtcgcgagttcgaatctcgtcgttcgcttatataaacccacactctgtaactttctaaaggcggagccaagagaaggtgctttatcggtcacaattgctttcggctcaccaaactgtttatggagtcgttttaagaaagcataggctgcttgcgtatcccgtttctttcgtaaccagatatctaaggttaagccgtccgcatcaattgcacgataaagataatgccaacgtcccttaattttgatataggtttcgtccattttccatgaatagaaggattgtctattttgcttcttccaaagataatagaggactttgctgtacccttgcacccaacgataaatcgtagtatgacaaacatttattccacgatcatataacaattcctgaacttcacgatagcttagattgtaacgcaggtagtaaccaacagcgacaataatgacgtcgtacaaaagaagaagaatgctggggttattctaattactcatgatttaggggttgttgctgaagttgccgatacagtggcggtgatgtatgctggacaactcgtcgaaaaagcttctgttgaagagatttttcaaaatcccaaacatccatacacccggtcacttttgcgttcaaatccatctgccgaaacagtttcggatgatttatatgtgattccagggtctgtgccttctctgtcagaaattgaatatgacaaagatttatttctcgctcgagtgccttggatgaaagaagaagctcaaaaagtaatttcggaaaaaatgactgaaatttctctaaatcattttgttcgaggtcaggcttggaaaaaatttgaatttccagatcaaaaattgaaagggggtgtaccccctttcaatttttgatctggaaattcaaattttttccaagcctgacctcgaacaaaatgatttgaagaaatttcagtcattttttccgaaattactttttgagcttcttctttcatccaaggcactcgagcgagaaataaatctttgtcatactcaatttctgacagagaaggcacagaccctggaatcacatataaatcatccgaaactgtttcggcagatggatttgaacgcaaaagtgaccgggtgtatggatgtttgggattttgaaaaagctcttcaacagaagctttttcgacgagttgtccggcatacatcaccgccactgtatcagcaacttcagcaacaacccctaaatcatgagtaattagaataaccccagcattcttcttcttttgtatagtcaaataagtctaaggagatctttcatgatagattatattgaagtggacgggggaaatagtaatttaaaggagcttaactgttcaaacagtaattctttacactcagtggtatatctttttaaccctaaaaataaaatctacgatttttttaaagaagagtatcagcttgatttagaaaaccttttgtatgaagaagaggaagtgatacacgagatatctgatacaaagacaggtaaagaagaattaaagatactttttattttacctcaccaaaacttgaaaaatgatttgaatcggaaaataaaggctttagttatcttaaaactagaggaaaagctcattattgtaacgagtgagaaagaagacttcatttctgatttttttaaggggaagctgtcaataatggatacactcattccttcaacctctttaaagacgagtgcttggcgaatgacttggatactcggtaagagggcattacaacggcggacaaagcgagaatattctaggaaattaggaaataaactttgagccaattggtgcttagctttaagcgtttcactaaaatgcagtacgccccataggtaacaagcgataactaagcaatctgatgttgcgagatggacgttctttcggttttgaacctcaaggggaacactcgtttgataaagcgtctcaatggttgtcagtaaataaacaaaaacttttggaagtgtgctattataagtcatataagtcgtgcgctttctaatgcttagtggagtcgtttcaagaacgcataagcagcttgagtatcccgtttcttgcgtagccagatgtctaaagtcaatccatccgcatcaattgcacgatagagataatgccaacgacctttgattttgatataagtttcatccattttccacgaatagaaggactgtctatttttctttttccagagatgatagaggactttactgtattcttgtacccaacgataaatagttgtgtgacaaacgttaatcccacgatcataaaggagttcttgaatttcacgatagcttagattgtaacgtagataataaccaacagcgacaataatcacatctttttgaaattgtttacctttaaaatagttcattgatatatatccaagctagaaaggtacttattataagctcttaccaaagactttaaggtgtccatcctctcttcaagaagagttacttcattttgcatatgaatttctttaatactttccatttgttctctttttataaagcttaatatttttctatcggaatcaatgataaaatctaacaagataagatattttttcagtcgcaaaatttcatcaaatattgtccctgaaggtcctaaactttgtatttgtgtttccaataaactaatttcttctcttttctctttaacatctttaattactttttggatgctcacattcaaaagctggataaaatttacctcacttctttcaacattttctcctgtatttgttaatctctatcaaactggtaaaacacaaactgaactctgtaaagattatggggtatcttcttctgcacttgcaaaatggattaagcagtactctcaagtgcgtcttgaagataatacggtgttgactgctaaacagattcaaaaattacaaaaaaggaatgcccaactagaggaagaaaatctgatcttaaaaaaagcgagtgccatattcatgcaaaactccaagtaagattgaaagccatctatagactccgatttgaacacacgacagttatgctctgtcgtgttttacatgtcaatcgttccacctactataacttcataaacaagaggccttcgaagcgtgaagtagcaaacattaaaagctgtgtttgataaaaactatacgaatgtcaaagatgaacttaacaaagaaaaaaaagtggaagaaaaaaactactaccgcaacaatacaaataatttcaatctgctcaaaggactaggaacaaatctactctttacgattttacgaggggaaagcgaacctgaacgtcccgctcataaaccgaagaagaaaaagcataaaaacgatagaggatacagtccaaaaatgtaacattcataattgttggaccaatgtcaaatctttagacacaaaatgagctatattttcttaaaataattttcttctttctgatttggagttaaaccccaattataaataataatagttcgtttcagttgaacaatattatgaaaacgttaactgagcttacagttgtcttaacaataccaacaattacttatgggttttggggaataaatctcaagttgccttttcaaggtatcccttatggttcgttacttgtaattgttatttcacttctaatcagtctattagtttggtactggttaaaaaagaaaaaatctctttagaaaaatttataaaattataaagaaaagaaggaaaaactatgaaaattggcctagtaaaagcaaacttccctggagaaagacgagtcccacttctaccaaaagacagtagataccgaaaatccgaagagcgttccatttcttcggttctttttgtatattcctcgaattgtttccatgcccttaatcgtggttgaggcagttcgtagacttcgataaaatttattgcgtcgtttgattggtcgatggtcttgctcaatgaggttattgagatacttcacggttcgatgctctgtcttagtatataaaccgttactctgtaactttctaaatgcagaaccaatagagggcgctttatccgtgacaattactcttggttgaccaaactgtttatgtcaatacagaagaaaatgttgaaagaagtgaggtaaattttatccagcttttgaatgtgagcatccaaaaagtaattaaagatgttaaagagaaaagagaagaaattagtttgttggaaacacaaatacaaagtataggaccttcagggacaatatttgatgaaattttgcgactgaaaaaatatcttatcttgttagattttattattgattccgatagaaaaatattaagctttataaaaagagaacaaatggaaaatattaaagaaatgattcgtaatttcagaagcaaagttcttggagattatgccaatgttggctacaatgctacaaagggacagtacttctatggatgtaaatatcatgctttagtcagtgaatcaggctacgtcatagactacacaattactcctgcttcaatggcagatcgttcaatgaccgaggaagtgttgagtcaatttgggacaccaacagtccttggagatatgggatatctaggtcagtcactgcatgataggctggaattaaacaggtggctgatcaagctcaggcggaacaacaaatccaacatcaagtacagatggtggctcaagttcaggcggaacaacaaatccaacatcaagtacagatggtggctcaagttcaggcggaacaacaaacccaacatcaagcacagatggcggctcaagttcaggtggaacaacaaatccaacatcaagcacagatggcggatcaagctcaggcggaacaacaaacccaacatcaagttgaaaaaccaaagcaaaaattgcttaatctaaaaacattttggtgcttttttttagttttcaatactatcctaattatataaaactaaacctattaatgcaaattacaatattggttccaaaatttaaaccataagaaactttacatatcaaaaaaatataattttaatcaattagcatagattttcaagctattatttacccataaacagtttggggagccgaaagcaattgtgactggtaaagcaccttctcttggctccgcctttagaaagttacagagtgtgggtttatatactaagacagagcaccgaactgtgaagtatcttaacaatttaatagaacaagaccatcgaccaatcaaacgacgcaataaattttatcgaagtctacgaactgcctcggaaaatggcattatttgtatcgagccatcgatgcagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatacggaagtcaatcgagattatgttcgagcatcaaaaacttcgggaacctctgattttaaaattatgtttcgggaaatatggcccaacttgtccaccttagtcattgctgaagcaacgcttgtttttgctggaaatattggtttagaaacagggctttctttcttaggttttggacttccagcaaaatccttttccctaatttttcaaaacgtagaaaagtgattgagcgagttttctcttttttgacaaatctaggagctgagcgttgtaaaagtcgttcgcctcaaggttttcaattgaaattagagatgatacttttagcgtattctttactgttaaaatcagctaaatcactggaaccaattagatcaattccttttaattccagcctatcatgcagtgactgacctaaatatcccatatctccaaggactgttggtgtcccaaattgactcaacacttcctcggtcattgaactatcagccattgaagcaggagtaattgtgtagtctatgacatagcctgattcactgactccttttataatgttatttacgatttataaattgatcaatgattcctgatttttttaaaaatagaccaatataaattcctaatccaattaaaaataaaaccagaatcattttccaaaatccaatagtgaagatacacacagcaatgagtgcacctacgattccccctataatcctaaaagagtcgttaatcaatttcctcaccaactttcaggcgggatgagacaaagagtaatgattgcaatagccattgccaatgacccagatttgattattgctgatgagccaacgactgctttagacgttaccattcaagctcagattttagacttgattttagaatttaattttgatgtacgtttcatccattttccatgaataaaaggattttttatttttctttttccaaatttgatagagtagtttgccatattcttgcacccaacgataaatcgtcgtatgagaaacgttaatgccacgatcatataagatttcttgaacgtcagtgaatcaggctatgtcatagactacacaattactcctgcttcaatggctgatagttcactgaccgaggaagtgttgagtcaatttgggacaccaacagtccttggagatatgggatatttaggtcagtcactgcatgataggctggaattaggcttgatgttggatttgttgttccgcctgaacttgagccaccatctgtacttgatgttggatttgttgttccgcctgaacttgagctaccatctgtacttgatgttgggtttgttgttccacctgaacttgagccgccatctgtgcttgatgttggttcacgatagctaaggttataacgaagatagtagcccacggctacaataatcacatcctgctgaaattgctttcctttaaaatgattcatcgtcattcctcctgctatctttttctattattctaccttatttgatagtagattttgttggcggaatgaggattataattgttataaaattgttcgatgtattcaaagcaagagagttgaacttcttgaatggagtgataagttctgcgattaatttctcgttgtttaagatacttgaaaaagacctcagtcgggtatcgatttttttcgaaataatccattgatccctcctacataacacgttgtcgtttagggttatcgtctttacttaatgtattgacttttactttaagtttaaccgtatgttccaatccaaatggagctatactataaaagtggacagaaaattgtgtgttataatctgtctattaagacacaaaaatgaaaggacttttatgtcaggttttaaacgttacgacgaggatttcaaacaatcgctccttcctttgtgtcagccgattcgtaatttcagaagcaaagttcttggagattatgcaaatgttggctacaatgctacaaagggacagtacttctatggatgtaaatgacatgctttatttgggagtttagctcagctgggagagcatctgccttacaagcagagggtcagcggttcgatcccgttaactcccattggttgtttcagccattaagtgaataaaggaactggaggagctaaggctcctcttttttttatctcgctaacgagattcaagagatgtgatgtatgaataaataaaaaaagacctttcgggcctttttttatttataaagcatgacatttacatccatagaagtactgtccctttgtagcattgtagccaacatttgcataatctccaagaactttgcttctgaaattacgaata
